United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 75

SEQ ID NO: 143379 - DNA, 1884 bp, Artificial Sequence
  Description of Artificial Sequence: Synthetic coding sequence
atgagggccctgagcccccggcccggctaccagagctcctgggccagccggcccatcagcacagcagaatatgccctgctgtaccacaccctgcaggaggccaccaagcccctgcaccagttcttcctgaacaccaccggcttctccttccaggactgccacgaccgctgcctggccttcacagatgtggccccccggggcgtggccagcggccagaggaggtcctggctgatcatccagcgctacgtggagggctacttcctgcaccccaccggcctggagctgctggtggaccacggcagcacagatgctggccactgggccgtggagcaggtgtggtacaacgggaagttctacggcagccctgaggagctggccaggaaatatgcagatggagaggtggatgtggtggtgctggaggaccccctgcccggcggcaaaggacatgacagcacagaggagcccccactcttcagcagccacaagcccaggggggacttccccagccccatccacgtgtctggcccccggctggtgcagccccacggcccccgcttccggctggagggcaatgctgtgctgtatggaggctggagctttgccttccggctgcggagcagcagcggcctgcaggtgctgaatgtgcactttggaggagagcgcatcgcctatgaggtgtctgtgcaggaggccgtggccctgtatggaggccacaccccagctggcatgcagaccaagtacctggatgtgggctggggcctgggctctgtgacccatgagctggcccctggcatcgactgcccagagacagccaccttcctggacaccttccactactatgatgctgatgatcctgtgcactacccccgggccctgtgcctgtttgagatgcccactggagtgcccctgcggcggcacttcaacagcaacttcaagggcggcttcaacttctacgccggcctgaagggccaggtgctggtgctgcggaccaccagcacagtgtacaactatgactacatctgggacttcatcttctaccccaacggggtgatggaggccaagatgcacgccaccggctacgtgcacgccaccttctacaccccagagggcctgcggcacggcacccggctgcacacccacctgattggcaacatccacacccacctggtgcactacagagtggacctggatgtggccggcaccaagaacagcttccagaccctgcagatgaagctggagaacatcaccaacccctggagccccaggcaccgggtggtgcagcccaccctggagcagacccagtacagctgggagcggcaggccgccttccgcttcaagaggaagctgcccaagtacctgctcttcaccagcccccaggagaacccctggggccacaagaggacctaccgcctgcagatccacagcatggctgaccaggtgctgcccccaggctggcaggaggagcaggccatcacctgggcccgctaccccctggccgtgaccaagtaccgggagagcgagctgtgcagcagcagcatctaccaccagaatgacccctggcacccccctgtggtgtttgagcagttcctgcacaacaatgaaaatattgaaaatgaagacctggtggcctgggtgacagtgggcttcctgcacatcccccacagcgaggacatccccaacacagccaccccaggcaacagcgtgggcttcctgctgcggcccttcaacttcttccctgaggaccccagcctggccagccgggacacagtgattgtgtggccccgggacaatggccccaactacgtgcagcgctggatccctgaggaccgggactgcagcatgcccccacccttctcctacaacggcacctacagacctgtgtag

SEQ ID NO: 143380 - DNA, 750 bp, Artificial Sequence
  Description of Artificial Sequence: Synthetic coding sequence
atgcctgccctgggctgggccgtggccgccatcctgatgctgcagacagccatggccgagcccagccctggcaccctgcccaggaaggccggggtcttcagtgacctgagcaaccaggagctgaaggctgtgcacagcttcctgtggagcaagaaggagctgcggctgcagcccagcagcaccaccaccatggccaagaacacagtgttcctgattgagatgctgctgcccaagaagtaccacgtgctgcgcttcctggacaagggggagcggcaccctgtgcgggaggcccgggctgtgatcttctttggagaccaggagcaccccaacgtgacagaatttgctgtgggccccctgcccggcccctgctacatgagggccctgagcccccggcccggctaccagagctcctgggccagccggcccatcagcacagcagaatatgccctgctgtaccacaccctgcaggaggccaccaagcccctgcaccagttcttcctgaacaccaccggcttctccttccaggactgccacgaccgctgcctggccttcacagatgtggccccccggggcgtggccagcggccagaggaggtcctggctgatcatccagcgctacgtggagggctacttcctgcaccccaccggcctggagctgctggtggaccacggcagcacagatgctggccactgggccgtggagcaggtgtggtacaacgggaagttctacggcagccctgaggagctgtag

SEQ ID NO: 143381 - DNA, 2256 bp, Artificial Sequence; identical to SEQ ID NO: 143377
  Description of Artificial Sequence: Synthetic coding sequence

SEQ ID NO: 143382 - DNA, 1014 bp, Artificial Sequence
  Description of Artificial Sequence: Synthetic coding sequence
atgcctgccctgggctgggccgtggccgccatcctgatgctgcagacagccatggccgagcccagccctggcaccctgcccaggaaggccggggtcttcagtgacctgagcaaccaggagctgaaggctgtgcacagcttcctgtggagcaagaaggagctgcggctgcagcccagcagcaccaccaccatggccaagaacacagtgttcctgattgagatgctgctgcccaagaagtaccacgtgctgcgcttcctggacaagggggagcggcaccctgtgcgggaggcccgggctgtgatcttctttggagaccaggagcaccccaacgtgacagaatttgctgtgggccccctgcccggcccctgctacatgagggccctgagcccccggcccggctaccagagctcctgggccagccggcccatcagcacagcagaatatgccctgctgtaccacaccctgcaggaggccaccaagcccctgcaccagttcttcctgaacaccaccggcttctccttccaggactgccacgaccgctgcctggccttcacagatgtggccccccggggcgtggccagcggccagaggaggtcctggctgatcatccagcgctacgtggagggctacttcctgcaccccaccggcctggagctgctggtggaccacggcagcacagatgctggccactgggccgtggagcaggtgtggtacaacgggaagttctacggcagccctgaggagctggccaggaaatatgcagatggagaggtggatgtggtggtgctggaggaccccctgcccggcggcaaaggacatgacagcacagaggagcccccactcttcagcagccacaagcccaggggggacttccccagccccatccacgtgtctggcccccggctggtgcagccccacggcccccgcttccggctggagggcaatgctgtgctgtatggaggctggagctttgccttccggctgcggagcagcagcggcctgcaggtgctgtag

SEQ ID NO: 143383 - DNA, 582 bp, Artificial Sequence
  Description of Artificial Sequence: Synthetic coding sequence
atggaggccaagatgcacgccaccggctacgtgcacgccaccttctacaccccagagggcctgcggcacggcacccggctgcacacccacctgattggcaacatccacacccacctggtgcactacagagtggacctggatgtggccggcaccaagaacagcttccagaccctgcagatgaagctggagaacatcaccaacccctggagccccaggcaccgggtggtgcagcccaccctggagcagacccagtacagctgggagcggcaggccgccttccgcttcaagaggaagctgcccaagtacctgctcttcaccagcccccaggagaacccctggggccacaagaggacctaccgcctgcagatccacagcatggctgaccaggtgctgcccccaggctggcaggaggagcaggccatcacctgggcccgctaccccctggccgtgaccaagtaccgggagagcgagctgtgcagcagcagcatctaccaccagaatgacccctggcacccctggagcctgagcagcttcttcaccaccaccaggaccctgaagatgaggacctggtggccaggatag

SEQ ID NO: 143384 - DNA, 2256 bp, Artificial Sequence; identical to SEQ ID NO: 143377
  Description of Artificial Sequence: Synthetic coding sequence

SEQ ID NO: 143385 - DNA, 1191 bp, Artificial Sequence
  Description of Artificial Sequence: Synthetic coding sequence
atgctgcccagcctgcaggagagcatggatggagatgagaaggagctggagagcagcgaggagggcggcagcgctgaggagcggcggctggagccccccagcagcagccactactgcctgtacagctaccggggcagccggctggcccagcagagaggagacagtgaagatggcagccccagcggcaccaatgctgagaccccatctggagatgacttcagcctgagcctggccgacaccaacctgcccagcgaggtggagcctgagctgcggagcttcatcgccaagaggctgagcagaggagctgtgtttgagggcctgggcaatgtggcctctgtggagctgaagatccctggctacagagtgggctgctactactgcctcttccagaatgagaagctgctgcctgagaccgtgaccattgattctgaaagaaaccccagtgaatatgtggtgtgcttcctgggcggcagcgagaagggcctggagaccttccggctggagctggacaagtacatccagggcctgaagaacaacatgaactgtgaggcccggggcctggagagccacatcaagagctacctgagctcctggtttgaagatgtggtgtgccccatccagagggtggtgctgctcttccaggagaagctgaccttcctgctgcatgctgccctgagctacacccctgtggaggtgaaggagagtgatgagaagaccaagagggacatcaaccgcttcctgtctgtggccagcctgcagggcctcatccacgagggcaccatgaccagcctgtgcatggccatgacagaggagcagcacaagtctgtggtgattgactgcagcagcagccagccccagttctgcaatgccggcagcaaccgcttctgtgaggactggatgcaggccttcctgaatggagccaagggcggcaaccccttcctgttccggcaggtgctggagaacttcaagctgaaggccatccaggacaccaacaacctgaagcgcttcatccggcaggccgagatgaaccactacgccctcttcaagtgctacatgttcctgaagaactgtggcagcggggacatcctgctgaagatcgtgaaggtggagcacgaggagatgcctgaggccaagaatgtgattgctgtgctggaggagttcatgaaggaggccctggaccagagcttctag

SEQ ID NO: 143386 - DNA, 1539 bp, Artificial Sequence
  Description of Artificial Sequence: Synthetic coding sequence
atggacctgaaggagagccccagcgagggcagcctgcagcccagcagcatccagatctttgccaacaccagcaccctgcacggcatccgccacatctttgtgtatggccccctgaccatcagaagagtgctgtgggccgtggcctttgtgggcagcctgggcctgctgctggtggagagcagcgagcgggtgtcctactacttctcctaccagcacgtgaccaaggtggatgaggtggtggcccagagcctggtgtttcctgctgtgaccctgtgcaacctgaatggcttccgcttcagccggctgaccaccaatgacctgtaccacgccggggagctgctggccctgctggatgtgaacctgcagatcccagacccccacctggccgaccccagcgtgctggaggccctgcggcagaaggccaacttcaagcactacaagcccaagcagttctccatgctggagttcctgcaccgggtgggccatgacctgaaggacatgatgctgtactgcaagttcaagggccaggagtgtggccaccaggacttcaccaccgtcttcaccaagtatggcaagtgctacatgttcaacagcggggaggatggcaagcccctgctgaccaccgtgaagggcggcactggaaatggcctggagatcatgctggacatccagcaggatgagtacctgcccatctggggcgagacagaggagaccacctttgaggccggcgtgaaggtgcagatccacagccagagcgagccccccttcatccaggagctgggcttcggcgtggcccctggcttccagacctttgtggccacccaggagcagaggctgacctacctgcccccaccctggggcgagtgccgcagcagcgagatgggcctggacttcttccctgtgtacagcatcacagcctgcagaattgactgtgagacccgctacatcgtggagaactgcaactgcaggatggtgcacatgcctggagatgcccccttctgcaccccagagcagcacaaggaatgtgccgagcccgccctgggcctgctggccgagaaggacagcaactactgcctgtgcaggaccccctgcaacctgacccgctacaacaaggagctgtccatggtgaagatccccagcaagaccagcgccaagtacctggagaagaagttcaacaagtctgagaagtacatcagcgagaacatcctggtgctggacatcttctttgaggccctgaactatgagaccatcgagcagaagaaggcctatgaggtggccgccctgctgggggacatcggcggccagatgggcctcttcatcggggccagcatcctgaccatcctggagctgtttgactacatctatgagctgatcaaggagaagctgctggacctgctgggcaaggaggaggatgagggcagccatgatgaaaatgtgtccacctgtgacaccatgcccaaccacagcgagaccatcagccacacagtgaatgtgcccctgcagaccaccctgggcaccctggaggagatcgcctgctag

SEQ ID NO: 143387 - DNA, 612 bp, Artificial Sequence
  Description of Artificial Sequence: Synthetic coding sequence
atgttcaacagcggggaggatggcaagcccctgctgaccaccgtgaagggcggcactggaaatggcctggagatcatgctggacatccagcaggatgagtacctgcccatctggggcgagacagaggagaccacctttgaggccggcgtgaaggtgcagatccacagccagagcgagccccccttcatccaggagctgggcttcggcgtggcccctggcttccagacctttgtggccacccaggagcagaggctgacctacctgcccccaccctggggcgagtgccgcagcagcgagatgggcctggacttcttccctgtgtacagcatcacagcctgcagaattgactgtgagacccgctacatcgtggagaactgcaactgcaggatggtgcacatgcctggagatgcccccttctgcaccccagagcagcacaaggaatgtgccgagcccgccctgggcctgctggccgagaaggacagcaactactgcctgtgcaggaccccctgcaacctgacccgctacaacaaggagctgtccatggtgaagatccccagcaagaccagcgccaagtacctggagaagaagttcaacaagtctgagaagtactag

SEQ ID NO: 143388 - DNA, 1287 bp, Artificial Sequence
  Description of Artificial Sequence: Synthetic coding sequence
atggctgtgggcgccagcggcctggagggggacaagatggccggggccatgcccctgcagctgctgctgctgctgatcctgctgggccctggcaacagcctgcagctgtgggacacctgggcagatgaggccgagaaggccctgggccccctgctggcccgggaccggcggcaggccacagaatatgagtacctggactatgacttcctgcctgagacagagcccccagagatgctgaggaacagcacagacaccacccccctgactggacctggcaccccagagagcaccaccgtggagcctgctgcccggcgcagcacaggcctggatgctggaggagctgtgacagagctgaccacagagctggccaacatgggcaacctgagcacagacagcgctgccatggagatccagaccacccagcctgctgccacagaggcccagaccacccagcctgtgcccacagaggcccagaccacccccctggccgccacagaggcccagaccacccggctgacagccacagaggcccagaccacccccctggccgccacagaggcccagaccaccccacctgctgccacagaggcccagaccacccagcccaccggcctggaggcccagaccacagccccagctgccatggaggcccagaccacagccccagctgccatggaggcccagaccaccccacctgctgccatggaggcccagaccacccagaccacagccatggaggcccagaccacagcccctgaggccacagaggcccagaccacccagcccacagccacagaggcccagaccacccccctggccgccatggaggccctgagcacagagcccagcgccacagaggccctgtccatggagcccaccaccaagaggggcctcttcatccccttctctgtgtcctctgtgacccacaagggcatccccatggccgccagcaacctgtctgtgaactaccctgtgggcgccccagaccacatctctgtgaagcagtgcctgctggccatcctgatcctggccctggtggccaccatcttctttgtgtgcaccgtggtgctggccgtgcggctgagcaggaagggccacatgtaccctgtgaggaactacagccccacagagatggtgtgcatcagcagcctgctgcctgatggaggagagggccccagcgccacagccaatggaggcctgagcaaggccaagagccctggcctgaccccagagccccgggaggaccgggagggagatgacctgaccctgcacagcttcctgccctag

SEQ ID NO: 143389 - DNA, 1587 bp, Artificial Sequence
  Description of Artificial Sequence: Synthetic coding sequence
atggagctgaaggccgaggaggaggaggtgggcggcgtgcagcctgtgtccatccaggcctttgccagcagcagcaccctgcacggcctggcccacatcttctcctatgaaaggctgagcctgaagagggccctgtgggccctgtgcttcctgggcagcctggccgtgctgctgtgtgtgtgcacagagcgggtgcagtactacttccactaccaccacgtgaccaagctggatgaggtggccgccagccagctgaccttccctgctgtgaccctgtgcaacctgaatgagttccgcttcagccaggtgtccaagaatgacctgtaccacgccggggagctgctggccctgctgaacaacagatatgagatcccagacacccagatggctgatgagaagcagctggagatcctgcaggacaaggccaacttccgctccttcaagcccaagcccttcaacatgagggagttctatgacagagctggccatgacatccgggacatgctgctgagctgccacttccggggggaggtgtgcagcgctgaggacttcaaggtggtgttcaccaggtatggcaagtgctacaccttcaacagcggcagagatggccggccccggctgaagaccatgaagggcggcactggaaatggcctggagatcatgctggacatccagcaggatgagtacctgcctgtgtggggcgagacagatgagaccagctttgaagctggcatcaaggtgcagatccacagccaggatgagccccccttcatcgaccagctgggctttggagtggcccctggcttccagacctttgtggcctgccaggagcagaggctcatctacctgcccccaccctggggcacctgcaaggctgtgaccatggacagcgacctggacttctttgacagctacagcatcacagcctgcagaattgactgtgagacccgctacctggtggagaactgcaactgcaggatggtgcacatgcctggagatgccccctactgcaccccagagcagtacaaggaatgtgccgaccctgccctggacttcctggtggagaaggaccaggagtactgtgtgtgtgagatgccctgcaacctgaccaggtatggcaaggagctgtccatggtgaagatccccagcaaggccagcgccaagtacctggccaagaagttcaacaagtctgagcagtacatcggggagaacatcctggtgctggacatcttctttgaggtgctgaactatgagaccatcgagcagaagaaggcctatgaaattgctggcctgctgggggacattggaggccagatgggcctcttcatcggggccagcatcctgactgtgctggagctgtttgattatgcctatgaggtgatcaagcacaagctgtgcagaagaggcaagtgccagaaggaggccaagaggagcagcgctgacaagggcgtggccctgagcctggatgatgtgaagaggcacaacccctgtgagagcctgcggggccaccctgctggcatgacctacgccgccaacatcctgccccaccacccagcccggggcacctttgaggacttcacctgctag

SEQ ID NO: 143390 - DNA, 1689 bp, Artificial Sequence
  Description of Artificial Sequence: Synthetic coding sequence
atgcccatccagatcttctgcagcatgtccttcagcagtggagaggaggcccctggccccctgggggacatctggggcccccaccaccaccagcagcagcaggacatcagcgagagcgaggaggaggaggaggagaaggagaaggaggccgtgaggaaggaggccagcgagggccacagccccatggacctggtggcctttgccaacagctgcaccctgcacggcaccaaccacatctttgtggagggcggccctggcccccggcaggtgctgtgggccgtggcctttgtgctggccctgggcgccttcctgtgccaggtgggggacagagtggcctactacctgagctacccccacgtgaccctgctgaatgaggtggccaccacagagctggccttccctgctgtgaccctgtgcaacaccaatgctgtgcggctgagccagctgagctacccagacctgctgtacctggcccccatgctgggcctggatgaaagtgatgatcctggggtgcccctggcccctcctggccctgaggccttcagcggggagcccttcaacctgcaccgcttctacaacagaagctgccaccggctggaggacatgctgctgtactgcagctaccagggcggcccctgtggcccccacaacttctctgtggtgttcaccaggtatggcaagtgctacaccttcaacagcggcagagatggccggccccggctgaagaccatgaagggcggcactggaaatggcctggagatcatgctggacatccagcaggatgagtacctgcctgtgtggggcgagacagatgagaccagctttgaagctggcatcaaggtgcagatccacagccaggatgagccccccttcatcgaccagctgggctttggagtggcccctggcttccagacctttgtggcctgccaggagcagaggctcatctacctgcccccaccctggggcacctgcaaggctgtgaccatggacagcgacctggacttctttgacagctacagcatcacagcctgcagaattgactgtgagacccgctacctggtggagaactgcaactgcaggatggtgcacatgcctggagatgccccctactgcaccccagagcagtacaaggaatgtgccgaccctgccctggacttcctggtggagaaggaccaggagtactgtgtgtgtgagatgccctgcaacctgaccaggtatggcaaggagctgtccatggtgaagatccccagcaaggccagcgccaagtacctggccaagaagttcaacaagtctgagcagtacatcggggagaacatcctggtgctggacatcttctttgaggtgctgaactatgagaccatcgagcagaagaaggcctatgaaattgctggcctgctgggggacattggaggccagatgggcctcttcatcggggccagcatcctgactgtgctggagctgtttgattatgcctatgaggtgatcaagcacaagctgtgcagaagaggcaagtgccagaaggaggccaagaggagcagcgctgacaagggcgtggccctgagcctggatgatgtgaagaggcacaacccctgtgagagcctgcggggccaccctgctggcatgacctacgccgccaacatcctgccccaccacccagcccggggcacctttgaggacttcacctgctag

SEQ ID NO: 143391 - DNA, 1650 bp, Artificial Sequence
  Description of Artificial Sequence: Synthetic coding sequence
atgaagcccaccagcggccctgaggaggcccggcggcctgccagtgacatccgggtgtttgccagcaactgcagcatgcacggcctgggccacgtgtttggacctggcagcctgagcctgcggcggggcatgtgggccgctgctgtggtgctgtctgtggccaccttcctgtaccaggtggccgagcgggtgcgctactaccgggagttccaccaccagacagccctggatgagcgggagagccacaggctcatcttccctgctgtgaccctgtgcaacatcaaccccctgcggcgcagccggctgaccccaaatgacctgcactgggccggcagcgccctgctgggcctggaccctgctgagcacgccgccttcctgcgggccctgggccggcccccagcccctcctggcttcatgcccagccccacctttgacatggcccagctgtatgcccgggccggccacagcctggatgacatgctgctggactgccgcttccggggccagccctgtggccctgagaacttcaccaccatcttcaccaggatgggcaagtgctacaccttcaacagcggggctgatggagctgagctgctgaccaccacccggggcggcatgggaaatggcctggacatcatgctggatgtgcagcaggaggagtacctgcctgtgtggagggacaatgaggagaccccatttgaggtgggcatccgggtgcagatccacagccaggaggagccccccatcatcgaccagctgggcctgggcgtgtccccaggctaccagacctttgtgtcctgccagcagcagcagctgtccttcctgcccccaccctggggagactgcagcagcgccagcctgaaccccaactatgagcctgagcccagcgaccccctgggcagccccagccccagccccagccccccctacaccctgatgggctgccgcctggcctgtgagaccaggtatgtggccaggaaatgtggctgcaggatggtgtacatgcctggagatgtgcctgtgtgcagcccccagcagtacaagaactgtgcccacccagccattgatgccatgctgaggaaggacagctgtgcctgccccaacccctgtgccagcaccaggtatgccaaggagctgtccatggtgcgcatccccagcagagctgctgcccgcttcctggccaggaagctgaacagaagtgaggcctacatcgccgagaatgtgctggccctggacatcttctttgaggccctgaactatgagaccgtggagcagaagaaggcctatgagatgtctgagctgctgggggacatcggcggccagatgggcctcttcatcggggccagcctgctgaccatcctggagatcctggactacctgtgtgaggtgttccgggacaaggtgctgggctacttctggaaccggcagcacagccagaggcacagcagcaccaacctgctgcaggagggcctgggcagccacaggacccaggtgccccacctgagcctgggccccagcaccctgctgtgcagcgaggacctgccccccctgcctgtgcccagcccccggctgagccccccacccacagccccagccaccctgagccacagcagcaggcctgctgtgtgtgtgctgggcgccccaccctag

SEQ ID NO: 143392 - DNA, 1596 bp, Artificial Sequence
  Description of Artificial Sequence: Synthetic coding sequence
atgaagcccaccagcggccctgaggaggcccggcggcctgccagtgacatccgggtgtttgccagcaactgcagcatgcacggcctgggccacgtgtttggacctggcagcctgagcctgcggcggggcatgtgggccgctgctgtggtgctgtctgtggccaccttcctgtaccaggtggccgagcgggtgcgctactaccgggagttccaccaccagacagccctggatgagcgggagagccacaggctcatcttccctgctgtgaccctgtgcaacatcaaccccctgcggcgcagccggctgaccccaaatgacctgcactgggccggcagcgccctgctgggcctggaccctgctgagcacgccgccttcctgcgggccctgggccggcccccagcccctcctggcttcatgcccagccccacctttgacatggcccagctgtatgcccgggccggccacagcctggatgacatgctgctggactgccgcttccggggccagccctgtggccctgagaacttcaccaccatcttcaccaggatgggcaagtgctacaccttcaacagcggggctgatggagctgagctgctgaccaccacccggggcggcatgggaaatggcctggacatcatgctggatgtgcagcaggaggagtacctgcctgtgtggagggacaatgaggagaccccatttgaggtgggcatccgggtgcagatccacagccaggaggagccccccatcatcgaccagctgggcctgggcgtgtccccaggctaccagacctttgtgtcctgccagcagcagcagctgtccttcctgcccccaccctggggagactgcagcagcgccagcctgaaccccaactatgagcctgagcccagcgaccccctgggcagccccagccccagccccagccccccctacaccctgatgggctgccgcctggcctgtgagaccaggtatgtggccaggaaatgtggctgcaggatggtgtacatgcctggagatgtgcctgtgtgcagcccccagcagtacaagaactgtgcccacccagccattgatgccatgctgaggaaggacagctgtgcctgccccaacccctgtgccagcaccaggtatgccaaggagctgtccatggtgcgcatccccagcagagctgctgcccgcttcctggccaggaagctgaacagaagtgaggcctacatcgccgagaatgtgctggccctggacatcttctttgaggccctgaactatgagaccgtggagcagaagaaggcctatgagatgtctgagctgctgggggacatcggcggccagatgggcctcttcatcggggccagcctgctgaccatcctggagatcctggactacctgtgtgaggtgttccgggacaaggtgctgggctacttctggaaccggcagcacagccagaggcacagcagcaccaacctgctgcaggagggcctgggcagccacaggacccaggtgccccacctgagcctgggccccaggcctcccaccccaccctgtgctgtgaccaagaccctgagcgccagccacaggacctgctacctggtgacccagctgtag

SEQ ID NO: 143393 - DNA, 1632 bp, Artificial Sequence
  Description of Artificial Sequence: Synthetic coding sequence
atgaagcccaccagcggccctgaggaggcccggcggcctgccagtgacatccgggtgtttgccagcaactgcagcatgcacggcctgggccacgtgtttggacctggcagcctgagcctgcggcggggcatgtgggccgctgctgtggtgctgtctgtggccaccttcctgtaccaggtggccgagcgggtgcgctactaccgggagttccaccaccagacagccctggatgagcgggagagccacaggctcatcttccctgctgtgaccctgtgcaacatcaaccccctgcggcgcagccggctgaccccaaatgacctgcactgggccggcagcgccctgctgggcctggaccctgctgagcacgccgccttcctgcgggccctgggccggcccccagcccctcctggcttcatgcccagccccacctttgacatggcccagctgtatgcccgggccggccacagcctggatgacatgctgctggactgccgcttccggggccagccctgtggccctgagaacttcaccaccatcttcaccaggatgggcaagtgctacaccttcaacagcggggctgatggagctgagctgctgaccaccacccggggcggcatgggaaatggcctggacatcatgctggatgtgcagcaggaggagtacctgcctgtgtggagggacaatgaggagaccccatttgaggtgggcatccgggtgcagatccacagccaggaggagccccccatcatcgaccagctgggcctgggcgtgtccccaggctaccagacctttgtgtcctgccagcagcagcagctgtccttcctgcccccaccctggggagactgcagcagcgccagcctgaaccccaactatgagcctgagcccagcgaccccctgggcagccccagccccagccccagccccccctacaccctgatgggctgccgcctggcctgtgagaccaggtatgtggccaggaaatgtggctgcaggatggtgtacatgcctggagatgtgcctgtgtgcagcccccagcagtacaagaactgtgcccacccagccattgatgccatgctgaggaaggacagctgtgcctgccccaacccctgtgccagcaccaggtatgccaaggagctgtccatggtgcgcatccccagcagagctgctgcccgcttcctggccaggaagctgaacagaagtgaggcctacatcgccgagaatgtgctggccctggacatcttctttgaggccctgaactatgagaccgtggagcagaagaaggcctatgagatgtctgagctgctgggggacatcggcggccagatgggcctcttcatcggggccagcctgctgaccatcctggagatcctggactacctgtgtgaggtgttccgggacaaggtgctgggctacttctggaaccggcagcacagccagaggcacagcagcaccaacctgaccagccaccccagcctgtgccgccaccaggacagcctgcggctgcccccccacctgctgccctgccacacagccctggacctgctgtctgtgtcctctgagcccaggccagacatcctggacatgcccagcctgcacgtggccttccccagcagcccccagatcaagagctag

SEQ ID NO: 143394 - DNA, 1944 bp, Artificial Sequence
  Description of Artificial Sequence: Synthetic coding sequence
atgctgtctggagctgctggggccgcccggcggggcggggccgccctggcccccagcctgaccaggagcctggccggcacccatgctggagctgacagctgtgccggggctgacaagggcagccacaaggagaccatcgaggagcgggacaagaggcagcagaggcagcagaggcagaggcagcaccagggctgtggggccgccggcagcggcagtgacagccccaccagcggcccccaccctgtgcctgtgctcttccccctggccctgagcctggaggagcagcccctgccccccctgcccctgggccgggcccctggcctgctggcccgggagggccagggccgggaggccctggccagccccagcagccggggccagatgcccatcgagatcgtgtgcaagatcaagtttgctgaagaagatgccaagcccaaggagaaggaggccggagatgagcagagcctgctgggcgctgtggcccctggggccgccccccgggacctggccacctttgccagcaccagcaccctgcacggcctgggccgggcctgtggccctggcccccacggcctgcggaggaccctgtgggccctggccctgctgaccagcctggccgccttcctgtaccaggccgccggcctggcccggggctacctgacccggccccacctggtggccatggaccctgctgccccagcccctgtggccggcttccctgctgtgaccctgtgcaacatcaaccgcttccgccacagcgccctgagtgatgctgacatcttccacctggccaacctgaccggcctgccccccaaggacagagatggccacagagctgctggcctgcgctacccagagccagacatggtggacatcctgaacagaacaggccaccagctggccgacatgctgaagagctgcaacttcagcggccaccactgcagcgccagcaacttctctgtggtgtacaccaggtatggcaagtgctacaccttcaatgctgaccccaggagcagcctgcccagccgggccggcggcatgggcagcggcctggagatcatgctggacatccagcaggaggagtacctgcccatctggagggagaccaatgagaccagctttgaggccggcatccgggtgcagatccacagccaggaggagcccccctacatccaccagctgggcttcggcgtgtccccaggcttccagacctttgtgtcctgccaggagcagaggctgacctacctgccccagccctggggcaactgcagagctgagagcgagctgcgggagcctgagctgcagggctacagcgcctacagcgtgtctgcctgccgcctgcgctgtgagaaggaggccgtgctgcagcgctgccactgcaggatggtgcacatgccagacagcctgggcggcggccctgagggcccctgcttctgccccaccccctgcaacctgaccaggtatggcaaggagatctccatggtgcgcatccccaacagaggcagcgcccgctacctggccaggaagtacaacagaaatgagacctacatccgggagaacttcctggtgctggatgtgttctttgaggccctgaccagcgaggccatggagcagagagctgcctacggcctgagcgccctgctgggggacctgggcggccagatgggcctcttcatcggggccagcatcctgaccctgctggagatcctggactacatctatgaggtgtcctgggaccggctgaagagggtgtggaggcggcccaagacccccctgcggaccagcactggaggcatcagcaccctgggcctgcaggagctgaaggagcagagcccctgccccagccggggccgggtggagggcggcggcgtgagcagcctgctgcccaaccaccaccacccccacggccccccaggcggcctgtttgaagattttgcctgctag

SEQ ID NO: 143395 - DNA, 2001 bp, Artificial Sequence
  Description of Artificial Sequence: Synthetic coding sequence
atgctgtctggagctgctggggccgcccggcggggcggggccgccctggcccccagcctgaccaggagcctggccggcacccatgctggagctgacagctgtgccggggctgacaagggcagccacaaggagaccatcgaggagcgggacaagaggcagcagaggcagcagaggcagaggcagcaccagggctgtggggccgccggcagcggcagtgacagccccaccagcggcccccaccctgtgcctgtgctcttccccctggccctgagcctggaggagcagcccctgccccccctgcccctgggccgggcccctggcctgctggcccgggagggccagggccgggaggccctggccagccccagcagccggggccagatgcccatcgagatcgtgtgcaagatcaagtttgctgaagaagatgccaagcccaaggagaaggaggccggagatgagcagagcctgctgggcgctgtggcccctggggccgccccccgggacctggccacctttgccagcaccagcaccctgcacggcctgggccgggcctgtggccctggcccccacggcctgcggaggaccctgtgggccctggccctgctgaccagcctggccgccttcctgtaccaggccgccggcctggcccggggctacctgacccggccccacctggtggccatggaccctgctgccccagcccctgtggccggcttccctgctgtgaccctgtgcaacatcaaccgcttccgccacagcgccctgagtgatgctgacatcttccacctggccaacctgaccggcctgccccccaaggacagagatggccacagagctgctggcctgcgctacccagagccagacatggtggacatcctgaacagaacaggccaccagctggccgacatgctgaagagctgcaacttcagcggccaccactgcagcgccagcaacttctctgtggtgtacaccaggtatggcaagtgctacaccttcaatgctgaccccaggagcagcctgcccagccgggccggcggcatgggcagcggcctggagatcatgctggacatccagcaggaggagtacctgcccatctggagggagaccaatgagaccagctttgaggccggcatccgggtgcagatccacagccaggaggagcccccctacatccaccagctgggcttcggcgtgtccccaggcttccagacctttgtgtcctgccaggagcagaggctgacctacctgccccagccctggggcaactgcagagctgagagcgagctgcgggagcctgagctgcagggctacagcgcctacagcgtgtctgcctgccgcctgcgctgtgagaaggaggccgtgctgcagcgctgccactgcaggatggtgcacatgcctggaaatgagaccatctgcccccccaacatctacattgaatgtgccgaccacaccctggacagcctgggcggcggccctgagggcccctgcttctgccccaccccctgcaacctgaccaggtatggcaaggagatctccatggtgcgcatccccaacagaggcagcgcccgctacctggccaggaagtacaacagaaatgagacctacatccgggagaacttcctggtgctggatgtgttctttgaggccctgaccagcgaggccatggagcagagagctgcctacggcctgagcgccctgctgggggacctgggcggccagatgggcctcttcatcggggccagcatcctgaccctgctggagatcctggactacatctatgaggtgtcctgggaccggctgaagagggtgtggaggcggcccaagacccccctgcggaccagcactggaggcatcagcaccctgggcctgcaggagctgaaggagcagagcccctgccccagccggggccgggtggagggcggcggcgtgagcagcctgctgcccaaccaccaccacccccacggccccccaggcggcctgtttgaggactttgcctgctag

SEQ ID NO: 143396 - DNA, 2271 bp, Artificial Sequence
  Description of Artificial Sequence: Synthetic coding sequence
atgcacctgaagatcgtgctggccttcctggccctgagcctcatcaccatctttgccctggcctacgtgctgctgaccagccctgggggcagcagccagcccccccactgccccagcgtgagccaccgggcccagccctggccccaccctggccagagccagctgtttgctgacctgagccgggaggagctgacagctgtgatgaggttcctgacccagaggctgggccctggcctggtggatgctgcccaggcccagcccagcgacaactgcatcttctctgtggagctgcagctgccccccaaggccgccgccctggcccacctggaccggggcagccccccaccagcccgggaggccctggccatcgtgctgtttggaggccagccccagcccaacgtgtctgagctggtggtgggccccctgccccaccccagctacatgagagatgtgacagtggagcggcacggcggccccctgccctaccaccggcggcctgtgctgcgggcagagttcacccagatgtggaggcacctgaaggaggtggagctgcccaaggcccccatcttcctgagcagcaccttcaactacaacggcagcaccctggccgctgtgcacgccaccccccggggcctgcggagcggggaccgggccacctggatggccctgtaccacaacatcagcggcgtgggcctcttcctgcaccctgtgggcctggagctgctgctggaccaccgggccctggaccctgcccactggacagtgcagcaggtgttctacctgggccactactatgctgacctgggccagctggagcgggagttcaagagcggccgcctggaggtggtgcgggtgcccctgcccccaccaaatggagccagcagcctgcggagcaggaacagccctggccccctgccccccctgcagttcagcccccagggcagccagtacagcgtgcagggcaacctggtggtgagcagcctgtggagcttcacctttggacatggagtcttcagcggcctgcgcatctttgatgtgcgcttccagggcgagagaattgcctatgaggtgtctgtgcaggagtgtgtgtccatctacggggctgacagccccaagaccatgctgacccgctacctggacagcagctttggcctgggcaggaacagccggggcctggtgcggggcgtggactgcccctaccaggccaccatggtggacatccacatcctggtgggcaaaggagctgtgcagctgctgcccggggctgtgtgtgtgtttgaggaggcccagggcctgcccctgcggcggcaccacaactacctgcagaaccacttctacggcggcctggccagcagcgccctggtggtgcgctctgtgtcctctgtgggcaactatgactacatctgggactttgtgctgtaccccaacggggccctggagggccgggtgcacgccaccggctacatcaacacagccttcctgaagggcggggaggagggcctgctgtttggaaacagagtgggggagcgggtgctgggcaccgtgcacacccacgccttccacttcaagctggacctggatgtggccggcctgaagaactgggtggtggccgaggatgtggtgttcaagcctgtggccgccccctggaaccctgagcactggctgcagaggccccagctgacccggcaggtgctgggcaaggaggacctgacagccttcagcctgggcagccccctgccccgctacctgtacctggccagcaaccagaccaatgcctggggccaccagaggggctaccgcatccagatccacagccccctgggcatccacatccccctggagagtgacatggagcgggccctgtcctggggccgctaccagctggtggtgacccagaggaaggaggaggagagccagagcagcagcatctaccaccagaatgacatctggacccccaccgtgacctttgctgacttcatcaacaatgagaccctgctgggggaggacctggtggcctgggtgacagccagcttcctgcacatcccccatgctgaggacatccccaacacagtgaccctgggcaacagagtgggcttcctgctgcggccctacaacttctttgatgaggaccccagcatcttcagccctggctctgtgtactttgagaagggccaggatgctggcctgtgcagcatcaaccctgtggcctgcctgcctgacctggccgcctgtgtgcctgacctgccccccttctcctaccacggcttctag

SEQ ID NO: 143397 - DNA, 2190 bp, Artificial Sequence
  Description of Artificial Sequence: Synthetic coding sequence
atgcacctgaagatcgtgctggccttcctggccctgagcctcatcaccatctttgccctggcctacgtgctgctgaccagccctgggggcagcagccagcccccccactgccccagcgtgagccaccgggcccagccctggccccaccctggccagagccagctgtttgctgacctgagccgggaggagctgacagctgtgatgaggttcctgacccagaggctgggccctggcctggtggatgctgcccaggcccagcccagcgacaactgcatcttctctgtggagctgcagctgccccccaaggccgccgccctggcccacctggaccggggcagccccccaccagcccgggaggccctggccatcgtgctgtttggaggccagccccagcccaacgtgtctgagctggtggtgggccccctgccccaccccagctacatgagagatgtgacagtggagcggcacggcggccccctgccctaccaccggcggcctgtgctgcgggcagagttcacccagatgtggaggcacctgaaggaggtggagctgcccaaggcccccatcttcctgagcagcaccttcaactacaacggcagcaccctggccgctgtgcacgccaccccccggggcctgcggagcggggaccgggccacctggatggccctgtaccacaacatcagcggcgtgggcctcttcctgcaccctgtgggcctggagctgctgctggaccaccgggccctggaccctgcccactggacagtgcagcaggtgttctacctgggccactactatgctgacctgggccagctggagcgggagttcaagagcggccgcctggaggtggtgcgggtgcccctgcccccaccaaatggagccagcagcctgcggagcaggaacagccctggccccctgccccccctgcagttcagcccccagggcagccagtacagcgtgcagggcaacctggtggtgagcagcctgtggagcttcacctttggacatggagtcttcagcggcctgcgcatctttgatgtgcgcttccagggcgagagaattgcctatgaggtgtctgtgcaggagtgtgtgtccatctacggggctgacagccccaagaccatgctgacccgctacctggacagcagctttggcctgggcaggaacagccggggcctggtgcggggcgtggactgcccctaccaggccaccatggtggacatccacatcctggtgggcaaaggagctgtgcagctgctgcccggggctgtgtgtgtgtttgaggaggcccagggcctgcccctgcggcggcaccacaactacctgcagaaccacttctacggcggcctggccagcagcgccctggtggtgcgctctgtgtcctctgtgggcaactatgactacatctgggactttgtgctgtaccccaacggggccctggagggccgggtgcacgccaccggctacatcaacacagccttcctgaagggcggggaggagggcctgctgtttggaaacagagtgggggagcgggtgctgggcaccgtgcacacccacgccttccacttcaagctggacctggatgtggccggcctgaagaactgggtggtggccgaggatgtggtgttcaagcctgtggccgccccctggaaccctgagcactggctgcagaggccccagctgacccggcaggtgctgggcaaggaggacctgacagccttcagcctgggcagccccctgccccgctacctgtacctggccagcaaccagaccaatgcctggggccaccagaggggctaccagctggtggtgacccagaggaaggaggaggagagccagagcagcagcatctaccaccagaatgacatctggacccccaccgtgacctttgctgacttcatcaacaatgagaccctgctgggggaggacctggtggcctgggtgacagccagcttcctgcacatcccccatgctgaggacatccccaacacagtgaccctgggcaacagagtgggcttcctgctgcggccctacaacttctttgatgaggaccccagcatcttcagccctggctctgtgtactttgagaagggccaggatgctggcctgtgcagcatcaaccctgtggcctgcctgcctgacctggccgcctgtgtgcctgacctgccccccttctcctaccacggcttctag

SEQ ID NO: 143398 - DNA, 2292 bp, Artificial Sequence
  Description of Artificial Sequence: Synthetic coding sequence
atgaaccagaagaccatcctggtgctgctgatcctggccgtcatcaccatctttgccctggtgtgtgtgctgctggtgggcagaggaggagatggaggagagcccagccagctgccccactgccccagcgtgagccccagcgcccagccctggacccaccctggccagagccagctgtttgctgacctgagccgggaggagctgacagctgtgatgaggttcctgacccagaggctgggccctggcctggtggatgctgcccaggcccggcccagcgacaactgtgtgttttctgtggagctgcagctgccccccaaggccgccgccctggcccacctggaccggggcagccccccaccagcccgggaggccctggccatcgtgttcttcggccggcagccccagcccaacgtgtctgagctggtggtgggccccctgccccaccccagctacatgagagatgtgacagtggagcggcacggcggccccctgccctaccaccggcggcctgtgctcttccaggagtacctggacatcgaccagatgatcttcaaccgggagctgccccaggccagcggcctgctgcaccactgctgcttctacaagcaccggggcaggaacctggtgaccatgaccacagccccccggggcctgcagagcggggaccgggccacctggtttggcctgtactacaacatcagcggggccggcttcttcctgcaccacgtgggcctggagctgctggtgaaccacaaggccctggaccctgcccgctggaccatccagaaggtgttctaccagggccgctactatgacagcctggcccagctggaggcccagtttgaagctggcctggtgaatgtggtgctgatcccagacaatggcaccggcggctcctggagcctgaagagccctgtgcccccaggccctgccccacccctgcagttctacccccagggcccccgcttctctgtgcagggcagccgggtggccagcagcctgtggaccttctcctttggcctgggcgccttcagcggcccccgcatctttgatgtgcgcttccagggcgagcggctggtgtatgagatcagcctgcaggaggccctggccatctacggcggcaacagccctgctgccatgaccacccgctacgtggatggcggcttcggcatgggcaagtacaccacccccctgacccggggcgtggactgcccctacctggccacctacgtggactggcacttcctgctggagagccaggcccccaagaccatcagagatgccttctgtgtgtttgagcagaaccagggcctgcccctgcggcggcaccacagcgacctgtacagccactactttggaggcctggccgagaccgtgctggtggtgcgctccatgagcaccctgctgaactatgactatgtgtgggacacagtgttccaccccagcggggccatcgagatccgcttctacgccaccggctacatcagcagcgccttcctgtttggagccaccgggaagtatggcaaccaggtgtctgagcacaccctgggcaccgtgcacacccacagcgcccacttcaaggtggacctggatgtggccggcctggagaactgggtgtgggccgaggacatggtgtttgtgcccatggctgtgccctggagccctgagcaccagctgcagaggctgcaggtgaccaggaagctgctggagatggaggagcaggccgccttcctggtgggcagcgccaccccccgctacctgtacctggccagcaaccacagcaacaagtggggccacccccggggctaccgcatccagatgctgagctttgctggggagcccctgccccagaacagctccatggcccggggcttctcctgggagcgctaccagctggccgtgacccagaggaaggaggaggagcccagcagcagcagcgtcttcaaccagaatgacccctgggcccccaccgtggacttcagtgacttcatcaacaatgagaccatcgccggcaaggacctggtggcctgggtgacagctggcttcctgcacatcccccatgctgaggacatccccaacacagtgacagtgggcaatggagtgggcttcttcctgcggccctacaacttctttgatgaggaccccagcttctacagcgctgacagcatctacttccggggggaccaggatgctggggcctgtgaggtgaaccccctggcctgcctgccccaggccgccgcctgtgccccagacctgcctgccttcagccatggaggcttcagccacaactag

SEQ ID NO: 143399 - DNA, 939 bp, Artificial Sequence
  Description of Artificial Sequence: Synthetic coding sequence
atggccaacaatgatgctgtgctgaagaggctggagcagaagggagctgaggccgaccagatcatcgagtacctgaagcagcaggtgtccctgctgaaggagaaggccatcctgcaggccaccctgcgggaggagaagaagctgcgggtggagaatgccaagctgaagaaggagattgaggagctgaagcaggagctgatccaggccgagatccagaatggagtgaagcagatccccttccccagcggcacccccctgcacgccaacagcatggtgtctgaaaatgtcatccagagcacagctgtgaccaccgtgagcagcggcaccaaggagcagatcaagggcggcactggagatgagaagaaggccaaggagaagattgagaagaagggggagaagaaggagaagaagcagcagagcattgctggcagcgctgacagcaagcccattgatgtgtcccggctggacctgagaattggctgcatcatcacagccaggaagcacccagatgctgacagcctgtatgtggaggaggtggatgtgggggagatcgcccccaggacagtggtgtctggcctggtgaaccacgtgcccctggagcagatgcagaacaggatggtgatcctgctgtgcaacctgaagccagccaagatgaggggcgtgctgagccaggccatggtgatgtgtgccagcagccctgagaagattgagatcctggcccccccaaatggatctgtgcctggggaccgcatcacctttgatgccttccctggagagccagacaaggagctgaaccccaagaagaagatctgggagcagatccagcctgacctgcacaccaatgatgaatgtgtggccacctacaagggcgtgccctttgaggtgaagggcaagggcgtgtgccgggcccagaccatgagcaacagcggcatcaagtag

SEQ ID NO: 143400 - DNA, 1011 bp, Artificial Sequence
  Description of Artificial Sequence: Synthetic coding sequence
atgctgcctgctgtggccgtgtctgagcctgtggtgctgcgcttcatgatcttctgccgcctgctggccaagatggccaacaatgatgctgtgctgaagaggctggagcagaagggagctgaggccgaccagatcatcgagtacctgaagcagcaggtgtccctgctgaaggagaaggccatcctgcaggccaccctgcgggaggagaagaagctgcgggtggagaatgccaagctgaagaaggagattgaggagctgaagcaggagctgatccaggccgagatccagaatggagtgaagcagatccccttccccagcggcacccccctgcacgccaacagcatggtgtctgaaaatgtcatccagagcacagctgtgaccaccgtgagcagcggcaccaaggagcagatcaagggcggcactggagatgagaagaaggccaaggagaagattgagaagaagggggagaagaaggagaagaagcagcagagcattgctggcagcgctgacagcaagcccattgatgtgtcccggctggacctgagaattggctgcatcatcacagccaggaagcacccagatgctgacagcctgtatgtggaggaggtggatgtgggggagatcgcccccaggacagtggtgtctggcctggtgaaccacgtgcccctggagcagatgcagaacaggatggtgatcctgctgtgcaacctgaagccagccaagatgaggggcgtgctgagccaggccatggtgatgtgtgccagcagccctgagaagattgagatcctggcccccccaaatggatctgtgcctggggaccgcatcacctttgatgccttccctggagagccagacaaggagctgaaccccaagaagaagatctgggagcagatccagcctgacctgcacaccaatgatgaatgtgtggccacctacaagggcgtgccctttgaggtgaagggcaagggcgtgtgccgggcccagaccatgagcaacagcggcatcaagtag

SEQ ID NO: 143401 - DNA, 810 bp, Artificial Sequence
  Description of Artificial Sequence: Synthetic coding sequence
atggccaacaatgatgctgtgctgaagaggctggagcagaagggagctgaggccgaccagatcatcgagtacctgaagcagcaggtgtccctgctgaaggagaaggccatcctgcaggccaccctgcgggaggagaagaagctgcgggtggagaatgccaagctgaagaaggagattgaggagctgaagcaggagctgatccaggccgagatccagaatggagtgaagcagatccccttccccagcggcacccccctgcacgccaacagcatggtgtctgaaaatgtcatccagagcacagctgtgaccaccgtgagcagcggcaccaaggagcagatcaagggcggcactggagatgagaagaaggccaaggagaagattgagaagaagggggagaagaaggagaagaagcagcagagcatcgcccccaggacagtggtgtctggcctggtgaaccacgtgcccctggagcagatgcagaacaggatggtgatcctgctgtgcaacctgaagccagccaagatgagaggagtgctgagccaggccatggtgatgtgtgccagcagccctgagaagattgagatcctggccccacccaacggctctgtgcctggggaccgcatcacctttgatgccttccctggagagccagacaaggagctgaaccccaagaagaagatctgggagcagatccagcctgacctgcacaccaatgatgaatgtgtggccacctacaagggcgtgccctttgaggtgaagggcaaaggagtgtgccgggcccagaccatgagcaacagcggcatcaagtag

SEQ ID NO: 143402 - DNA, 939 bp, Artificial Sequence; identical to SEQ ID NO: 143399
  Description of Artificial Sequence: Synthetic coding sequence

SEQ ID NO: 143403 - DNA, 453 bp, Artificial Sequence
  Description of Artificial Sequence: Synthetic coding sequence
atggccaacaatgatgctgtgctgaagaggctggagcagaagggagctgaggccgaccagatcatcgagtacctgaagcagcaggtgtccctgctgaaggagaaggccatcctgcaggccaccctgcgggaggagaagaagctgcgggtggagaatgccaagctgaagaaggagattgaggagctgaagcaggagctgatccaggccgagatccagaatggagtgaagcagatccccttccccagcggcacccccctgcacgccaacagcatggtgtctgaaaatgtcatccagagcacagctgtgaccaccgtgagcagcggcaccaaggagcagatcaagggcggcactggagatgagaagaaggccaaggagaagattgagaagaagggggagaagaaggagaagaagcagcagagcattgctggcagcgctgacagcaagcccatctag

SEQ ID NO: 143404 - DNA, 1227 bp, Artificial Sequence
  Description of Artificial Sequence: Synthetic coding sequence
atgaccagcaagggccctgaggaggagcaccccagcgtgaccctcttccggcagtacctgcgcatcagaacagtgcagcccaagccagactatggagctgctgtggccttctttgaggagacagcccggcagctgggcctgggctgccagaaggtggaggtggcccctggctacgtggtgacagtgctgacctggccaggcaccaaccccaccctgagcagcatcctgctgaacagccacacagatgtggtgcctgtgttcaaggagcactggagccatgacccctttgaggccttcaaggacagcgagggctacatctatgcccggggggcccaggacatgaagtgtgtgtccatccagtacctggaggccgtgcggcggctgaaggtggagggccaccgcttccccaggaccatccacatgacctttgtgcctgatgaggaggtgggcggccaccagggcatggagctgtttgtgcagaggcctgagttccacgccctgcgggccggctttgccctggatgagggcatcgccaaccccacagatgccttcaccgtcttctacagcgagaggagcccctggtgggtgcgggtgaccagcacaggccggcccggccacgccagccgcttcatggaggacacagctgctgagaagctgcacaaggtggtgaacagcatcctggccttccgggagaaggagtggcagaggctgcagagcaacccccacctgaaggagggctctgtgacctctgtgaacctgaccaagctggagggcggcgtggcctacaacgtcatcccagccaccatgtctgccagctttgacttccgggtggccccagatgtggacttcaaggcctttgaggagcagctgcagagctggtgccaggccgccggggagggcgtgaccctggagtttgcccagaagtggatgcacccccaggtgacccccacagatgacagcaacccctggtgggccgccttcagccgggtgtgcaaggacatgaacctgaccctggagcctgagatcatgcctgctgccacagacaaccgctacatccgggctgtgggcgtgcctgccctgggcttcagccccatgaacagaacacctgtgctgctgcatgaccatgatgagcggctgcacgaggccgtgttcctgcggggcgtggacatctacacccggctgctgcctgccctggcctctgtgcctgccctgcccagcgacagctag

SEQ ID NO: 143405 - DNA, 1497 bp, Artificial Sequence
  Description of Artificial Sequence: Synthetic coding sequence
atgtggggctgccaggcccccctgagccggctgcctgccagcggggagacccccatgagccagagctggctggtgagccccctggccacccggcccagcttcaccgcccgctgcagccacagcaccaggcacacaggctggcgctggtgctgcttcatggagcggcccctgaccctgacccggggcagctcctgggcccactgcagctactgccacagaggagccaccggcccctggcccctgaccttccagctgaccaccaggtctgccatgaccagcaagggccctgaggaggagcaccccagcgtgaccctcttccggcagtacctgcgcatcagaacagtgcagcccaagccagactatggagctgctgtggccttctttgaggagacagcccggcagctgggcctgggctgccagaaggtggaggtggcccctggctacgtggtgacagtgctgacctggccaggcaccaaccccaccctgagcagcatcctgctgaacagccacacagatgtggtgcctgtgttcaaggagcactggagccatgacccctttgaggccttcaaggacagcgagggctacatctatgcccggggggcccaggacatgaagtgtgtgtccatccagtacctggaggccgtgcggcggctgaaggtggagggccaccgcttccccaggaccatccacatgacctttgtgcctgatgaggaggtgggcggccaccagggcatggagctgtttgtgcagaggcctgagttccacgccctgcgggccggctttgccctggatgagggcatcgccaaccccacagatgccttcaccgtcttctacagcgagaggagcccctggtgggtgcgggtgaccagcacaggccggcccggccacgccagccgcttcatggaggacacagctgctgagaagctgcacaaggtggtgaacagcatcctggccttccgggagaaggagtggcagaggctgcagagcaacccccacctgaaggagggctctgtgacctctgtgaacctgaccaagctggagggcggcgtggcctacaacgtcatcccagccaccatgtctgccagctttgacttccgggtggccccagatgtggacttcaaggcctttgaggagcagctgcagagctggtgccaggccgccggggagggcgtgaccctggagtttgcccagaagtggatgcacccccaggtgacccccacagatgacagcaacccctggtgggccgccttcagccgggtgtgcaaggacatgaacctgaccctggagcctgagatcatgcctgctgccacagacaaccgctacatccgggctgtgggcgtgcctgccctgggcttcagccccatgaacagaacacctgtgctgctgcatgaccatgatgagcggctgcacgaggccgtgttcctgcggggcgtggacatctacacccggctgctgcctgccctggcctctgtgcctgccctgcccagcgacagctag

SEQ ID NO: 143406 - DNA, 1122 bp, Artificial Sequence
  Description of Artificial Sequence: Synthetic coding sequence
atgaccagcaagggccctgaggaggagcaccccagcgtgaccctcttccggcagtacctgcgcatcagaacagtgcagcccaagccagactatggcaccaaccccaccctgagcagcatcctgctgaacagccacacagatgtggtgcctgtgttcaaggagcactggagccatgacccctttgaggccttcaaggacagcgagggctacatctatgcccggggggcccaggacatgaagtgtgtgtccatccagtacctggaggccgtgcggcggctgaaggtggagggccaccgcttccccaggaccatccacatgacctttgtgcctgatgaggaggtgggcggccaccagggcatggagctgtttgtgcagaggcctgagttccacgccctgcgggccggctttgccctggatgagggcatcgccaaccccacagatgccttcaccgtcttctacagcgagaggagcccctggtgggtgcgggtgaccagcacaggccggcccggccacgccagccgcttcatggaggacacagctgctgagaagctgcacaaggtggtgaacagcatcctggccttccgggagaaggagtggcagaggctgcagagcaacccccacctgaaggagggctctgtgacctctgtgaacctgaccaagctggagggcggcgtggcctacaacgtcatcccagccaccatgtctgccagctttgacttccgggtggccccagatgtggacttcaaggcctttgaggagcagctgcagagctggtgccaggccgccggggagggcgtgaccctggagtttgcccagaagtggatgcacccccaggtgacccccacagatgacagcaacccctggtgggccgccttcagccgggtgtgcaaggacatgaacctgaccctggagcctgagatcatgcctgctgccacagacaaccgctacatccgggctgtgggcgtgcctgccctgggcttcagccccatgaacagaacacctgtgctgctgcatgaccatgatgagcggctgcatgaagctgtgttcctgcggggcgtggacatctacacccggctgctgcctgccctggcctctgtgcctgccctgcccagcgacagctag

SEQ ID NO: 143407 - DNA, 1032 bp, Artificial Sequence
  Description of Artificial Sequence: Synthetic coding sequence
atgaccagcaagggccctgaggaggagcaccccagcgtgaccctcttccggcagtacctgcgcatcagaacagtgcagcccaagccagactatggagctgctgtggccttctttgaggagacagcccggcagctgggcctgggctgccagaaggtggaggtggcccctggctacgtggtgacagtgctgacctggccaggcaccaaccccaccctgagcagcatcctgctgaacagccacacagatgtggtgcctgtgttcaaggagcactggagccatgacccctttgaggccttcaaggacagcgagggctacatctatgcccggggggcccaggacatgaagtgtgtgtccatccagtacctggaggccgtgcggcggctgaaggtggagggccaccgcttccccaggaccatccacatgacctttgtgcctgatgaggaggtgggcggccaccagggcatggagctgtttgtgcagaggcctgagttccacgccctgcgggccggctttgccctggatgagggcatcgccaaccccacagatgccttcaccgtcttctacagcgagaggagcccctggtgggtgcgggtgaccagcacaggccggcccggccacgccagccgcttcatggaggacacagctgctgagaagctggcctttgaggagcagctgcagagctggtgccaggccgccggggagggcgtgaccctggagtttgcccagaagtggatgcacccccaggtgacccccacagatgacagcaacccctggtgggccgccttcagccgggtgtgcaaggacatgaacctgaccctggagcctgagatcatgcctgctgccacagacaaccgctacatccgggctgtgggcgtgcctgccctgggcttcagccccatgaacagaacacctgtgctgctgcatgaccatgatgagcggctgcatgaagctgtgttcctgcggggcgtggacatctacacccggctgctgcctgccctggcctctgtgcctgccctgcccagcgacagctag

SEQ ID NO: 143408 - DNA, 1011 bp, Artificial Sequence
  Description of Artificial Sequence: Synthetic coding sequence
atgaccagcaagggccctgaggaggagcaccccagcgtgaccctcttccggcagtacctgcgcatcagaacagtgcagcccaagccagactatggagctgctgtggccttctttgaggagacagcccggcagctgggcctgggctgccagaaggtggaggtggcccctggctacgtggtgacagtgctgacctggccaggcaccaaccccaccctgagcagcatcctgctgaacagccacacagatgtggtgcctgtgttcaaggagcactggagccatgacccctttgaggccttcaaggacagcgagggcatcgccaaccccacagatgccttcaccgtcttctacagcgagaggagcccctggtgggtgcgggtgaccagcacaggccggcccggccacgccagccgcttcatggaggacacagctgctgagaagctgcacaaggtggtgaacagcatcctggccttccgggagaaggagtggcagaggctgcagagcaacccccacctgaaggagggctctgtgacctctgtgaacctgaccaagctggagggcggcgtggcctacaacgtcatcccagccaccatgtctgccagctttgacttccgggtggccccagatgtggacttcaaggcctttgaggagcagctgcagagctggtgccaggccgccggggagggcgtgaccctggagtttgcccagaagtggatgcacccccaggtgacccccacagatgacagcaacccctggtgggccgccttcagccgggtgtgcaaggacatgaacctgaccctggagcctgagatcatgcctgctgccacagacaaccgctacatccgggctgtgggcgtgcctgccctgggcttcagccccatgaacagaacacctgtgctgctgcatgaccatgatgagcggctgcacgaggccgtgttcctgcggggcgtggacatctacacccggctgctgcctgccctggcctctgtgcctgccctgcccagcgacagctag

SEQ ID NO: 143409 - DNA, 1278 bp, Artificial Sequence
  Description of Artificial Sequence: Synthetic coding sequence
atgaactatgcccgcttcatcacagctgccagcgctgccaggaaccccagccccatccgcaccatgacagacatcctgagccggggccccaagtccatgatcagcctggccggcggcctgcccaaccccaacatgttccccttcaagacagctgtgatcaccgtggagaatggcaagaccatccagtttggagaggagatgatgaagagggccctgcagtacagccccagcgctggcatccctgagctgctgtcctggctgaagcagctgcagatcaagctgcacaacccccccaccatccactacccacccagccagggccagatggacctgtgtgtgaccagcggcagccagcagggcctgtgcaaggtgtttgagatgatcatcaaccctggggacaacgtgctgctggatgagcccgcctacagcggcaccctgcagagcctgcaccccctgggctgcaacatcatcaacgtggccagtgatgagagcggcatcgtgcctgacagcctgcgggacatcctgagccgctggaagccagaagatgccaagaacccccagaagaacacccccaagttcctgtacacagtgcccaatggaaacaaccccaccggcaacagcctgaccagcgagaggaagaaggagatctatgagctggccaggaaatatgacttcctgatcattgaagatgacccctactacttcctgcagttcaacaagttccgggtgcccaccttcctgtccatggatgtggatggccgggtcatccgggctgacagcttcagcaagatcatcagcagcggcctgagaattggcttcctgaccggccccaagcccctgattgaaagagtcatcctgcacatccaggtgtccaccctgcaccccagcaccttcaaccagctgatgatcagccagctgctgcacgagtggggcgaggagggcttcatggcccacgtggacagagtgattgacttctacagcaaccagaaggatgccatcctggccgctgctgacaagtggctgaccggcctggccgagtggcacgtgcctgctgctggcatgttcctgtggatcaaggtgaagggcatcaatgatgtgaaggagctgattgaggagaaggctgtgaagatgggcgtgctgatgctgcctggaaatgccttctacgtggacagcagcgcccccagcccctacctgcgggccagcttcagcagcgccagccctgagcagatggatgtggccttccaggtgctggcccagctgatcaaggagagcctgtag

SEQ ID NO: 143410 - DNA, 1278 bp, Artificial Sequence; identical to SEQ ID NO: 143409
  Description of Artificial Sequence: Synthetic coding sequence

SEQ ID NO: 143411 - DNA, 543 bp, Artificial Sequence
  Description of Artificial Sequence: Synthetic coding sequence
atgaactatgcccgcttcatcacagctgccagcgctgccaggaaccccagccccatccgcaccatgacagacatcctgagccggggccccaagtccatgatcagcctggccggcggcctgcccaaccccaacatgttccccttcaagacagctgtgatcaccgtggagaatggcaagaccatccagtttggagaggagatgatgaagagggccctgcagtacagccccagcgctggcatccctgagctgctgtcctggctgaagcagctgcagatcaagctgcacaacccccccaccatccactacccacccagccagggccagatggacctgtgtgtgaccagcggcagccagcagggcctgtgcaaggtgtttgagatgatcatcaaccctggggacaacgtgctgctggatgagcccgcctacagcggcaccctgcagagcctgcaccccctgggctgcaacatcatcaacgtggccagtgatgagagcggcatcgtgcctgacagcctgcgggacatcctgagccgctggaagccctag

SEQ ID NO: 143412 - DNA, 630 bp, Artificial Sequence
  Description of Artificial Sequence: Synthetic coding sequence
atgaactatgcccgcttcatcacagctgccagcgctgccaggaaccccagccccatccgcaccatgacagacatcctgagccggggccccaagtccatgatcagcctggccggcggcctgcccaaccccaacatgttccccttcaagacagctgtgatcaccgtggagaatggcaagaccatccagtttggagaggagatgatgaagagggccctgcagtacagccccagcgctggcatccctgagctgctgtcctggctgaagcagctgcagatcaagctgcacaacccccccaccatccactacccacccagccagggccagatggacctgtgtgtgaccagcggcagccagcagggcctgtgcaaggtgtttgagatgatcatcaaccctggggacaacgtgctgctggatgagcccgcctacagcggcaccctgcagagcctgcaccccctgggctgcaacatcatcaacgtggccagtgatgagagcggcatcgtgcctgacagcctgcgggacatcctgagccgctggaagccagaagatgccaagaacccccagaagaacacccccaagttcctgtacacagtgcccaatggaaacaaccccaccggcaacagcctgacctag

SEQ ID NO: 143413 - DNA, 1290 bp, Artificial Sequence
  Description of Artificial Sequence: Synthetic coding sequence
atgaactatgcccgcttcatcacagctgccagcgctgccaggaaccccagccccatccgcaccatgtctgagaagagagctgacatcctgagccggggccccaagtccatgatcagcctggccggcggcctgcccaaccccaacatgttccccttcaagacagctgtgatcaccgtggagaatggcaagaccatccagtttggagaggagatgatgaagagggccctgcagtacagccccagcgctggcatccctgagctgctgtcctggctgaagcagctgcagatcaagctgcacaacccccccaccatccactacccacccagccagggccagatggacctgtgtgtgaccagcggcagccagcagggcctgtgcaaggtgtttgagatgatcatcaaccctggggacaacgtgctgctggatgagcccgcctacagcggcaccctgcagagcctgcaccccctgggctgcaacatcatcaacgtggccagtgatgagagcggcatcgtgcctgacagcctgcgggacatcctgagccgctggaagccagaagatgccaagaacccccagaagaacacccccaagttcctgtacacagtgcccaatggaaacaaccccaccggcaacagcctgaccagcgagaggaagaaggagatctatgagctggccaggaaatatgacttcctgatcattgaagatgacccctactacttcctgcagttcaacaagttccgggtgcccaccttcctgtccatggatgtggatggccgggtcatccgggctgacagcttcagcaagatcatcagcagcggcctgagaattggcttcctgaccggccccaagcccctgattgaaagagtcatcctgcacatccaggtgtccaccctgcaccccagcaccttcaaccagctgatgatcagccagctgctgcacgagtggggcgaggagggcttcatggcccacgtggacagagtgattgacttctacagcaaccagaaggatgccatcctggccgctgctgacaagtggctgaccggcctggccgagtggcacgtgcctgctgctggcatgttcctgtggatcaaggtgaagggcatcaatgatgtgaaggagctgattgaggagaaggctgtgaagatgggcgtgctgatgctgcctggaaatgccttctacgtggacagcagcgcccccagcccctacctgcgggccagcttcagcagcgccagccctgagcagatggatgtggccttccaggtgctggcccagctgatcaaggagagcctgtag

SEQ ID NO: 143414 - DNA, 1278 bp, Artificial Sequence; identical to SEQ ID NO: 143409
  Description of Artificial Sequence: Synthetic coding sequence

SEQ ID NO: 143415 - DNA, 621 bp, Artificial Sequence
  Description of Artificial Sequence: Synthetic coding sequence
atggcccccagccacctgtctgtgcgggagatgagagaagatgagaagcccctggtgctggagatgctgaaggccggcgtgaaggacacagaaaatagagtggccctgcacgccctgacccggcccccagccctgctgctgctggccgccgccagcagcggcctgcgctttgtgctggccagctttgccctggccctgctgctgcctgtgttcctggccgtggccgctgtgaagctgggcctgcgggcccgctggggcagcctgcccccacctgggggcctgggcggcccctgggtggccgtgcggggcagcggagatgtgtgtggggtgctggccctggcccctggcaccaatgctggagatggagcccgggtgacccggctgtctgtgagccgctggcacagaagaagaggagtgggccgccgcctgctggcctttgctgaggcccgggcccgggcctgggccggcggcatgggagagccccgggcccggctggtggtgcctgtggccgtggccgcctggggcgtgggcggcatgctggagggctgcggctaccaggccgagggcggctggggctgcctgggctacaccctggtgcgggagttcagcaaggacctgtag

SEQ ID NO: 143416 - DNA, 1842 bp, Artificial Sequence
  Description of Artificial Sequence: Synthetic coding sequence
atggtgtccaaggatgcctctgtgaaggagtacatcttcaaggagctgcagaagtacctgcccagccatgctgtgcctgatgagctggtgctgattgacagcctgcccttcaccagccacggcaagattgatgtgtctgagctgaacaagatctacctgaactacatcaacctgaagtctgagaacaagctgagcggcaaggaggacctgtgggagaagctgcagtacctgtggaagagcaccctgaacctgcctgaggacctgctgcgggtgcctgatgagagcctcttcctgaacagcggcggggacagcctgaagagcatccggctgctgtctgaaattgagaagctggtgggcacctctgtgcccggcctgctggagatcatcctgagcagcagcatcctggagatctacaaccacatcctgcagacagtggtgcctgatgaagatgtgaccttcaggaagagctgtgccaccaagaggaagctgagtgacatcaaccaggaggaggccagcggcaccagcctgcaccagaaggccatcatgaccttcacctgccacaatgagatcaatgcctttgtggtgctgagccggggcagccagatcctgagcctgaacagcacccgcttcctgaccaagctgggccactgcagcagcgcctgccccagcgacagcgtgtcccagaccaacatccagaacctgaagggcctgaacagccctgtgctgattggcaagagcaaggaccccagctgtgtggccaaggtgtctgaggagggcaagccagccatcggcacccagaagatggagctgcacgtgcgctggaggagtgacacaggaaaatgtgtggatgccagccccctggtggtgatccccacctttgacaagagcagcaccaccgtgtacatcggcagccacagccacaggatgaaggctgtggacttctacagcggcaaggtgaagtgggagcagatcctgggggacagaattgagagcagcgcctgtgtgtccaaatgtggcaacttcatcgtggtgggctgctacaacggcctggtgtatgtgctgaagagcaacagcggggagaagtactggatgttcaccacagaagatgctgtgaagagcagcgccaccatggaccccaccaccggcctcatctacatcggcagccatgaccagcacgcctatgccctggacatctacaggaagaagtgtgtgtggaagagcaaatgtggcggcaccgtcttcagcagcccctgcctgaacctgatcccccaccacctgtactttgccaccctgggcggcctgctgctggccgtgaacccagccactggaaatgtcatctggaagcacagctgtgggaagcccctcttcagcagcccccagtgctgcagccagtacatctgcatcggctgtgtggatggcaacctgctgtgcttcacccactttggagagcaggtgtggcagttcagcaccagcggccccatcttcagcagcccctgcaccagccccagcgagcagaagatcttcttcggcagccatgactgcttcatctactgctgcaacatgaagggccacctgcagtggaagtttgagaccaccagccgggtgtatgccaccccatttgccttccacaactacaacggcagcaatgagatgctgctggccgccgccagcacagatggcaaggtgtggatcctggagagccagagcggccagctgcagagcgtgtatgagctgcctggagaggtgttcagcagccctgtggtgctggagagcatgctgatcatcggctgccgggacaactacgtgtactgcctggacctgctgggcggcaaccagaagtag

SEQ ID NO: 143417 - DNA, 2574 bp, Artificial Sequence
  Description of Artificial Sequence: Synthetic coding sequence
atgaccctgcaggagctggtgcacaaggccgccagctgctacatggacagagtggccgtgtgctttgatgagtgcaacaaccagctgcctgtgtactacacctacaagacagtggtgaatgctgccagcgagctgagcaacttcctgctgctgcactgtgacttccagggcatccgggagatcggcctgtactgccagcccggcatcgacctgcccagctggatcctgggcatcctgcaggtgcctgctgcctacgtgcccatcgagccagacagcccccccagcctgagcacccacttcatgaagaagtgcaacctgaagtacatcctggtggagaagaagcagatcaacaagttcaagagcttccacgagaccctgctgaactatgacaccttcaccgtggagcacaatgacctggtgctcttccggctgcactggaagaacacagaggtgaacctgatgctgaatgatggcaaggagaagtatgagaaggagaagatcaagagcatcagcagcgagcacgtgaatgaggagaaggccgaggagcacatggacctgcggctgaagcactgcctggcctacgtgctgcacaccagcggcaccaccggcatccccaagatcgtgcgggtgccccacaagtgcatcgtgcccaacatccagcacttccgggtgctgtttgacatcacccaggaggatgtgctcttcctggccagccccctgacctttgaccccagcgtggtggagatcttcctggccctgagcagcggggccagcctgctgattgtgcccacctctgtgaagctgctgcccagcaagctggcctctgtgctcttcagccaccaccgggtgacagtgctgcaggccacccccaccctgctgcggcgcttcggcagccagctgatcaagagcacagtgctgagcgccaccaccagcctgcgggtgctggccctgggcggggaggccttccccagcctgactgtgctgcgctcctggagaggagagggcaacaagacccagatcttcaacgtgtatggcatcacagaggtgtcctcctgggccaccatctaccgcatccctgagaagaccctgaacagcaccctgaagtgtgagctgcctgtgcagctgggcttccccctgctgggcaccgtggtggaggtgcgggacaccaacggcttcaccatccaggagggcagcggccaggtgttcctgggcggcaggaacagagtgtgcttcctggatgatgaggtgacagtgcccctgggcaccatgagggccaccggggactttgtgacagtgaaggatggagagatcttcttcctgggcaggaaggacagccagatcaagagacatggcaagaggctgaacatcgagctggtgcagcaggtggccgaggagctgcagcaggtggagagctgtgctgtgacctggtacaaccaggagaagctgatcctcttcatggtgtccaaggatgcctctgtgaaggagtacatcttcaaggagctgcagaagtacctgcccagccatgctgtgcctgatgagctggtgctgattgacagcctgcccttcaccagccacggcaagattgatgtgtctgagctgaacaagatctacctgaactacatcaacctgaagtctgagaacaagctgagcggcaaggaggacctgtgggagaagctgcagtacctgtggaagagcaccctgaacctgcctgaggacctgctgcgggtgcctgatgagagcctcttcctgaacagcggcggggacagcctgaagagcatccggctgctgtctgaaattgagaagctggtgggcacctctgtgcccggcctgctggagatcatcctgagcagcagcatcctggagatctacaaccacatcctgcagacagtggtgcctgatgaagatgtgaccttcaggaagagctgtgccaccaagaggaagctgagtgacatcaaccaggaggaggccagcggcaccagcctgcaccagaaggccatcatgaccttcacctgccacaatgagatcaatgcctttgtggtgctgagccggggcagccagatcctgagcctgaacagcacccgcttcctgaccaagctgggccactgcagcagcgcctgccccagcgacagcgtgtcccagaccaacatccagaacctgaagggcctgaacagccctgtgctgattggcaagagcaaggaccccagctgtgtggccaaggtgtctgaggagggcaagccagccatcggcacccagaagatggagctgcacgtgcgctggaggagtgacacaggaaaatgtgtggatgccagccccctggtggtgatccccacctttgacaagagcagcaccaccgtgtacatcggcagccacagccacaggatgaaggctgtggacttctacagcggcaaggtgaagtgggagcagatcctgggggaccgcatcgagagcagcgcctgtgtgtccaaatgtggcaacttcatcgtggtgggcctggccgtgctgtaccagtggaccaacctcttcatccctgtgtacctgaccatccgggccaagaacatcttctggttcccctag

SEQ ID NO: 143418 - DNA, 2526 bp, Artificial Sequence
  Description of Artificial Sequence: Synthetic coding sequence
atgaccctgcaggagctggtgcacaaggccgccagctgctacatggacagagtggccgtgtgctttgatgagtgcaacaaccagctgcctgtgtactacacctacaagacagtggtgaatgctgccagcgagctgagcaacttcctgctgctgcactgtgacttccagggcatccgggagatcggcctgtactgccagcccggcatcgacctgcccagctggatcctgggcatcctgcaggtgcctgctgcctacgtgcccatcgagccagacagcccccccagcctgagcacccacttcatgaagaagtgcaacctgaagtacatcctggtggagaagaagcagatcaacaagttcaagagcttccacgagaccctgctgaactatgacaccttcaccgtggagcacaatgacctggtgctcttccggctgcactggaagaacacagaggtgaacctgatgctgaatgatggcaaggagaagtatgagaaggagaagatcaagagcatcagcagcgagcacgtgaatgaggagaaggccgaggagcacatggacctgcggctgaagcactgcctggcctacgtgctgcacaccagcggcaccaccggcatccccaagatcgtgcgggtgccccacaagtgcatcgtgcccaacatccagcacttccgggtgctgtttgacatcacccaggaggatgtgctcttcctggccagccccctgacctttgaccccagcgtggtggagatcttcctggccctgagcagcggggccagcctgctgattgtgcccacctctgtgaagctgctgcccagcaagctggcctctgtgctcttcagccaccaccgggtgacagtgctgcaggccacccccaccctgctgcggcgcttcggcagccagctgatcaagagcacagtgctgagcgccaccaccagcctgcgggtgctggccctgggcggggaggccttccccagcctgactgtgctgcgctcctggagaggagagggcaacaagacccagatcttcaacgtgtatggcatcacagaggtgtcctcctgggccaccatctaccgcatccctgagaagaccctgaacagcaccctgaagtgtgagctgcctgtgcagctgggcttccccctgctgggcaccgtggtggaggtgcgggacaccaacggcttcaccatccaggagggcagcggccaggtgttcctgggcggcaggaacagagtgtgcttcctggatgatgaggtgacagtgcccctgggcaccatgagggccaccggggactttgtgacagtgaaggatggagagatcttcttcctgggcaggaaggacagccagatcaagagacatggcaagaggctgaacatcgagctggtgcagcaggtggccgaggagctgcagcaggtggagagctgtgctgtgacctggtacaaccaggagaagctgatcctcttcatggtgtccaaggatgcctctgtgaaggagtacatcttcaaggagctgcagaagtacctgcccagccatgctgtgcctgatgagctggtgctgattgacagcctgcccttcaccagccacggcaagattgatgtgtctgagctgaacaagatctacctgaactacatcaacctgaagtctgagaacaagctgagcggcaaggaggacctgtgggagaagctgcagtacctgtggaagagcaccctgaacctgcctgaggacctgctgcgggtgcctgatgagagcctcttcctgaacagcggcggggacagcctgaagagcatccggctgctgtctgaaattgagaagctggtgggcacctctgtgcccggcctgctggagatcatcctgagcagcagcatcctggagatctacaaccacatcctgcagacagtggtgcctgatgaagatgtgaccttcaggaagagctgtgccaccaagaggaagctgagtgacatcaaccaggaggaggccagcggcaccagcctgcaccagaaggccatcatgaccttcacctgccacaatgagatcaatgcctttgtggtgctgagccggggcagccagatcctgagcctgaacagcacccgcttcctgaccaagctgggccactgcagcagcgcctgccccagcgacagcgtgtcccagaccaacatccagaacctgaagggcctgaacagccctgtgctgattggcaagagcaaggaccccagctgtgtggccaaggtgtctgaggagggcaagccagccatcggcacccagaagatggagctgcacgtgcgctggaggagtgacacaggaaaatgtgtggatgccagccccctggtggtgatccccacctttgacaagagcagcaccaccgtgtacatcggcagccacagccacaggatgaaggctgtggacttctacagcggcaaggtgaagtgggagcagatcctgggggaccgcatcgagagcagcgcctgtgtgtccaaatgtggcaacttcatcgtggtgggcaagttcctgaacctgcgctttgtggagctgaactag

SEQ ID NO: 143419 - DNA, 2997 bp, Artificial Sequence
  Description of Artificial Sequence: Synthetic coding sequence
atgaagaagtgcaacctgaagtacatcctggtggagaagaagcagatcaacaagttcaagagcttccacgagaccctgctgaactatgacaccttcaccgtggagcacaatgacctggtgctcttccggctgcactggaagaacacagaggtgaacctgatgctgaatgatggcaaggagaagtatgagaaggagaagatcaagagcatcagcagcgagcacgtgaatgaggagaaggccgaggagcacatggacctgcggctgaagcactgcctggcctacgtgctgcacaccagcggcaccaccggcatccccaagatcgtgcgggtgccccacaagtgcatcgtgcccaacatccagcacttccgggtgctgtttgacatcacccaggaggatgtgctcttcctggccagccccctgacctttgaccccagcgtggtggagatcttcctggccctgagcagcggggccagcctgctgattgtgcccacctctgtgaagctgctgcccagcaagctggcctctgtgctcttcagccaccaccgggtgacagtgctgcaggccacccccaccctgctgcggcgcttcggcagccagctgatcaagagcacagtgctgagcgccaccaccagcctgcgggtgctggccctgggcggggaggccttccccagcctgactgtgctgcgctcctggagaggagagggcaacaagacccagatcttcaacgtgtatggcatcacagaggtgtcctcctgggccaccatctaccgcatccctgagaagaccctgaacagcaccctgaagtgtgagctgcctgtgcagctgggcttccccctgctgggcaccgtggtggaggtgcgggacaccaacggcttcaccatccaggagggcagcggccaggtgttcctgggcggcaggaacagagtgtgcttcctggatgatgaggtgacagtgcccctgggcaccatgagggccaccggggactttgtgacagtgaaggatggagagatcttcttcctgggcaggaaggacagccagatcaagagacatggcaagaggctgaacatcgagctggtgcagcaggtggccgaggagctgcagcaggtggagagctgtgctgtgacctggtacaaccaggagaagctgatcctcttcatggtgtccaaggatgcctctgtgaaggagtacatcttcaaggagctgcagaagtacctgcccagccatgctgtgcctgatgagctggtgctgattgacagcctgcccttcaccagccacggcaagattgatgtgtctgagctgaacaagatctacctgaactacatcaacctgaagtctgagaacaagctgagcggcaaggaggacctgtgggagaagctgcagtacctgtggaagagcaccctgaacctgcctgaggacctgctgcgggtgcctgatgagagcctcttcctgaacagcggcggggacagcctgaagagcatccggctgctgtctgaaattgagaagctggtgggcacctctgtgcccggcctgctggagatcatcctgagcagcagcatcctggagatctacaaccacatcctgcagacagtggtgcctgatgaagatgtgaccttcaggaagagctgtgccaccaagaggaagctgagtgacatcaaccaggaggaggccagcggcaccagcctgcaccagaaggccatcatgaccttcacctgccacaatgagatcaatgcctttgtggtgctgagccggggcagccagatcctgagcctgaacagcacccgcttcctgaccaagctgggccactgcagcagcgcctgccccagcgacagcgtgtcccagaccaacatccagaacctgaagggcctgaacagccctgtgctgattggcaagagcaaggaccccagctgtgtggccaaggtgtctgaggagggcaagccagccatcggcacccagaagatggagctgcacgtgcgctggaggagtgacacaggaaaatgtgtggatgccagccccctggtggtgatccccacctttgacaagagcagcaccaccgtgtacatcggcagccacagccacaggatgaaggctgtggacttctacagcggcaaggtgaagtgggagcagatcctgggggaccgcatcgagagcagcgcctgtgtgtccaaatgtggcaacttcatcgtggtgggctgctacaacggcctggtgtatgtgctgaagagcaacagcggggagaagtactggatgttcaccacagaagatgctgtgaagagcagcgccaccatggaccccaccaccggcctcatctacatcggcagccatgaccagcacgcctatgccctggacatctacaggaagaagtgtgtgtggaagagcaaatgtggcggcaccgtcttcagcagcccctgcctgaacctgatcccccaccacctgtactttgccaccctgggcggcctgctgctggccgtgaacccagccactggaaatgtcatctggaagcacagctgtgggaagcccctcttcagcagcccccagtgctgcagccagtacatctgcatcggctgtgtggatggcaacctgctgtgcttcacccactttggagagcaggtgtggcagttcagcaccagcggccccatcttcagcagcccctgcaccagccccagcgagcagaagatcttcttcggcagccatgactgcttcatctactgctgcaacatgaagggccacctgcagtggaagtttgagaccaccagccgggtgtatgccaccccatttgccttccacaactacaacggcagcaatgagatgctgctggccgccgccagcacagatggcaaggtgtggatcctggagagccagagcggccagctgcagagcgtgtatgagctgcccggggaggtgttcagcagccctgtggtgctggagagcatgctgatcatcggctgccgggacaactacgtgtactgcctggacctgctgggcggcaaccagaagtag

SEQ ID NO: 143420 - DNA, 2781 bp, Artificial Sequence
  Description of Artificial Sequence: Synthetic coding sequence
atgctgcaggtgcacaggacaggcctgggccgcctgggcgtgtccctgagcaagggcctgcaccacaaggctgtgctggccgtgagaagagaagatgtgaatgcctgggagcggcgggcccccctggcccccaagcacatcaagggcatcaccaacctgggctacaaggtgctgatccagcccagcaacagaagagccatccatgacaaggactatgtgaaggccggcggcatcctgcaggaggacatcagcgaggcctgcctgatcctgggcgtgaagaggcctcctgaggagaagctgatgagcaggaagacctacgccttcttcagccacaccatcaaggcccaggaggccaacatgggcctgctggatgagatcctgaagcaggagatccggctgattgattatgagaagatggtggaccaccggggcgtgcgggtggtggccttcggccagtgggccggcgtggccggcatgatcaacatcctgcacggcatgggcctgcggctgctggccctgggccaccacacccccttcatgcacatcggcatggcccacaactacagaaacagcagccaggccgtgcaggccgtgagagatgctggctatgagatcagcctgggcctgatgcccaagagcatcggccccctgacctttgtgttcaccggcactggaaatgtgtccaaaggagcccaggccatcttcaatgagctgccctgtgaatatgtggagccccatgagctgaaggaggtgtcccagacaggagacctgaggaaggtgtatggaacagtgctgagccgccaccaccacctggtgaggaagacagatgctgtgtatgaccctgcagaatatgacaagcaccctgagcgctacatcagccgcttcaacacagacatcgccccctacaccacctgcctgatcaatggcatctactgggagcagaacaccccccggctgctgacccggcaggatgcccagagcctgctggcccctgggaagttcagccctgctggggtggagggctgcccagccctgccccacaagctggtggccatctgtgacatctctgctgacacaggaggcagcattgagttcatgacagagtgcaccaccatcgagcaccccttctgcatgtatgatgctgaccagcacatcatccatgattctgtggagggcagcggcatcctgatgtgcagcattgacaacctgcctgcccagctgcccatcgaggccacagaatgttttggagacatgctgtacccctacgtggaggagatgatcctgagtgatgccacccagcccctggagagccagaacttcagccctgtggtgagagatgctgtgatcaccagcaatggcaccctgcctgacaagtacaagtacatccagaccctgcgggagagccgggagcgggcccagagcctgtccatgggcaccaggaggaaggtgctggtgctgggcagcggctacatcagcgagcctgtgctggagtacctgagcagagatggcaacatcgagatcaccgtgggcagtgacatgaagaaccagatcgagcagctgggcaagaagtacaacatcaaccctgtgtccatggacatctgcaagcaggaggagaagctgggcttcctggtggccaagcaggacctggtgatcagcctgctgccctacgtgctgcaccccctggtggccaaggcctgcatcaccaacaaggtgaacatggtgacagccagctacatcaccccagccctgaaggagctggagaagtctgtggaggatgctggcatcaccatcatcggggagctgggcctggaccccggcctggaccacatgctggccatggagaccatcgacaaggccaaggaggtgggcgccaccatcgagagctacatctcctactgcggcggcctgcctgcccctgagcacagcaacaaccccctgcgctacaagttctcctggagccctgtgggcgtgctgatgaatgtgatgcagagcgccacctacctgctggatggcaaggtggtgaatgtggccggcggcatctccttcctggatgctgtgacctccatggacttcttccctggcctgaacctggagggctaccccaacagagacagcaccaagtatgcagagatctacggcatcagcagcgcccacaccctgctgcggggcaccctgcgctacaagggctacatgaaggccctgaatggatttgtgaagctgggcctcatcaaccgggaggccctgcctgccttccggcctgaggccaaccccctgacctggaagcagctgctgtgtgacctggtgggcatcagccccagcagcgagcatgatgtgctgaaggaggccgtgctgaagaagctgggcggggacaacacccagctggaggccgctgagtggctgggcctgctgggagatgagcaggtgccccaggccgagagcatcctggatgccctgagcaagcacctggtgatgaagctgtcctatggccctgaggagaaggacatgattgtgatgagggacagctttggcatccgccaccccagcggccacctggagcacaagaccatcgacctggtggcctatggagacatcaatggcttcagcgccatggccaagacagtgggcctgcccacagccatggccgccaagatgctgctggatggagagatcggggccaagggcctgatgggccccttcagcaaggagatctacggccccatcctggagcgcatcaaggccgagggcatcatctacaccacccagagcaccatcaagccctag

SEQ ID NO: 143421 - DNA, 2781 bp, Artificial Sequence; identical to SEQ ID NO: 143420
  Description of Artificial Sequence: Synthetic coding sequence

SEQ ID NO: 143422 - DNA, 942 bp, Artificial Sequence
  Description of Artificial Sequence: Synthetic coding sequence
atgcagccccagagcgtgctgcacagcggctacttccaccccctgctgcgggcctggcagacagccaccaccaccctgaatgccagcaacctgatctaccccatctttgtgacctatggagtgaagaggctggaggagatgctgcggcccctggtggaggagggcctgcgctgtgtgctgatcttcggcgtgcccagccgggtgcccaaggatgagcggggcagcgctgctgacagcgaggagagccctgccatcgaggccatccacctgctgaggaagaccttccccaacctgctggtggcctgtgatgtgtgcctgtgcccctacaccagccacggccactgcggcctgctgtctgaaaatggagccttccgggcagaggagagccggcagaggctggccgaggtggccctggcctatgccaaggccggctgccaggtggtggcccccagcgacatgatggatggccgggtggaggccatcaaggaggccctgatggcccacggcctgggcaacagagtgtctgtgatgagctacagcgccaagtttgccagctgcttctacggccccttcagagatgctgccaagagcagccctgcctttggagaccggcgctgctaccagctgcccccaggggcccggggcctggccctgcgggctgtggacagagatgtgcgggagggcgctgacatgctgatggtgaagccaggcatgccctacctggacatcgtgcgggaggtgaaggacaagcacccagacctgcccctggccgtgtaccacgtgtctggagaatttgccatgctgtggcacggggcccaggccggggcctttgacctgaaggctgctgtgctggaggccatgacagccttcagaagagctggagctgacatcatcatcacctactacaccccccagctgctgcagtggctgaaggaggagtag

SEQ ID NO: 143423 - DNA, 993 bp, Artificial Sequence
  Description of Artificial Sequence: Synthetic coding sequence
atgcagccccagagcgtgctgcacagcggctacttccaccccctgctgcgggcctggcagacagccaccaccaccctgaatgccagcaacctgatctaccccatctttgtgacagatgtgcctgatgacatccagcccatcaccagcctgcccggggtggcccgctatggagtgaagaggctggaggagatgctgcggcccctggtggaggagggcctgcgctgtgtgctgatctttggagtgcccagccgggtgcccaaggatgagcggggcagcgctgctgacagcgaggagagccctgccatcgaggccatccacctgctgaggaagaccttccccaacctgctggtggcctgtgatgtgtgcctgtgcccctacaccagccacggccactgcggcctgctgtctgaaaatggagccttccgggcagaggagagccggcagaggctggccgaggtggccctggcctatgccaaggccggctgccaggtggtggcccccagcgacatgatggatggccgggtggaggccatcaaggaggccctgatggcccacggcctgggcaacagagtgtctgtgatgagctacagcgccaagtttgccagctgcttctacggccccttcagagatgctgccaagagcagccctgccttcggggaccggcgctgctaccagctgcccccaggggcccggggcctggccctgcgggctgtggacagagatgtgcgggagggcgctgacatgctgatggtgaagccaggcatgccctacctggacatcgtgcgggaggtgaaggacaagcacccagacctgcccctggccgtgtaccacgtgtctggagaatttgccatgctgtggcatggagcccaggccggggcctttgacctgaaggctgctgtgctggaggccatgacagccttccggcgggccggggctgacatcatcatcacctactacaccccccagctgctgcagtggctgaaggaggagtag

SEQ ID NO: 143424 - DNA, 45 bp, Artificial Sequence; identical to SEQ ID NO: 72628
  Description of Artificial Sequence: Synthetic coding sequence

SEQ ID NO: 143425 - DNA, 363 bp, Artificial Sequence
  Description of Artificial Sequence: Synthetic coding sequence
atgcccctgtgccccctggcccacgccatgcagccccagagcgtgctgcacagcggctacttccaccccctgctgcgggcctggcagacagccaccaccaccctgaatgccagcaacctgatctaccccatctttgtgacagatgtgcctgatgacatccagcccatcaccagcctgcccggggtggcccgctatggagtgaagaggctggaggagatgctgcggcccctggtggaggagggcctgcgctgtgtgctgatcttcggcgtgcccagccgggtgcccaaggatgagcggggcagcgctgctgacagcgaggagagccctgccatcgaggccatccacctgctgaggaagacctag

SEQ ID NO: 143426 - DNA, 180 bp, Artificial Sequence
  Description of Artificial Sequence: Synthetic coding sequence
atgcccctgtgccccctggcccacgccatgcagccccagagcgtgctgcacagcggctacttccaccccctgctgcgggcctggcagacagccaccaccaccctgaatgccagcaacctgatctaccccatctttgtgacagatgtgcctgatgacatccagcccatcaccagcctgtag

SEQ ID NO: 143427 - DNA, 1923 bp, Artificial Sequence
  Description of Artificial Sequence: Synthetic coding sequence
atggagagcgtggtgcggcgctgccccttcctgagccgggtgccccaggccttcctgcagaaggccggcaagagcctgctcttctacgcccagaactgccccaagatgatggaggtgggcgccaagccagccccccgggccctgagcacagctgctgtgcactaccagcagatcaaggagaccccaccagccagcgagaaggacaagacagccaaggccaaggtgcagcagaccccagatggcagccagcagagcccagatggcacccagctgcccagcggccaccccctgcctgccaccagccagggcacagccagcaaatgtcccttcctggccgcccagatgaaccagaggggcagctctgtgttctgcaaggccagcctggagctgcaggaggatgtgcaggagatgaatgctgtgaggaaggaggtggccgagaccagcgctggccccagcgtggtgtctgtgaagacagatggaggagaccccagcggcctgctgaagaacttccaggacatcatgcagaagcagaggcctgagcgggtgagccacctgctgcaggacaacctgcccaagtctgtgtccaccttccagtatgaccgcttctttgagaagaagattgatgagaagaagaatgaccacacctacagagtcttcaagacagtgaacagaagagcccacatcttccccatggctgatgactacagcgacagcctcatcaccaagaagcaggtgtctgtgtggtgcagcaatgactacctgggcatgagccgccacccccgggtgtgtggggctgtgatggacaccctgaagcagcacggggccggggccggcggcaccaggaacatcagcggcaccagcaagttccacgtggacctggagcgggagctggccgacctgcacggcaaggatgctgccctgctcttcagcagctgctttgtggccaatgacagcaccctcttcaccctggccaagatgatgcctggctgtgagatctacagcgacagcggcaaccacgcctccatgatccagggcatccggaacagccgggtgcccaagtacatcttccgccacaatgatgtgagccacctgcgggagctgctgcagaggagtgaccccagcgtgcccaagatcgtggcctttgaaacagtgcacagcatggatggagctgtgtgccccctggaggagctgtgtgatgtggcccacgagtttggagccatcacctttgtggatgaggtgcatgctgtgggcctgtatggagcccggggcggcggcatcggggacagagatggagtgatgcccaagatggacatcatcagcggcaccctgggcaaggccttcggctgtgtgggcggctacatcgccagcaccagcagcctgattgacacagtgcgctcctatgctgctggcttcatcttcaccaccagcctgccccccatgctgctggccggggccctggagagcgtgcgcatcctgaagtctgctgagggccgggtgctgcggcggcagcaccagagaaatgtgaagctgatgaggcagatgctgatggatgctggcctgcctgtggtgcactgccccagccacatcatccctgtgcgggtggctgatgctgccaagaacacagaggtgtgtgatgagctgatgagccgccacaacatctacgtgcaggccatcaactaccccaccgtgcccagaggagaggagctgctgcgcatcgcccccaccccccaccacaccccccagatgatgaactacttcctggagaacctgctggtgacctggaagcaggtgggcctggagctgaagccccacagcagcgctgagtgcaacttctgcagaagacccctgcactttgaggtgatgtctgagcgggagaagagctacttcagcggcctgagcaagctggtgtctgcccaggcctag

SEQ ID NO: 143428 - DNA, 1923 bp, Artificial Sequence; identical to SEQ ID NO: 143427
  Description of Artificial Sequence: Synthetic coding sequence

SEQ ID NO: 143429 - DNA, 345 bp, Artificial Sequence
  Description of Artificial Sequence: Synthetic coding sequence
atggagagcgtggtgcggcgctgccccttcctgagccgggtgccccaggccttcctgcagaaggccggcaagagcctgctcttctacgcccagaactgccccaagatgatggaggtgggcgccaagccagccccccgggccctgagcacagctgctgtgcactaccagcagatcaaggagaccccaccagccagcgagaaggacaagacagccaaggccaaggtgcagcagaccccagatggcagccagcagagcccagatggcacccagttccggctggacaccccctgcctgccccaggcccgggccctgcaggccaatgccctgtcctggcagcacaggtag

SEQ ID NO: 143430 - DNA, 1923 bp, Artificial Sequence; identical to SEQ ID NO: 143427
  Description of Artificial Sequence: Synthetic coding sequence

SEQ ID NO: 143431 - DNA, 1923 bp, Artificial Sequence; identical to SEQ ID NO: 143427
  Description of Artificial Sequence: Synthetic coding sequence

SEQ ID NO: 143432 - DNA, 1764 bp, Artificial Sequence
  Description of Artificial Sequence: Synthetic coding sequence
atggtgacagctgccatgctgctgcagtgctgccctgtgctggcccggggccccaccagcctgctgggcaaggtggtgaagacccaccagttcctgtttggaattggccgctgccccatcctggccacccagggccccaactgcagccagatccacctgaaggccaccaaggccggcggggacagccccagctgggccaagggccactgccccttcatgctgtctgagctgcaggacggcaagagcaagatcgtgcagaaggccgcccctgaggtgcaggaggatgtgaaggccttcaagacagacctgcccagcagcctggtgtctgtgtccctgaggaagcccttcagcggcccccaggagcaggagcagatcagcggcaaggtgacccacctgatccagaacaacatgcctggcaactacgtgttctcctatgaccagttcttccgggacaagatcatggagaagaagcaggaccacacctacagagtcttcaagacagtgaaccgctgggcagatgcctacccctttgcccagcacttcagcgaggcctctgtggccagcaaggatgtgtctgtgtggtgcagcaatgactacctgggcatgagccgccacccccaggtgctgcaggccacccaggagaccctgcagagacatggagctggagctgggggcaccaggaacatcagcggcaccagcaagttccacgtggagctggagcaggagctggccgagctgcaccagaaggacagcgccctgctcttcagcagctgctttgtggccaatgacagcaccctcttcaccctggccaagatcctgcccggctgtgagatctacagtgatgctggcaaccacgcctccatgatccagggcatcagaaattctggagctgccaagtttgtgttccgccacaatgaccctgaccacctgaagaagctgctggagaagagcaaccccaagatccccaagatcgtggcctttgaaacagtgcacagcatggatggagccatctgccccctggaggagctgtgtgatgtgagccaccagtacggggccctgacctttgtggatgaggtgcatgctgtgggcctgtatggcagcagaggagctggcatcggggagagagatggcatcatgcacaagattgacatcatcagcggcaccctgggcaaggccttcggctgtgtgggcggctacatcgccagcacccgggacctggtggacatggtgcgctcctatgctgctggcttcatcttcaccaccagcctgccccccatggtgctgagcggggccctggagagcgtgcggctgctgaagggggaggagggccaggccctgcggcgggcccaccagagaaatgtgaagcacatgaggcagctgctgatggaccggggcctgcctgtgatcccctgccccagccacatcatccccatccgggtgggcaatgctgccctgaacagcaagctgtgtgacctgctgctgagcaagcacggcatctacgtgcaggccatcaactaccccaccgtgcccagaggagaggagctgctgcggctggcccccagcccccaccacagcccccagatgatggaggactttgtggagaagctgctgctggcctggacagctgtgggcctgcccctgcaggatgtgtctgtggccgcctgcaacttctgcagaagacctgtgcactttgagctgatgtctgagtgggagaggagctactttggaaacatgggcccccagtatgtgaccacctacgcctag

SEQ ID NO: 143433 - DNA, 1653 bp, Artificial Sequence
  Description of Artificial Sequence: Synthetic coding sequence
atggtgacagctgccatgctgctgcagtgctgccctgtgctggcccggggccccaccagcctgctgggcaaggtggtgaagacccaccagttcctgtttggaattggccgctgccccatcctggccacccagggccccaactgcagccagatccacctgaaggccaccaaggccggcggggacagccccagctgggccaagggccactgccccttcatgctgtctgagctgcaggacggcaagagcaagatcgtgcagaaggccgcccctgaggtgcaggaggatgtgaaggccttcaagacaggcaactacgtgttctcctatgaccagttcttccgggacaagatcatggagaagaagcaggaccacacctacagagtcttcaagacagtgaaccgctgggcagatgcctacccctttgcccagcacttcagcgaggcctctgtggccagcaaggatgtgtctgtgtggtgcagcaatgactacctgggcatgagccgccacccccaggtgctgcaggccacccaggagaccctgcagagacatggagctggggccggcggcaccaggaacatcagcggcaccagcaagttccacgtggagctggagcaggagctggccgagctgcaccagaaggacagcgccctgctcttcagcagctgctttgtggccaatgacagcaccctcttcaccctggccaagatcctgcccggctgtgagatctacagtgatgctggcaaccacgcctccatgatccagggcatccggaacagcggggccgccaagtttgtgttccgccacaatgaccctgaccacctgaagaagctgctggagaagagcaaccccaagatccccaagatcgtggcctttgagaccgtgcacagcatggatggagccatctgccccctggaggagctgtgtgatgtgagccaccagtatggagccctgacctttgtggatgaggtgcatgctgtgggcctgtatggcagcagaggagctggcattggagagagagatggcatcatgcacaagattgacatcatcagcggcaccctgggcaaggccttcggctgtgtgggcggctacatcgccagcacccgggacctggtggacatggtgcgctcctatgctgctggcttcatcttcaccaccagcctgccccccatggtgctgagcggggccctggagagcgtgcggctgctgaagggggaggagggccaggccctgcggcgggcccaccagagaaatgtgaagcacatgaggcagctgctgatggaccggggcctgcccgtcatcccctgccccagccacatcatccccatccgggtgggcaatgctgccctgaacagcaagctgtgtgacctgctgctgagcaagcacggcatctacgtgcaggccatcaactaccccaccgtgcccagaggagaggagctgctgcggctggcccccagcccccaccacagcccccagatgatggaggactttgtggagaagctgctgctggcctggacagctgtgggcctgcccctgcaggatgtgtctgtggccgcctgcaacttctgccggcggcctgtgcactttgagctgatgtctgagtgggagaggagctacttcggcaacatgggcccccagtatgtgaccacctacgcctag

SEQ ID NO: 143434 - DNA, 1725 bp, Artificial Sequence
  Description of Artificial Sequence: Synthetic coding sequence
atgagaggaggagaggtggccctgggctggaacaagaagaagaggctcttctgtgaggacttccgcttcaagatggtgacagctgccatgctgctgcagtgctgccctgtgctggcccggggccccaccagcctgctgggcaaggtggtgaagacccaccagttcctgtttggaattggccgctgccccatcctggccacccagggccccaactgcagccagatccacctgaaggccaccaaggccggcggggacagccccagctgggccaagggccactgccccttcatgctgtctgagctgcaggacggcaagagcaagatcgtgcagaaggccgcccctgaggtgcaggaggatgtgaaggccttcaagacaggcaactacgtgttctcctatgaccagttcttccgggacaagatcatggagaagaagcaggaccacacctacagagtcttcaagacagtgaaccgctgggcagatgcctacccctttgcccagcacttcagcgaggcctctgtggccagcaaggatgtgtctgtgtggtgcagcaatgactacctgggcatgagccgccacccccaggtgctgcaggccacccaggagaccctgcagagacatggagctggggccggcggcaccaggaacatcagcggcaccagcaagttccacgtggagctggagcaggagctggccgagctgcaccagaaggacagcgccctgctcttcagcagctgctttgtggccaatgacagcaccctcttcaccctggccaagatcctgcccggctgtgagatctacagtgatgctggcaaccacgcctccatgatccagggcatccggaacagcggggccgccaagtttgtgttccgccacaatgaccctgaccacctgaagaagctgctggagaagagcaaccccaagatccccaagatcgtggcctttgagaccgtgcacagcatggatggagccatctgccccctggaggagctgtgtgatgtgagccaccagtatggagccctgacctttgtggatgaggtgcatgctgtgggcctgtatggcagcagaggagctggcattggagagagagatggcatcatgcacaagattgacatcatcagcggcaccctgggcaaggccttcggctgtgtgggcggctacatcgccagcacccgggacctggtggacatggtgcgctcctatgctgctggcttcatcttcaccaccagcctgccccccatggtgctgagcggggccctggagagcgtgcggctgctgaagggggaggagggccaggccctgcggcgggcccaccagagaaatgtgaagcacatgaggcagctgctgatggaccggggcctgcccgtcatcccctgccccagccacatcatccccatccgggtgggcaatgctgccctgaacagcaagctgtgtgacctgctgctgagcaagcacggcatctacgtgcaggccatcaactaccccaccgtgcccagaggagaggagctgctgcggctggcccccagcccccaccacagcccccagatgatggaggactttgtggagaagctgctgctggcctggacagctgtgggcctgcccctgcaggatgtgtctgtggccgcctgcaacttctgccggcggcctgtgcactttgagctgatgtctgagtgggagaggagctacttcggcaacatgggcccccagtatgtgaccacctacgcctag

SEQ ID NO: 143435 - DNA, 669 bp, Artificial Sequence
  Description of Artificial Sequence: Synthetic coding sequence
tgactgagctttgtgcggccccagtgccgggccacagacagccccagctgggccaagggccactgccccttcatgctgtctgagctgcaggacggcaagagcaagatcgtgcagaaggccgcccctgaggtgcaggaggatgtgaaggccttcaagacagacctgcccagcagcctggtgtctgtgtccctgaggaagcccttcagcggcccccaggagcaggagcagatcagcggcaaggtgacccacctgatccagaacaacatgcctggcaactacgtgttctcctatgaccagttcttccgggacaagatcatggagaagaagcaggaccacacctacagagtcttcaagacagtgaaccgctgggcagatgcctacccctttgcccagcacttcagcgaggcctctgtggccagcaaggatgtgtctgtgtggtgcagcaatgactacctgggcatgagccgccacccccaggtgctgcaggccacccaggagaccctgcagagacatggagctggagctgggggcaccaggaacatcagcggcaccagcaagttccacgtggagctggagcaggagctggccgagctgcaccagaaggacagcgccctgctcttcagcagctgctttgtggccaatgacagcaccctcttcaccctggcctag

SEQ ID NO: 143436 - DNA, 1212 bp, Artificial Sequence
  Description of Artificial Sequence: Synthetic coding sequence
atgcagagagctgtgtctgtggtggcccggctgggcttccggctgcaggccttccccccagccctgtgccggcccctgagctgtgcccaggaggtgctgcggaggacccccctgtatgacttccacctggcccatggaggcaagatggtggcctttgctggctggagcctgcctgtgcagtacagagacagccacacagacagccacctgcacacccggcagcactgcagcctgtttgatgtgagccacatgctgcagaccaagatcctgggcagtgacagagtgaagctgatggagagcctggtggtgggggacattgctgagctgcggcccaaccagggcaccctgagcctcttcaccaatgaagctgggggcatcctggatgacctgattgtgaccaacaccagcgagggccacctgtatgtggtgtccaatgccggctgctgggagaaggacctggccctgatgcaggacaaggtgcgggagctgcagaaccagggcagagatgtgggcctggaggtgctggacaatgccctgctggccctgcagggccccacagctgcccaggtgctgcaggccggcgtggctgatgacctgaggaagctgcccttcatgaccagcgctgtgatggaggtgtttggagtgtctggctgccgggtgacccgctgtggctacaccggggaggatggagtggagatctctgtgcctgtggccggggctgtgcacctggccacagccatcctgaagaaccctgaggtgaagctggccggcctggccgcccgggacagcctgcggctggaggccggcctgtgcctgtatggaaatgacattgatgagcacaccacccctgtggagggcagcctgtcctggaccctgggcaagagaagaagagctgccatggacttccctggggccaaggtgattgtgccccagctgaagggccgggtgcagaggagaagagtgggcctgatgtgtgagggcgcccccatgagggcccacagccccatcctgaacatggagggcaccaagattggcaccgtgaccagcggctgccccagccccagcctgaagaagaatgtggccatgggctacgtgccctgtgagtacagccggcccggcaccatgctgctggtggaggtgcggaggaagcagcagatggctgtggtgtccaagatgccctttgtgcccaccaactactacaccctgaagtag

SEQ ID NO: 143437 - DNA, 1161 bp, Artificial Sequence
  Description of Artificial Sequence: Synthetic coding sequence
atgcagagagctgtgtctgtggtggcccggctgggcttccggctgcaggccttccccccagccctgtgccggcccctgagctgtgcccaggaggtgctgcggaggacccccctgtatgacttccacctggcccatggaggcaagatggtggcctttgctggctggagcctgcctgtgcagtacagagacagccacacagacagccacctgcacacccggcagcactgcagcctgtttgatgtgagccacatgctgcagaccaagatcctgggcagtgacagagtgaagctgatggagagcctggtggtgggggacattgctgagctgcggcccaaccagggcaccctgagcctcttcaccaatgaagctgggggcatcctggatgacctgattgtgaccaacaccagcgagggccacctgtatgtggtgtccaatgccggctgctgggagaaggacctggccctgatgcaggacaaggtgcgggagctgcagaaccagggcagagatgtgggcctggaggtgctggacaatgccctgctggccctgcagggccccacagctgcccaggtgctgcaggccggcgtggctgatgacctgaggaagctgcccttcatgaccagcgctgtgatggaggtgtttggagtgtctggctgccgggtgacccgctgtggctacaccggggaggatggagtggagatctctgtgcctgtggccggggctgtgcacctggccacagccatcctgaagaaccctgaggtgaagctggccggcctggccgcccgggacagcctgcggctggaggccggcctgtgcctgtatggaaatgacattgatgagcacaccacccctgtggagggcagcctgtcctggaccctgggcaagagaagaagagctgccatggacttccctggggccaaggtgattgtgccccagctgaagggccgggtgcagaggagaagagtgggcctgatgtgtgagggcgcccccatgagggcccacagccccatcctgaacatggagggcaccaagattggcaccgtgaccagcggctgccccagccccagcctgaagaagaatgtggccatgggctacgtgccctgtgagtacagccggcccggcaccatgctgctggtggagctgcccagcggcccctgcttctag

SEQ ID NO: 143438 - DNA, 1155 bp, Artificial Sequence
  Description of Artificial Sequence: Synthetic coding sequence
tgagctgtgtctgtggtggcccggctgggcttccggctgcaggccttccccccagccctgtgccggcccctgagctgtgcccaggaggtgctgcggaggacccccctgtatgacttccacctggcccatggaggcaagatggtggcctttgctggctggagcctgcctgtgcagtacagagacagccacacagacagccacctgcacacccggcagcactgcagcctgtttgatgtgagccacatgctgcagaccaagatcctgggcagtgacagagtgaagctgatggagagcctggtggtgggggacattgctgagctgcggcccaaccagggcaccctgagcctcttcaccaatgaagctgggggcatcctggatgacctgattgtgaccaacaccagcgagggccacctgtatgtggtgtccaatgccggctgctgggagaaggacctggccctgatgcaggacaaggtgcgggagctgcagaaccagggcagagatgtgggcctggaggtgctggacaatgccctgctggccctgcagggccccacagctgcccaggtgctgcaggccggcgtggctgatgacctgaggaagctgcccttcatgaccagcgctgtgatggaggtgtttggagtgtctggctgccgggtgacccgctgtggctacaccggggaggatggagtggagatctctgtgcctgtggccggggctgtgcacctggccacagccatcctgaagaaccctgaggtgaagctggccggcctggccgcccgggacagcctgcggctggaggccggcctgtgcctgtatggaaatgacattgatgagcacaccacccctgtggagggcagcctgtcctggaccctgggcaagagaagaagagctgccatggacttccctggggccaaggtgattgtgccccagctgaagggccgggtgcagaggagaagagtgggcctgatgtgtgagggcgcccccatgagggcccacagccccatcctgaacatggagggcaccaagattggcaccgtgaccagcggctgccccagccccagcctgaagaagaatgtggccatgggctacgtgccctgtgagtacagccggcccggcaccatgctgctggtggagctgcccagcggcccctgcttctag

SEQ ID NO: 143439 - DNA, 1080 bp, Artificial Sequence
  Description of Artificial Sequence: Synthetic coding sequence
atgcagagagctgtgtctgtggtggcccggctgggcttccggctgcaggccttccccccagccctgtgccggcccctgagctgtgcccaggaggtgctgcggaggacccccctgtatgacttccacctggcccatggaggcaagatggtggcctttgctggctggagcctgcctgtgcagtacagagacagccacacagacagccacctgcacacccggcagcactgcagcctgtttgatgtgagccacatgctgcagaccaagatcctgggcagtgacagagtgaagctgatggagagcctggtggtgggggacattgctgagctgcggcccaaccaggacaaggtgcgggagctgcagaaccagggcagagatgtgggcctggaggtgctggacaatgccctgctggccctgcagggccccacagctgcccaggtgctgcaggccggcgtggctgatgacctgaggaagctgcccttcatgaccagcgctgtgatggaggtgtttggagtgtctggctgccgggtgacccgctgtggctacaccggggaggatggagtggagatctctgtgcctgtggccggggctgtgcacctggccacagccatcctgaagaaccctgaggtgaagctggccggcctggccgcccgggacagcctgcggctggaggccggcctgtgcctgtatggaaatgacattgatgagcacaccacccctgtggagggcagcctgtcctggaccctgggcaagagaagaagagctgccatggacttccctggggccaaggtgattgtgccccagctgaagggccgggtgcagaggagaagagtgggcctgatgtgtgagggcgcccccatgagggcccacagccccatcctgaacatggagggcaccaagattggcaccgtgaccagcggctgccccagccccagcctgaagaagaatgtggccatgggctacgtgccctgtgagtacagccggcccggcaccatgctgctggtggaggtgcggaggaagcagcagatggctgtggtgtccaagatgccctttgtgcccaccaactactacaccctgaagtag

SEQ ID NO: 143440 - DNA, 1044 bp, Artificial Sequence
  Description of Artificial Sequence: Synthetic coding sequence
atgcagagagctgtgtctgtggtggcccggctgggcttccggctgcaggccttccccccagccctgtgccggcccctgagctgtgcccagaccaagatcctgggcagtgacagagtgaagctgatggagagcctggtggtgggggacattgctgagctgcggcccaaccagggcaccctgagcctcttcaccaatgaagctgggggcatcctggatgacctgattgtgaccaacaccagcgagggccacctgtatgtggtgtccaatgccggctgctgggagaaggacctggccctgatgcaggacaaggtgcgggagctgcagaaccagggcagagatgtgggcctggaggtgctggacaatgccctgctggccctgcagggccccacagctgcccaggtgctgcaggccggcgtggctgatgacctgaggaagctgcccttcatgaccagcgctgtgatggaggtgtttggagtgtctggctgccgggtgacccgctgtggctacaccggggaggatggagtggagatctctgtgcctgtggccggggctgtgcacctggccacagccatcctgaagaaccctgaggtgaagctggccggcctggccgcccgggacagcctgcggctggaggccggcctgtgcctgtatggaaatgacattgatgagcacaccacccctgtggagggcagcctgtcctggaccctgggcaagagaagaagagctgccatggacttccctggggccaaggtgattgtgccccagctgaagggccgggtgcagaggagaagagtgggcctgatgtgtgagggcgcccccatgagggcccacagccccatcctgaacatggagggcaccaagattggcaccgtgaccagcggctgccccagccccagcctgaagaagaatgtggccatgggctacgtgccctgtgagtacagccggcccggcaccatgctgctggtggaggtgcggaggaagcagcagatggctgtggtgtccaagatgccctttgtgcccaccaactactacaccctgaagtag

SEQ ID NO: 143441 - DNA, 921 bp, Artificial Sequence
  Description of Artificial Sequence: Synthetic coding sequence
atggagagcctggtggtgggggacattgctgagctgcggcccaaccagggcaccctgagcctcttcaccaatgaggccggcggcatcctggatgacctgattgtgaccaacaccagcgagggccacctgtatgtggtgtccaatgccggctgctgggagaaggacctggccctgatgcaggacaaggtgcgggagctgcagaaccagggcagagatgtgggcctggaggtgctggacaatgccctgctggccctgcagggccccacagctgcccaggtgctgcaggccggcgtggctgatgacctgaggaagctgcccttcatgaccagcgctgtgatggaggtgtttggagtgtctggctgccgggtgacccgctgtggctacacaggagaagatggagtggagatctctgtgcctgtggccggggctgtgcacctggccacagccatcctgaagaaccctgaggtgaagctggccggcctggccgcccgggacagcctgcggctggaggccggcctgtgcctgtatggaaatgacattgatgagcacaccacccctgtggagggcagcctgtcctggaccctgggcaagagaagaagagctgccatggacttccctggggccaaggtgattgtgccccagctgaagggccgggtgcagaggcggcgggtgggcctgatgtgtgagggcgcccccatgagggcccacagccccatcctgaacatggagggcaccaagattggaacagtgaccagcggctgccccagccccagcctgaagaagaatgtggccatgggctacgtgccctgtgagtacagcaggcctggcaccatgctgctggtggaggtgcggaggaagcagcagatggctgtggtgtccaagatgccctttgtgcccaccaactactacaccctgaagtag

SEQ ID NO: 143442 - DNA, 2760 bp, Artificial Sequence
  Description of Artificial Sequence: Synthetic coding sequence
atgtggctggccgccgccgcccccagcctggcccggcggctgctcttcctgggccccccacctccacccctgctgctgctggtgttcagccgcagcagcagaagaaggctgcacagcctgggcctggccgccatgcctgagaagaggccctttgagcggctgcctgcagatgtgagccccatcaactacagcctgtgcctgaagccagacctgctggacttcacctttgagggcaagctggaggccgccgcccaggtgcggcaggccaccaaccagatcgtgatgaactgtgccgacatcgacatcatcacagccagctatgccccagaaggagatgaggagatccacgccaccggcttcaactaccagaatgaagatgagaaggtgaccctgtccttccccagcaccctgcagacaggaacaggcaccctgaagattgactttgtgggggagctgaatgacaagatgaagggcttctaccgcagcaagtacaccacccccagcggggaggtgcgctatgctgctgtgacccagtttgaggccacagatgcccggcgggccttcccctgctgggatgagcccgccatcaaggccacctttgacatcagcctggtggtgcccaaggacagagtggccctgagcaacatgaatgtgattgacaggaagccctacccagatgatgagaacctggtggaggtgaagtttgcccggacccctgtgatgagcacctacctggtggcctttgtggtgggggagtatgactttgtggagaccaggagcaaggatggagtgtgtgtgcgggtgtacacccctgtgggcaaggccgagcagggcaagtttgccctggaggtggccgccaagaccctgcccttctacaaggactacttcaacgtgccctaccccctgcccaagattgacctgattgccatcgctgactttgctgctggggccatggagaactggggcctggtgacctaccgggagacagccctgctgattgaccccaagaacagctgcagcagcagccggcagtgggtggccctggtggtgggccacgagctggcccaccagtggtttggaaacctggtgaccatggagtggtggacccacctgtggctgaatgaaggatttgcctcctggattgagtacctgtgtgtggaccactgcttcccagaatatgacatctggacccagtttgtgtctgctgactacacccgggcccaggagctggatgccctggacaacagccaccccatcgaggtgtctgtgggccaccccagcgaggtggatgagatctttgatgccatctcctacagcaagggggccagcgtcatccgcatgctgcatgactacatcggggacaaggacttcaagaagggcatgaacatgtacctgaccaagttccagcagaagaatgctgccacagaggacctgtgggagagcctggagaatgccagcggcaagcccatcgctgctgtgatgaacacctggaccaagcagatgggcttccccctcatctacgtggaggccgagcaggtggaggatgaccggctgctgcggctgagccagaagaagttctgtgccggcggcagctatgtgggggaggactgcccccagtggatggtgcccatcaccatcagcaccagcgaggaccccaaccaggccaagctgaagatcctgatggacaagccagagatgaatgtggtgctgaagaatgtgaagccagaccagtgggtgaagctgaacctgggcaccgtgggcttctaccgcacccagtacagcagcgccatgctggagagcctgctgcccggcatccgggacctgagcctgccccctgtggaccggctgggcctgcagaatgacctcttcagcctggcccgggccggcatcatcagcacagtggaggtgctgaaggtgatggaggcctttgtgaatgagcccaactacacagtgtggagcgacctgagctgcaacctgggcatcctgagcaccctgctgagccacacagacttctatgaggagatccaggagtttgtgaaggatgtgttcagccccatcggggagcggctgggctgggaccccaagccaggagagggccacctggatgccctgctgcggggcctggtgctgggcaagctgggcaaggccggccacaaggccaccctggaggaggcccggcggcgcttcaaggaccacgtggagggcaagcagatcctgtctgctgacctgcggagccctgtgtacctgactgtgctgaagcatggagatggcaccaccctggacatcatgctgaagctgcacaagcaggccgacatgcaggaggagaagaacagaattgagcgggtgctgggcgccaccctgctgcctgacctgatccagaaggtgctgacctttgccctgtctgaggaggtgcggccccaggacacagtgtctgtgattggaggagtggccggcggcagcaagcacggcaggaaggccgcctggaagttcatcaaggacaactgggaggagctgtacaaccgctaccagggcggcttcctgatcagccgcctcatcaagctgtctgtggagggctttgctgtggacaagatggccggggaggtgaaggccttctttgagagccacccagcccccagcgctgagaggaccatccagcagtgctgtgagaacatcctgctgaatgctgcctggctgaagagagatgctgagagcatccaccagtacctgctgcagaggaaggccagcccccccaccgtgtag

SEQ ID NO: 143443 - DNA, 1884 bp, Artificial Sequence
  Description of Artificial Sequence: Synthetic coding sequence
atgtggctggccgccgccgcccccagcctggcccggcggctgctcttcctgggccccccacctccacccctgctgctgctggtgttcagccgcagcagcagaagaaggctgcacagcctgggcctggctgatgtgagccccatcaactacagcctgtgcctgaagccagacctgctggacttcacctttgagggcaagctggaggccgccgcccaggtgcggcaggccaccaaccagatcgtgatgaactgtgccgacatcgacatcatcacagccagctatgccccagaaggagatgaggagatccacgccaccggcttcaactaccagaatgaagatgagaaggtgaccctgtccttccccagcaccctgcagacaggcaccggcaccctgaagattgactttgtgggggagctgaatgacaagatgaagggcttctaccgcagcaagtacaccaccccatctggagaggtgcgctatgctgctgtgacccagtttgaggccacagatgcccggcgggccttcccctgctgggatgagcccgccatcaaggccacctttgacatcagcctggtggtgcccaaggacagagtggccctgagcaacatgaatgtcatcgacaggaagccctacccagatgatgagaacctggtggaggtgaagtttgcccggacccctgtgatgagcacctacctggtggcctttgtggtgggggagtatgactttgtggagaccaggagcaaggatggagtgtgtgtgcgggtgtacacccctgtgggcaaggccgagcagggcaagtttgccctggaggtggccgccaagaccctgcccttctacaaggactacttcaacgtgccctaccccctgcccaagattgacctgattgccatcgctgactttgctgctggggccatggagaactggggcctggtgacctaccgggagacagccctgctgattgaccccaagaacagctgcagcagcagccggcagtgggtggccctggtggtgggccacgagctggcccaccagtggtttggaaacctggtgaccatggagtggtggacccacctgtggctgaatgaaggatttgcctcctggattgagtacctgtgtgtggaccactgcttcccagaatatgacatctggacccagtttgtgtctgctgactacacccgggcccaggagctggatgccctggacaacagccaccccatcgaggtgtctgtgggccaccccagcgaggtggatgagatctttgatgccatctcctacagcaaaggagccagcgtcatccgcatgctgcatgactacatcggggacaaggacttcaagaagggcatgaacatgtacctgaccaagttccagcagaagaatgctgccacagaggacctgtgggagagcctggagaatgccagcggcaagcccatcgctgctgtgatgaacacctggaccaagcagatgggcttccccctcatctacgtggaggccgagcaggtggaggatgaccggctgctgcggctgagccagaagaagttctgtgccggcggcagctatgtgggggaggactgcccccagtggatggtgcccatcaccatcagcaccagcgaggaccccaaccaggccaagctgaagatcctgatggacaagccagagatgaatgtggtgctgaagaatgtgaagccagaccagtgggtgaagctgaacctgggcaccgtgggcttctaccgcacccagtacagcagcgccatgctggagagcctgctgcccggcatccgggacctgagcctgccccctgtggaccggctgggcctgcagaatgacctcttcagcctcttcatcctgtgtgtgcgggaggtgtctggcaactgctgccgggcctag

SEQ ID NO: 143444 - DNA, 2520 bp, Artificial Sequence
  Description of Artificial Sequence: Synthetic coding sequence
atgcctgagaagaggccctttgagcggctgcctgcagatgtgagccccatcaactacagcctgtgcctgaagccagacctgctggacttcacctttgagggcaagctggaggccgccgcccaggtgcggcaggccaccaaccagatcgtgatgaactgtgccgacatcgacatcatcacagccagctatgccccagaaggagatgaggagatccacgccaccggcttcaactaccagaatgaagatgagaaggtgaccctgtccttccccagcaccctgcagacaggaacaggcaccctgaagattgactttgtgggggagctgaatgacaagatgaagggcttctaccgcagcaagtacaccacccccagcggggaggtgcgctatgctgctgtgacccagtttgaaaatgtgattgacaggaagccctacccagatgatgagaacctggtggaggtgaagtttgcccggacccctgtgatgagcacctacctggtggcctttgtggtgggggagtatgactttgtggagaccaggagcaaggatggagtgtgtgtgcgggtgtacacccctgtgggcaaggccgagcagggcaagtttgccctggaggtggccgccaagaccctgcccttctacaaggactacttcaacgtgccctaccccctgcccaagattgacctgattgccatcgctgactttgctgctggggccatggagaactggggcctggtgacctaccgggagacagccctgctgattgaccccaagaacagctgcagcagcagccggcagtgggtggccctggtggtgggccacgagctggcccaccagtggtttggaaacctggtgaccatggagtggtggacccacctgtggctgaatgaaggatttgcctcctggattgagtacctgtgtgtggaccactgcttcccagaatatgacatctggacccagtttgtgtctgctgactacacccgggcccaggagctggatgccctggacaacagccaccccatcgaggtgtctgtgggccaccccagcgaggtggatgagatctttgatgccatctcctacagcaagggggccagcgtcatccgcatgctgcatgactacatcggggacaaggacttcaagaagggcatgaacatgtacctgaccaagttccagcagaagaatgctgccacagaggacctgtgggagagcctggagaatgccagcggcaagcccatcgctgctgtgatgaacacctggaccaagcagatgggcttccccctcatctacgtggaggccgagcaggtggaggatgaccggctgctgcggctgagccagaagaagttctgtgccggcggcagctatgtgggggaggactgcccccagtggatggtgcccatcaccatcagcaccagcgaggaccccaaccaggccaagctgaagatcctgatggacaagccagagatgaatgtggtgctgaagaatgtgaagccagaccagtgggtgaagctgaacctgggcaccgtgggcttctaccgcacccagtacagcagcgccatgctggagagcctgctgcccggcatccgggacctgagcctgccccctgtggaccggctgggcctgcagaatgacctcttcagcctggcccgggccggcatcatcagcacagtggaggtgctgaaggtgatggaggcctttgtgaatgagcccaactacacagtgtggagcgacctgagctgcaacctgggcatcctgagcaccctgctgagccacacagacttctatgaggagatccaggagtttgtgaaggatgtgttcagccccatcggggagcggctgggctgggaccccaagccaggagagggccacctggatgccctgctgcggggcctggtgctgggcaagctgggcaaggccggccacaaggccaccctggaggaggcccggcggcgcttcaaggaccacgtggagggcaagcagatcctgtctgctgacctgcggagccctgtgtacctgactgtgctgaagcatggagatggcaccaccctggacatcatgctgaagctgcacaagcaggccgacatgcaggaggagaagaacagaattgagcgggtgctgggcgccaccctgctgcctgacctgatccagaaggtgctgacctttgccctgtctgaggaggtgcggccccaggacacagtgtctgtgattggaggagtggccggcggcagcaagcacggcaggaaggccgcctggaagttcatcaaggacaactgggaggagctgtacaaccgctaccagggcggcttcctgatcagccgcctcatcaagctgtctgtggagggctttgctgtggacaagatggccggggaggtgaaggccttctttgagagccacccagcccccagcgctgagaggaccatccagcagtgctgtgagaacatcctgctgaatgctgcctggctgaagagagatgctgagagcatccaccagtacctgctgcagaggaaggccagcccccccaccgtgtag

SEQ ID NO: 143445 - DNA, 1125 bp, Artificial Sequence
  Description of Artificial Sequence: Synthetic coding sequence
atgaggagccctgctgtgcccaccccagcccggggccagctgggcgtggcctttgtgctgctgcccccccacagcgagggcgcccgggtgtttggagccctgggccccatcggccccagcagccctggcctgaccctgggcggcctggccgtgtctgagcaccggctgagcaacaagctgctggcctggagcggcgtgctggagtggcaggagaagagaagaccctacagcgacagcacagccaagctgaagaggaccctgccctgccaggcctacgtgaaccagggcgagaacctggagacagaccagtggccccagaagctgatcatgcagctgatcccccagcagctgctgaccaccctgggccccctcttcaggaacagccagctggcccagttccacttcaccaacagagactgtgacagcctgaagggcctgtgccgcatcatgggaaatggatttgctggctgcatgctgttcccccacatcagcccctgtgaggtgcgggtgctgatgctgctgtacagcagcaagaagaagatcttcatgggcctcatcccctatgaccagagcggctttgtgtctgccatccggcaggtgatcaccaccaggaagcaggccgtgggccctgggggcgtgaacagcggccctgtgcagatcgtgaacaacaagttcctggcctggagcggcgtgatggagtggcaggagcccaggcctgagcccaacagccgcagcaagcgctggctgcccagccacgtgtatgtgaaccagggcgagatcctgaggacagagcagtggcccaggaagctgtacatgcagctgatcccccagcagctgctgaccaccctggtgcccctcttcaggaacagccggctggtgcagttccacttcaccaaggacctggagaccctgaagagcctgtgccgcatcatggacaatggcttccggaggaagagcagcctggccagcagccccatgacccgggccaccctgagcacagccagcggcgtgtccctgcccaccagcagccgcagctgcagcggcacctggagccgcagcaacagcaatgaaggctggggcggcagcggctacccaggcctgggccccagccgcagccacaggtag

SEQ ID NO: 143446 - DNA, 594 bp, Artificial Sequence
  Description of Artificial Sequence: Synthetic coding sequence
atgatgttcccccagagccgccacagcggcagcagccacctgccccagcagctgaagttcaccaccagtgacagctgtgaccgcatcaaggatgagttccagctgctgcaggcccagtaccacagcctgaagctggagtgtgacaagctggccagcgagaagtctgagatgcagaggcactacgtgatgtactatgagatgtcctatggcctgaacatcgagatgcacaagcaggccgagatcgtgaagaggctgaatggcatctgtgcccaggtgctgccctacctgagccaggagcaccagcagcaggtgctgggcgccatcgagcgggccaagcaggtgacagcccctgagctgaacagcatcatccggcagcagctgcaggcccaccagctgagccagctgcaggccctggccctgcccctgacccccctgcctgtgggcctgcagccccccagcctgcctgctgtgtctgctggcaccggcctgctgagcctgagcgccctgggcagccaggcccacctgagcaaggaggacaagaatggacatgatggagacacccaccaggaggatgatggagagaagagtgactag

SEQ ID NO: 143447 - DNA, 1362 bp, Artificial Sequence
  Description of Artificial Sequence: Synthetic coding sequence
atgggcgtgctgggccgggtgctgctgtggctgcagctgtgtgccctgacccaggccgtgtccaagctgtgggtgcccaacacagactttgatgtggccgccaactggagccagaacagaacaccctgtgccggcggcgctgtggagttccctgctgacaagatggtgtctgtgctggtgcaggagggccatgctgtgtctgacatgctgctgcccctggatggagagctggtgctggccagcggggccggctttggagtgtctgatgtgggcagccacctggactgtggggccggggagcctgctgtgttccgggacagcgaccgcttctcctggcatgacccccacctgtggaggtctggagatgaggcccctggcctcttctttgtggatgctgagcgggtgccctgcagacatgatgatgtgttcttccccccatctgccagcttccgggtgggcctgggccctggggccagccctgtgcgggtgcgcagcatcagcgccctgggccgcaccttcaccagagatgaggacctggccgtgttcctggccagcagagctggccgcctgcgcttccacggccctggggccctgtctgtgggccctgaggactgtgccgaccccagcggctgtgtgtgtggaaatgctgaggcccagccctggatctgtgccgccctgctgcagcccctgggcggccgctgcccccaggccgcctgccacagcgccctgcggccccagggccagtgctgtgacctgtgtggggctgtggtgctgctgacccacggccctgcctttgacctggagcgctaccgggcccgcatcctggacaccttcctgggcctgccccagtaccacggcctgcaggtggccgtgtccaaggtgcccaggagcagccggctgcgggaggccgacacagagatccaggtggtgctggtggagaatggacctgagaccggcggggccggccgcctggcccgggccctgctggctgatgtggccgagaatggagaggccctgggcgtgctggaggccaccatgagggagagcggggcccacgtgtggggcagcagcgctgctggcctggccggcggcgtggccgctgctgtgctgctggccctgctggtgctgctggtggccccacccctgctgcggcgggccggccgcctgcgctggaggagacatgaggccgccgccccagctggggcccccctgggcttcagaaatcctgtgtttgatgtgacagccagcgaggagctgcccctgccccggcggctgagcctggtgcccaaggctgctgctgacagcaccagccacagctactttgtgaaccccctgtttgctggagctgaggccgaggcctag

SEQ ID NO: 143448 - DNA, 1962 bp, Artificial Sequence
  Description of Artificial Sequence: Synthetic coding sequence
atggctgacatcaagacaggcatctttgccaagaatgtgcagaagaggctgaacagagcccaggagaaggtgctgcagaagctgggcaaggcagatgagaccaaggatgagcagtttgaggagtatgtgcagaacttcaagaggcaggaggccgagggcacccggctgcagcgggagctgcggggctacctggccgccatcaagggcatgcaggaggcctccatgaagctgacagagagcctgcacgaggtgtatgagccagactggtacggcagagaagatgtgaagatggtgggggagaagtgtgatgtgctgtgggaggacttccaccagaagctggtggatggcagcctgctgaccctggacacctacctgggccagttcccagacatcaagaacagaattgccaagaggagcaggaagctggtggactatgattctgcccggcaccacctggaggccctgcagagcagcaagaggaaggatgagagccgcatcagcaaggccgaggaggagttccagaaggcccagaaggtgtttgaggagttcaacgtggacctgcaggaggagctgcccagcctgtggagcagaagagtgggcttctacgtgaacaccttcaagaatgtgagcagcctggaggccaagttccacaaggagattgctgtgctgtgccacaagctgtatgaggtgatgaccaagctgggggaccagcacgccgacaaggccttcaccatccagggcgcccccagcgacagcggccccctgagaattgccaagacccccagccccccagaggagcccagccccctgcccagccccacagccagccccaaccacaccctggccccagccagccctgccccagcccggcccaggagccccagccagaccaggaaaggacctcctgtgccccccctgcccaaggtgacccccaccaaggagctgcagcaggagaacatcatctccttctttgaggacaactttgtgcctgagatctctgtgaccacccccagccagaatgaggtgcctgaggtgaagaaggaggagaccctgctggacctggactttgaccccttcaagccagaggtgaccccagctggcagcgctggggtgacccacagccccatgagccagaccctgccctgggacctgtggaccaccagcacagacctggtgcagcctgccagcggcggcagcttcaacggcttcacccagccccaggacaccagcctcttcaccatgcagacagaccagagcatgatctgcaacctgatcatccctggagcagatgctgatgctgctgtgggcaccctggtgtctgctgctgagggcgcccctggagaggaggccgaggccgagaaggccaccgtgcctgctggggagggcgtgtccctggaggaggccaagattggaacagagaccacagaaggagctgagagcgcccagcctgaggccgaggagctggaggccaccgtgccccaggagaaggtgatccccagcgtggtgattgaaccagccagcaaccacgaggaggagggggagaatgagatcaccatcggggctgagcccaaggagaccacagaagatgctgcccctcctggccccaccagcgagaccccagagctggccacagagcagaagcccatccaggacccccagcccaccccatctgccccagccatgggcgctgctgaccagctggccagcgcccgggaggccagccaggagctgcccccaggcttcctgtacaaggtggagaccctgcatgactttgaagctgccaacagtgatgagctgaccctgcagagaggagatgtggtgctggtggtgcccagcgacagcgaggccgaccaggatgctggctggctggtgggcgtgaaggagagtgactggctgcagtacagagacctggccacctacaagggcctcttccctgagaacttcacccggcggctggactag

SEQ ID NO: 143449 - DNA, 1794 bp, Artificial Sequence
  Description of Artificial Sequence: Synthetic coding sequence
atgaccaagctgggggaccagcacgccgacaaggccttcaccatccagggcgcccccagcgacagcggccccctgagaattgccaagacccccagccccccagaggagcccagccccctgcccagccccacagccagccccaaccacaccctggccccagccagccctgccccagcccggcccaggagccccagccagaccaggaaaggacctcctgtgccccccctgcccaaggtgacccccaccaaggagctgcagcaggagaacatcatctccttctttgaggacaactttgtgcctgagatctctgtgaccacccccagccagaatgaggtgcctgaggtgaagaaggaggagaccctgctggacctggactttgaccccttcaagccagaggtgaccccagctggcagcgctggggtgacccacagccccatgagccagaccctgccctgggacctgtggaccacccacaccttcaatgatgacatcacagacagcagcgagagcctgagcctgtgcaacctgatcatggaggagaccccagacagcggcctggccgaggagatccagaggagccagaatgacattggagccttcacctggggcccagatgccagcacagacagagtgtcccaggaggtgaccagcggcggctttggagaggacagcgcctgccccagcgagacagagcaggacatccggctgagcaccagcctgctgagcagcgctgactggcccaccgtggccgaggagagcgagcacgcccctggccctgccttccctggaggaaatgagcagctgccccccaagccagcccctgaggccggcgtggccatcgccgcctgtgtggagatggagcagctgtatgaccccctggacagcgacatgcctgccatggacacagctggcctcttcaaggagagccatgaggacatgaagaagagtgatgaggaggaggagaagcagaagatggaggacagcctgtgggccggcgtggaggcctgccagaaggccagcggcggcagcttcaacggcttcacccagccccaggacaccagcctcttcaccatgcagacagaccagagcatgatctgcaacctgatcatccctggagcagatgctgatgctgctgtgggcaccctggtgtctgctgctgagggcgcccctggagaggaggccgaggccgagaaggccaccgtgcctgctggggagggcgtgtccctggaggaggccaagattggaacagagaccacagaaggagctgagagcgcccagcctgaggccgaggagctggaggccaccgtgccccaggagaaggtgatccccagcgtggtgattgaaccagccagcaaccacgaggaggagggggagaatgagatcaccatcggggctgagcccaaggagaccacagaagatgctgcccctcctggccccaccagcgagaccccagagctggccacagagcagaagcccatccaggacccccagcccaccccatctgccccagccatgggcgctgctgaccagctggccagcgcccgggaggccagccaggagctgcccccaggcttcctgtacaaggtggagaccctgcatgactttgaagctgccaacagtgatgagctgaccctgcagagaggagatgtggtgctggtggtgcccagcgacagcgaggccgaccaggatgctggctggctggtgggcgtgaaggagagtgactggctgcagtacagagacctggccacctacaagggcctcttccctgagaacttcacccggcggctggactag

SEQ ID NO: 143450 - DNA, 2088 bp, Artificial Sequence
  Description of Artificial Sequence: Synthetic coding sequence
atggctgacatcaagacaggcatctttgccaagaatgtgcagaagaggctgaacagagcccaggagaaggtgctgcagaagctgggcaaggcagatgagaccaaggatgagcagtttgaggagtatgtgcagaacttcaagaggcaggaggccgagggcacccggctgcagcgggagctgcggggctacctggccgccatcaagggcatgcaggaggcctccatgaagctgacagagagcctgcacgaggtgtatgagccagactggtacggcagagaagatgtgaagatggtgggggagaagtgtgatgtgctgtgggaggacttccaccagaagctggtggatggcagcctgctgaccctggacacctacctgggccagttcccagacatcaagaacagaattgccaagaggagcaggaagctggtggactatgattctgcccggcaccacctggaggccctgcagagcagcaagaggaaggatgagagccgcatcagcaaggccgaggaggagttccagaaggcccagaaggtgtttgaggagttcaacgtggacctgcaggaggagctgcccagcctgtggagcagaagagtgggcttctacgtgaacaccttcaagaatgtgagcagcctggaggccaagttccacaaggagattgctgtgctgtgccacaagctgtatgaggtgatgaccaagctgggggaccagcacgccgacaaggccttcaccatccagggcgcccccagcgacagcggccccctgagaattgccaagacccccagccccccagaggagcccagccccctgcccagccccacagccagccccaaccacaccctggccccagccagccctgccccagcccggcccaggagccccagccagaccaggaaaggacctcctgtgccccccctgcccaaggtgacccccaccaaggagctgcagcaggagaacatcatctccttctttgaggacaactttgtgcctgagatctctgtgaccacccccagccagaatgaggtgcctgaggtgaagaaggaggagaccctgctggacctggactttgaccccttcaagccagaggtgaccccagctggcagcgctggggtgacccacagccccatgagccagaccctgccctgggacctgtggaccaccagcacagacctggtgcagcctgccagcggcggcagcttcaacggcttcacccagccccaggacaccagcctcttcaccatgcagacagaccagagcatgatctgcaacctggccgagagcgagcaggccccacccacagagcccaaggccgaggagcccctggccgctgtgaccccagctgtgggcctggacctgggcatggacaccagggctgaggagcctgtggaggaggccgtcatcatccctggagcagatgctgatgctgctgtgggcaccctggtgtctgctgctgagggcgcccctggagaggaggccgaggccgagaaggccaccgtgcctgctggggagggcgtgtccctggaggaggccaagattggaacagagaccacagaaggagctgagagcgcccagcctgaggccgaggagctggaggccaccgtgccccaggagaaggtgatccccagcgtggtgattgaaccagccagcaaccacgaggaggagggggagaatgagatcaccatcggggctgagcccaaggagaccacagaagatgctgcccctcctggccccaccagcgagaccccagagctggccacagagcagaagcccatccaggacccccagcccaccccatctgccccagccatgggcgctgctgaccagctggccagcgcccgggaggccagccaggagctgcccccaggcttcctgtacaaggtggagaccctgcatgactttgaagctgccaacagtgatgagctgaccctgcagagaggagatgtggtgctggtggtgcccagcgacagcgaggccgaccaggatgctggctggctggtgggcgtgaaggagagtgactggctgcagtacagagacctggccacctacaagggcctcttccctgagaacttcacccggcggctggactag

SEQ ID NO: 143451 - DNA, 591 bp, Artificial Sequence
  Description of Artificial Sequence: Synthetic coding sequence
atggaggagaccccagattctggcctggccgaggagatccagaggagccagaatgacatcggggccttcacctggggcccagatgccagcacagacagagtgtcccaggaggtgaccagcggcggctttggagaagattctgcctgccccagcgagacagagcaggacatccggctgagcaccagcctgctgagcagcgctgactggcccaccgtggccgaggagagcgagcacgcccctggccctgccttccctggaggaaatgagcagctgccccccaagccagcccctgaggccggcgtggccatcgccgcctgtgtggagatggagcagctgtatgaccccctggacagcgacatgcctgccatggacacagctggcctcttcaaggagagccatgaggacatgaagaagagtgatgaggaggaggagaagcagaagatggaggacagcctgtgggccggcgtggaggcctgccagaaggccagcggcggcagcttcaacggcttcacccagccccaggacaccagcctcttcaccatgcagacagaccagagcatgatctgcaacctggagatcaccgtgaactag

SEQ ID NO: 143452 - DNA, 1962 bp, Artificial Sequence
  Description of Artificial Sequence: Synthetic coding sequence
atggctgacatcaagacaggcatctttgccaagaatgtgcagaagaggctgaacagagcccaggagaaggtgctgcagaagctgggcaaggcagatgagaccaaggatgagcagtttgaggagtatgtgcagaacttcaagaggcaggaggccgagggcacccggctgcagcgggagctgcggggctacctggccgccatcaagggcatgcaggaggcctccatgaagctgacagagagcctgcacgaggtgtatgagccagactggtacggcagagaagatgtgaagatggtgggggagaagtgtgatgtgctgtgggaggacttccaccagaagctggtggatggcagcctgctgaccctggacacctacctgggccagttcccagacatcaagaacagaattgccaagaggagcaggaagctggtggactatgattctgcccggcaccacctggaggccctgcagagcagcaagaggaaggatgagagccgcatcagcaaggccgaggaggagttccagaaggcccagaaggtgtttgaggagttcaacgtggacctgcaggaggagctgcccagcctgtggagcagaagagtgggcttctacgtgaacaccttcaagaatgtgagcagcctggaggccaagttccacaaggagattgctgtgctgtgccacaagctgtatgaggtgatgaccaagctgggggaccagcacgccgacaaggccttcaccatccagggcgcccccagcgacagcggccccctgagaattgccaagacccccagccccccagaggagcccagccccctgcccagccccacagccagccccaaccacaccctggccccagccagccctgccccagcccggcccaggagccccagccagaccaggaaaggacctcctgtgccccccctgcccaaggtgacccccaccaaggagctgcagcaggagaacatcatctccttctttgaggacaactttgtgcctgagatctctgtgaccacccccagccagaatgaggtgcctgaggtgaagaaggaggagaccctgctggacctggactttgaccccttcaagccagaggtgaccccagctggcagcgctggggtgacccacagccccatgagccagaccctgccctgggacctgtggacagctggggtggaggcctgccagaaggccagcggcggcagcttcaacggcttcacccagccccaggacaccagcctcttcaccatgcagacagaccagagcatgatctgcaacctgatcatccctggagcagatgctgatgctgctgtgggcaccctggtgtctgctgctgagggcgcccctggagaggaggccgaggccgagaaggccaccgtgcctgctggggagggcgtgtccctggaggaggccaagattggaacagagaccacagaaggagctgagagcgcccagcctgaggccgaggagctggaggccaccgtgccccaggagaaggtgatccccagcgtggtgattgaaccagccagcaaccacgaggaggagggggagaatgagatcaccatcggggctgagcccaaggagaccacagaagatgctgcccctcctggccccaccagcgagaccccagagctggccacagagcagaagcccatccaggacccccagcccaccccatctgccccagccatgggcgctgctgaccagctggccagcgcccgggaggccagccaggagctgcccccaggcttcctgtacaaggtggagaccctgcatgactttgaagctgccaacagtgatgagctgaccctgcagagaggagatgtggtgctggtggtgcccagcgacagcgaggccgaccaggatgctggctggctggtgggcgtgaaggagagtgactggctgcagtacagagacctggccacctacaagggcctcttccctgagaacttcacccggcggctggactag

SEQ ID NO: 143453 - DNA, 1158 bp, Artificial Sequence
  Description of Artificial Sequence: Synthetic coding sequence
atggctgacatcaagacaggcatctttgccaagaatgtgcagaagaggctgaacagagcccaggagaaggtgctgcagaagctgggcaaggcagatgagaccaaggatgagcagtttgaggagtatgtgcagaacttcaagaggcaggaggccgagggcacccggctgcagcgggagctgcggggctacctggccgccatcaagggcatgcaggaggcctccatgaagctgacagagagcctgcacgaggtgtatgagccagactggtacggcagagaagatgtgaagatggtgggggagaagtgtgatgtgctgtgggaggacttccaccagaagctggtggatggcagcctgctgaccctggacacctacctgggccagttcccagacatcaagaacagaattgccaagaggagcaggaagctggtggactatgattctgcccggcaccacctggaggccctgcagagcagcaagaggaaggatgagagccgcatcagcaaggccgaggaggagttccagaaggcccagaaggtgtttgaggagttcaacgtggacctgcaggaggagctgcccagcctgtggagcagaagagtgggcttctacgtgaacaccttcaagaatgtgagcagcctggaggccaagttccacaaggagattgctgtgctgtgccacaagctgtatgaggtgatgaccaagctgggggaccagcacgccgacaaggccttcaccatccagggcgccccccggcagtacctggacagcggccccctgcgcatcgccaagacccccagccccccagaggagcccagccccctgcccagccccacagccagccccaaccacaccctggccccagccagccctgccccagcccggcccaggagccccagccagaccaggaagggcccccctgtgccccccctgcccaaggtgacccccaccaaggagctgcagcaggagaacatcatctccttctttgaggacaactttgtgcctgagatctctgtgaccacccccagccagaatgaggtgcctgaggtgaagaaggaggagaccctgctggacctggactttgaccccttcaagccagaggtgaccccagctggcagcgctggggtgacccacagccccatgagccagacagtgggctggtag

SEQ ID NO: 143454 - DNA, 759 bp, Artificial Sequence
  Description of Artificial Sequence: Synthetic coding sequence
atgagggcccccctgctgcccccagcccctgtggtgctgagcctgctgatcctgggcagcggccactacgccgccggcctggacctgaatgacacctacagcggcaagcgggagcccttcagcggggaccacagcgcagatggctttgaggtgaccagccgctctgagatgagcagcggcagcgagatcagccctgtgtctgagatgcccagcagcagcgagcccagcagtggagctgactatgactacagcgaggagtatgacaatgagccccagatccctggctacatcgtggatgattctgtgcgggtggagcaggtggtgaagccaccccagaacaagacagaaagtgagaacaccagtgacaagcccaagaggaagaagaagggcggcaagaatggcaagaacagaagaaacaggaagaagaagaacccctgcaatgctgagttccagaacttctgcatccacggggagtgcaagtacatcgagcacctggaggccgtgacctgcaagtgccagcaggagtactttggagagcgctgtggggagaagtccatgaagacccacagcatgattgacagcagcctgagcaagatcgccctggccgccatcgccgccttcatgtctgctgtgatcctgacagctgtggccgtcatcaccgtgcagctgcggcggcagtatgtgaggaaatatgaaggagaggccgaggagaggaagaagctgcggcaggagaatggaaatgtgcacgccatcgcctag

SEQ ID NO: 143455 - DNA, 759 bp, Artificial Sequence; identical to SEQ ID NO: 143454
  Description of Artificial Sequence: Synthetic coding sequence

SEQ ID NO: 143456 - DNA, 1536 bp, Artificial Sequence
  Description of Artificial Sequence: Synthetic coding sequence
atgaagctgttctggctgctcttcaccatcggcttctgctgggcccagtacagcagcaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatccacaaccccttccggccctggtgggagcgctaccagcctgtgtcctacaagctgtgcaccaggtctggaaatgaagatgagttcaggaacatggtgacccgctgcaacaacgtgggcgtgcgcatctacgtggatgctgtgatcaaccacatgtgtggaaatgctgtgtctgctggcaccagcagcacctgtggcagctacttcaaccctggcagccgggacttccctgctgtgccctacagcggctgggacttcaatgatggcaagtgcaagacaggcagcggggacatcgagaactacaatgatgccacccaggtgcgggactgccgcctgagcggcctgctggacctggccctgggcaaggactatgtgcgcagcaagattgctgagtacatgaaccacctgattgacatcggcgtggccggcttcagaattgatgccagcaagcacatgtggccaggggacatcaaggccatcctggacaagctgcacaacctgaacagcaactggttccctgagggcagcaagcccttcatctaccaggaggtgattgacctgggcggggagcccatcaagagcagtgactactttggaaatggccgggtgacagagttcaagtatggagccaagctgggcaccgtcatcaggaagtggaatggagagaagatgagctacctgaagaactggggcgagggctggggcttcatgcccagcgaccgggccctggtgtttgtggacaaccacgacaaccagaggggccacggggccggcggggccagcatcctgaccttctgggatgcccggctgtacaagatggctgtgggcttcatgctggcccacccctacggcttcaccagggtgatgagcagctaccgctggccccgctactttgaaaatggcaaggatgtgaatgactgggtgggccccccaaatgacaatggagtgaccaaggaggtgaccatcaacccagacaccacctgtggaaatgactgggtgtgtgagcaccgctggaggcagatccggaacatggtgaacttcagaaatgtggtggatggccagcccttcaccaactggtatgacaatggcagcaaccaggtggccttcggccggggcaacagaggcttcatcgtgttcaacaatgatgactggaccttcagcctgaccctgcagacaggcctgcctgctggcacctactgtgatgtgatcagcggggacaagatcaatggaaactgcaccggcatcaagatctacgtgtctgatgatggcaaggcccacttcagcatcagcaacagcgctgaggaccccttcatcgccatccatgctgagagcaagctgtag

SEQ ID NO: 143457 - DNA, 318 bp, Artificial Sequence
  Description of Artificial Sequence: Synthetic coding sequence
atgaagctgttctggctgctcttcaccatcggcttctgctgggcccagtacagcagcaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatccacaaccccttccggccctggtgggagcgctaccagcctgtgtcctacaagctgtgcaccaggtctggaaatgaagatgagttcaggaacatggtgacccgctgcaacaacgtgggctag

SEQ ID NO: 143458 - DNA, 681 bp, Artificial Sequence
  Description of Artificial Sequence: Synthetic coding sequence
atgaagctgttctggctgctcttcaccatcggcttctgctgggcccagtacagcagcaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatccacaaccccttccggccctggtgggagcgctaccagcctgtgtcctacaagctgtgcaccaggtctggaaatgaagatgagttcaggaacatggtgacccgctgcaacaacgtgggcgtgcgcatctacgtggatgctgtgatcaaccacatgtgtggaaatgctgtgtctgctggcaccagcagcacctgtggcagctacttcaaccctggcagccgggacttccctgctgtgccctacagcggctgggacttcaatgatggcaagtgcaagacaggcagcggggacatcgagaactacaatgatgccacccaggtgcgggactgccgcctgagcggcctgctggacctggccctgggcaaggactatgtgcgcagcaagattgctgagtacatgaaccacctgattgacatcggcgtggccggcttcagaattgatgccagcaagcacatgtggccaggggacatcaaggccatcctgtag

SEQ ID NO: 143459 - DNA, 1536 bp, Artificial Sequence; identical to SEQ ID NO: 143456
  Description of Artificial Sequence: Synthetic coding sequence

SEQ ID NO: 143460 - DNA, 1536 bp, Artificial Sequence; identical to SEQ ID NO: 143456
  Description of Artificial Sequence: Synthetic coding sequence

SEQ ID NO: 143461 - DNA, 318 bp, Artificial Sequence; identical to SEQ ID NO: 143457
  Description of Artificial Sequence: Synthetic coding sequence

SEQ ID NO: 143462 - DNA, 681 bp, Artificial Sequence; identical to SEQ ID NO: 143458
  Description of Artificial Sequence: Synthetic coding sequence

SEQ ID NO: 143463 - DNA, 1536 bp, Artificial Sequence; identical to SEQ ID NO: 143456
  Description of Artificial Sequence: Synthetic coding sequence

SEQ ID NO: 143464 - DNA, 1536 bp, Artificial Sequence
  Description of Artificial Sequence: Synthetic coding sequence
atgaagttcttcctgctgctcttcaccatcggcttctgctgggcccagtacagccccaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatctacaaccccttccggccctggtgggagcgctaccagcctgtgtcctacaagctgtgcaccaggtctggaaatgaagatgagttcaggaacatggtgacccgctgcaacaacgtgggcgtgcgcatctacgtggatgctgtgatcaaccacatgtgtggaaatgctgtgtctgctggcaccagcagcacctgtggcagctacttcaaccctggcagccgggacttccctgctgtgccctacagcggctgggacttcaatgatggcaagtgcaagacaggcagcggggacatcgagaactacaatgatgccacccaggtgcgggactgccgcctgaccggcctgctggacctggccctggagaaggactatgtgcgcagcaagattgctgagtacatgaaccacctgattgacatcggcgtggccggcttccggctggatgccagcaagcacatgtggccaggggacatcaaggccatcctggacaagctgcacaacctgaacagcaactggttccctgctggcagcaagcccttcatctaccaggaggtgattgacctgggcggggagcccatcaagagcagtgactactttggaaatggccgggtgacagagttcaagtatggagccaagctgggcaccgtcatcaggaagtggaatggagagaagatgagctacctgaagaactggggcgagggctggggctttgtgcccagcgaccgggccctggtgtttgtggacaaccacgacaaccagaggggccacggggccggcggggccagcatcctgaccttctgggatgcccggctgtacaagatggctgtgggcttcatgctggcccacccctacggcttcaccagggtgatgagcagctaccgctggccccggcagttccagaatggaaatgatgtgaatgactgggtgggcccccccaacaacaatggagtcatcaaggaggtgaccatcaacccagacaccacctgtggaaatgactgggtgtgtgagcaccgctggaggcagatccggaacatggtgatcttcagaaatgtggtggatggccagcccttcaccaactggtatgacaatggcagcaaccaggtggccttcggccggggcaacagaggcttcatcgtgttcaacaatgatgactggagcttcagcctgaccctgcagacaggcctgcctgctggcacctactgtgatgtgatcagcggggacaagatcaatggaaactgcaccggcatcaagatctacgtgtctgatgatggcaaggcccacttcagcatcagcaacagcgctgaggaccccttcatcgccatccatgctgagagcaagctgtag

SEQ ID NO: 143465 - DNA, 1536 bp, Artificial Sequence
  Description of Artificial Sequence: Synthetic coding sequence
atgaagttcttcctgctgctcttcaccatcggcttctgctgggcccagtacagccccaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatccacaaccccttccggccctggtgggagcgctaccagcctgtgtcctacaagctgtgcaccaggtctggaaatgaagatgagttcaggaacatggtgacccgctgcaacaacgtgggcgtgcgcatctacgtggatgctgtgatcaaccacatgtctggaaatgctgtgtctgctggcaccagcagcacctgtggcagctacttcaaccctggcagccgggacttccctgctgtgccctacagcggctgggacttcaatgatggcaagtgcaagacaggcagcggggacatcgagaactacaatgatgccacccaggtgcgggactgccgcctggtgggcctgctggacctggccctggagaaggactatgtgcgcagcaagattgctgagtacatgaaccacctgattgacatcggcgtggccggcttccggctggatgccagcaagcacatgtggccaggggacatcaaggccatcctggacaagctgcacaacctgaacagcaactggttccctgctggcagcaagcccttcatctaccaggaggtgattgacctgggcggggagcccatcaagagcagtgactactttggaaatggccgggtgacagagttcaagtatggagccaagctgggcaccgtcatcaggaagtggaatggagagaagatgagctacctgaagaactggggcgagggctggggcttcatgcccagcgaccgggccctggtgtttgtggacaaccacgacaaccagaggggccacggggccggcggggccagcatcctgaccttctgggatgcccggctgtacaagatggctgtgggcttcatgctggcccacccctacggcttcaccagggtgatgagcagctaccgctggccccggcagttccagaatggaaatgatgtgaatgactgggtgggcccccccaacaacaatggagtcatcaaggaggtgaccatcaacccagacaccacctgtggaaatgactgggtgtgtgagcaccgctggaggcagatccggaacatggtgaacttcagaaatgtggtggatggccagcccttcaccaactggtatgacaatggcagcaaccaggtggccttcggccggggcaacagaggcttcatcgtgttcaacaatgatgactggaccttcagcctgaccctgcagacaggcctgcctgctggcacctactgtgatgtgatcagcggggacaagatcaatggaaactgcaccggcatcaagatctacgtgtctgatgatggcaaggcccacttcagcatcagcaacagcgctgaggaccccttcatcgccatccatgctgagagcaagctgtag

SEQ ID NO: 143466 - DNA, 291 bp, Artificial Sequence
  Description of Artificial Sequence: Synthetic coding sequence
atgaagttcttcctgctgctcttcaccatcggcttctgctgggcccagtacagccccaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatccacaaccccttccggccctggtgggagcgctaccagcctgtgtcctacaagctgtgcaccaggtctggaaatgaagatgagttcagaaattag

SEQ ID NO: 143467 - DNA, 261 bp, Artificial Sequence
  Description of Artificial Sequence: Synthetic coding sequence
atgaagttcttcctgctgctcttcaccatcggcttctgctgggcccagtacagccccaacacccagcagggccgcaccagcatcgtgcacctgtttgagtggcgctgggtggacatcgccctggagtgtgagcgctacctggcccccaagggctttggaggagtgcaggtgtccccaccaaatgaaaatgtggccatccacaaccccttccggccctggtgggagcgctaccagcctgtgtcctacaagctgtgcacctag

SEQ ID NO: 143468 - DNA, 2313 bp, Artificial Sequence
  Description of Artificial Sequence: Synthetic coding sequence
atgctgcccggcctggccctgctgctgctggccgcctggacagcccgggccctggaggtgcccacagatggaaatgccggcctgctggccgagccccagatcgccatgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggaggtgtgcagcgagcaggccgagaccggcccctgccgggccatgatcagccgctggtactttgatgtgacagagggcaaatgtgcccccttcttctatggaggctgcggcggcaacagaaacaactttgacacagaggagtactgcatggctgtgtgtggcagcgccatgagccagagcctgctgaagaccacccaggagcccctggcccgggaccctgtgaagctgcccaccacagctgccagcaccccagatgctgtggacaagtacctggagaccccaggagatgaaaatgagcacgcccacttccagaaggccaaggagcggctggaggccaagcaccgggagaggatgagccaggtgatgagggagtgggaggaggccgagcggcaggccaagaacctgcccaaggctgacaagaaggccgtcatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgagcacgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccacccggcccggcagcggcctgaccaacatcaagacagaggagatcagcgaggtgaagatggatgctgagttcagacatgattctggctatgaggtgcaccaccagaagctggtgttctttgctgaagatgtgggcagcaacaagggggccatcatcggcctgatggtgggcggcgtggtgattgccaccgtcatcgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143469 - DNA, 2088 bp, Artificial Sequence
  Description of Artificial Sequence: Synthetic coding sequence
atgctgcccggcctggccctgctgctgctggccgcctggacagcccgggccctggaggtgcccacagatggaaatgccggcctgctggccgagccccagatcgccatgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggtgcccaccacagctgccagcaccccagatgctgtggacaagtacctggagaccccaggagatgaaaatgaacatgcccacttccagaaggccaaggagcggctggaggccaagcaccgggagaggatgagccaggtgatgagggagtgggaggaggccgagcggcaggccaagaacctgcccaaggctgacaagaaggctgtgatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgaacatgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccaccaggcctggcagcggcctgaccaacatcaagacagaggagatcagcgaggtgaagatggatgctgagttcagacatgacagcggctatgaggtgcaccaccagaagctggtgttctttgctgaagatgtgggcagcaacaagggggccatcatcggcctgatggtgggcggcgtggtgattgccaccgtgattgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143470 - DNA, 1920 bp, Artificial Sequence
  Description of Artificial Sequence: Synthetic coding sequence
atgctgcccggcctggccctgctgctgctggccgcctggacagcccgggccctggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggtgcccaccacagctgccagcaccccagatgctgtggacaagtacctggagaccccaggagatgaaaatgaacatgcccacttccagaaggccaaggagcggctggaggccaagcaccgggagaggatgagccaggtgatgagggagtgggaggaggccgagcggcaggccaagaacctgcccaaggctgacaagaaggctgtgatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgaacatgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccaccaggcctggcagcggcctgaccaacatcaagacagaggagatcagcgaggtgaagatggatgctgagttcagacatgacagcggctatgaggtgcaccaccagaagctggtgttctttgctgaagatgtgggcagcaacaagggggccatcatcggcctgatggtgggcggcgtggtgattgccaccgtgattgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143471 - DNA, 2256 bp, Artificial Sequence
  Description of Artificial Sequence: Synthetic coding sequence
atgctgcccggcctggccctgctgctgctggccgcctggacagcccgggccctggaggtgcccacagatggaaatgccggcctgctggccgagccccagatcgccatgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggaggtgtgcagcgagcaggccgagaccggcccctgccgggccatgatcagccgctggtactttgatgtgacagagggcaaatgtgcccccttcttctatggaggctgcggcggcaacagaaacaactttgacacagaggagtactgcatggctgtgtgtggcagcgccatccccaccacagctgccagcaccccagatgctgtggacaagtacctggagaccccaggagatgaaaatgaacatgcccacttccagaaggccaaggagcggctggaggccaagcaccgggagaggatgagccaggtgatgagggagtgggaggaggccgagcggcaggccaagaacctgcccaaggctgacaagaaggctgtgatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgaacatgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccaccaggcctggcagcggcctgaccaacatcaagacagaggagatcagcgaggtgaagatggatgctgagttcagacatgacagcggctatgaggtgcaccaccagaagctggtgttctttgctgaagatgtgggcagcaacaagggggccatcatcggcctgatggtgggcggcgtggtgattgccaccgtgattgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143472 - DNA, 2259 bp, Artificial Sequence
  Description of Artificial Sequence: Synthetic coding sequence
atgctgcccggcctggccctgctgctgctggccgcctggacagcccgggccctggaggtgcccacagatggaaatgccggcctgctggccgagccccagatcgccatgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggaggtgtgcagcgagcaggccgagaccggcccctgccgggccatgatcagccgctggtactttgatgtgacagagggcaaatgtgcccccttcttctatggaggctgcggcggcaacagaaacaactttgacacagaggagtactgcatggctgtgtgtggcagcgccatgagccagagcctgctgaagaccacccaggagcccctggcccgggaccctgtgaagctgcccaccacagctgccagcaccccagatgctgtggacaagtacctggagaccccaggagatgaaaatgagcacgcccacttccagaaggccaaggagcggctggaggccaagcaccgggagaggatgagccaggtgatgagggagtgggaggaggccgagcggcaggccaagaacctgcccaaggctgacaagaaggccgtcatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgagcacgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaaggcagcggcctgaccaacatcaagacagaggagatcagcgaggtgaagatggatgctgagttcagacatgattctggctatgaggtgcaccaccagaagctggtgttctttgctgaagatgtgggcagcaacaagggggccatcatcggcctgatggtgggcggcgtggtgattgccaccgtcatcgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143473 - DNA, 2145 bp, Artificial Sequence
  Description of Artificial Sequence: Synthetic coding sequence
atgctgcccggcctggccctgctgctgctggccgcctggacagcccgggccctggaggtgcccacagatggaaatgccggcctgctggccgagccccagatcgccatgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggtgtcccagagcctgctgaagaccacccaggagcccctggcccgggaccctgtgaagctgcccaccacagctgccagcaccccagatgctgtggacaagtacctggagaccccaggagatgaaaatgagcacgcccacttccagaaggccaaggagcggctggaggccaagcaccgggagaggatgagccaggtgatgagggagtgggaggaggccgagcggcaggccaagaacctgcccaaggctgacaagaaggccgtcatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgagcacgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccacccggcccggcagcggcctgaccaacatcaagacagaggagatcagcgaggtgaagatggatgctgagttcagacatgattctggctatgaggtgcaccaccagaagctggtgttctttgctgaagatgtgggcagcaacaagggggccatcatcggcctgatggtgggcggcgtggtgattgccaccgtcatcgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143474 - DNA, 2145 bp, Artificial Sequence
  Description of Artificial Sequence: Synthetic coding sequence
atgctgcccggcctggccctgctgctgctggccgcctggacagcccgggccctggaggtgtacccagagctgcagatcaccaacgtggtggaggccaaccagcctgtgaccatccagaactggtgcaagaggggcaggaagcagtgcaagacccacccccactttgtgatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaagaagatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagagagcgtggaggaggtggtgcgggaggtgtgcagcgagcaggccgagaccggcccctgccgggccatgatcagccgctggtactttgatgtgacagagggcaaatgtgcccccttcttctatggaggctgcggcggcaacagaaacaactttgacacagaggagtactgcatggctgtgtgtggcagcgccatgagccagagcctgctgaagaccacccaggagcccctggcccgggaccctgtgaagctgcccaccacagctgccagcaccccagatgctgtggacaagtacctggagaccccaggagatgaaaatgagcacgcccacttccagaaggccaaggagcggctggaggccaagcaccgggagaggatgagccaggtgatgagggagtgggaggaggccgagcggcaggccaagaacctgcccaaggctgacaagaaggccgtcatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgagcacgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccacccggcccggcagcggcctgaccaacatcaagacagaggagatcagcgaggtgaagatggatgctgagttcagacatgattctggctatgaggtgcaccaccagaagctggtgttctttgctgaagatgtgggcagcaacaagggggccatcatcggcctgatggtgggcggcgtggtgattgccaccgtcatcgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143475 - DNA, 2241 bp, Artificial Sequence
  Description of Artificial Sequence: Synthetic coding sequence
atggaccagctggaggacctgctggtgctcttcatcaactacgtgcccacagatggaaatgccggcctgctggccgagccccagatcgccatgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccacttcgtcatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaggaggatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagaatctgtggaggaggtggtgcgggaggtgtgcagcgagcaggccgagaccggcccctgccgggccatgatcagccgctggtactttgatgtgacagagggcaaatgtgcccccttcttctacggcggctgcggcggcaacagaaacaactttgacacagaggagtactgcatggctgtgtgtggcagcgccatccccaccacagctgccagcaccccagatgctgtggacaagtacctggagaccccaggagatgaaaatgagcacgcccacttccagaaggccaaggagcggctggaggccaagcaccgggagaggatgagccaggtgatgagggagtgggaggaggccgagcggcaggccaagaacctgcccaaggctgacaagaaggccgtcatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgagcacgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccacccggcccggcagcggcctgaccaacatcaagacagaggagatcagcgaggtgaagatggatgctgagttcagacatgattctggctatgaggtgcaccaccagaagctggtgttctttgctgaagatgtgggcagcaacaagggggccatcatcggcctgatggtgggcggcgtggtgattgccaccgtcatcgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143476 - DNA, 1983 bp, Artificial Sequence
  Description of Artificial Sequence: Synthetic coding sequence
atgttctgtggccgcctgaacatgcacatgaatgtgcagaatggcaagtgggacagcgaccccagcggcaccaagacctgcatcgacaccaaggagggcatcctgcagtactgccaggaggtgtacccagagctgcagatcaccaacgtggtggaggccaaccagcctgtgaccatccagaactggtgcaagaggggcaggaagcagtgcaagacccacccccacttcgtcatcccctaccgctgcctggtgggggagtttgtgtctgatgccctgctggtgcctgacaagtgcaagttcctgcaccaggagaggatggatgtgtgtgagacccacctgcactggcacacagtggccaaggagacctgcagcgagaagagcaccaacctgcatgactatggcatgctgctgccctgtggcatcgacaagttccggggcgtggagtttgtgtgctgccccctggccgaggagagtgacaacgtggacagcgcagatgctgaggaggatgacagtgatgtgtggtggggcggcgctgacacagattatgcagatggcagcgaggacaaggtggtggaggtggccgaggaggaggaggtggccgaggtggaggaggaggaggctgatgatgatgaagatgatgaagatggagatgaggtggaggaggaggccgaggagccctatgaggaggccacagagaggaccaccagcatcgccaccaccaccaccaccaccacagaatctgtggaggaggtggtgcgggtgcccaccacagctgccagcaccccagatgctgtggacaagtacctggagaccccaggagatgaaaatgagcacgcccacttccagaaggccaaggagcggctggaggccaagcaccgggagaggatgagccaggtgatgagggagtgggaggaggccgagcggcaggccaagaacctgcccaaggctgacaagaaggccgtcatccagcacttccaggagaaggtggagagcctggagcaggaggccgccaatgaaaggcagcagctggtggagacccacatggcccgggtggaggccatgctgaatgacagaagaaggctggccctggagaactacatcacagccctgcaggccgtgcccccccggcccaggcatgtgttcaacatgctgaagaagtatgtgcgggcagagcagaaggaccggcagcacaccctgaagcactttgagcacgtgaggatggtggaccccaagaaggccgcccagatccgcagccaggtgatgacccacctgcgggtcatctatgaaagaatgaaccagagcctgagcctgctgtacaacgtgcctgctgtggccgaggagatccaggatgaggtggatgagctgctgcagaaggagcagaactacagtgatgatgtgctggccaacatgatcagcgagccccgcatctcctatggaaatgatgccctgatgcccagcctgacagagaccaagaccaccgtggagctgctgcctgtgaatggagagttcagcctggatgacctgcagccctggcacagctttggagctgacagcgtgcctgccaacacagaaaatgaggtggagcctgtggatgcccggcctgctgctgaccggggcctgaccacccggcccggcagcggcctgaccaacatcaagacagaggagatcagcgaggtgaagatggatgctgagttcagacatgattctggctatgaggtgcaccaccagaagctggtgttctttgctgaagatgtgggcagcaacaagggggccatcatcggcctgatggtgggcggcgtggtgattgccaccgtcatcgtcatcaccctggtgatgctgaagaagaagcagtacaccagcatccaccacggcgtggtggaggtggatgctgctgtgaccccagaggagcggcacctgagcaagatgcagcagaatggctatgagaaccccacctacaagttctttgagcagatgcagaactag

SEQ ID NO: 143477 - DNA, 789 bp, Artificial Sequence
  Description of Artificial Sequence: Synthetic coding sequence
atgagggtgcaggacaccagcggcacctactactggcacatccccaccggcaccacccagtgggagcccccaggccgggccagccccagccagggcagcagcccccaggaggagagccagctgacctggacaggctttgcccacggggagggctttgaagatggagagttctggaaggatgagcccagtgatgaggcccccatggagctgggcctgaaggagcctgaggagggcaccctgaccttccctgcccagagcctgagccctgagcccctgccccaggaggaggagaagctgccccccaggaacaccaaccctggcatcaagtgctttgctgtgcgcagcctgggctgggtggagatgacagaggaggagctggcccctggccgcagctctgtggccgtgaacaactgcatccggcagctgagctaccacaagaacaacctgcatgaccccatgtctgggggctggggcgagggcaaggacctgctgctgcagctggaggatgagaccctgaagctggtggagccccagagccaggccctgctgcacgcccagcccatcatcagcatccgggtgtggggcgtgggccgggacagcggccgggactttgcctacgtggcccgggacaagctgacccagatgctgaagtgccacgtgttccgctgtgaggccccagccaagaacatcgccaccagcctgcacgagatctgcagcaaggcccggcccccacccctgcccggcctggtggccacctttgccctgcagggctgcggctggggccactag

SEQ ID NO: 143478 - DNA, 1482 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggtgcacatccgggtgtggggcgtgggcagcagcaagggccgggacagccccatcagcgccccagcccgggactttgcctttgtggccagtgacaaggacagctgcatgctgaagtgccacgtgttctgctgtgatgtgcctgccaaggccatcgccagcgccctgcacggcctgtgtgcccagatcctgtctgagcgggtggaggtgtctggagatgccagctgctgcagcccagaccccatcagccctgaggacctgccccggcaggtggagctgctggatgctgtgtcccaggccgcccagaagtatgaggccctgtacatgggcaccctgcctgtgaccaaggccatgggcatggatgtgctgaatgaggccatcggcaccctgacagcccggggggacagaaatgcctgggtgcccaccatgctgtctgtgtctgacagcctgatgacagcccaccccatccaggccgaggccagcacagaggaggagcccctgtggcagtgccctgtgcggctggtgaccttcatcggcgtgggccgggacccccacaccttcggcctgattgctgacctgggccggcagagcttccagtgtgccgccttctggtgccagccccatgctgggggcctgtctgaggccgtgcaggccgcctgcatggtgcagtaccagaagtgcctggtggccagcgctgcccggggcaaggcctggggcgcccaggcccgggcccggctgcggctgaagaggaccagctccatggacagccctgggggccccctgcccctgcccctgctgaagggcggcgtgggcggggccggggccacccccaggaagaggggcgtcttctccttcctggatgccttccggctgaagcccagcctgctgcacatgccctag

SEQ ID NO: 143479 - DNA, 1377 bp, Artificial Sequence
  Description of Artificial Sequence: Synthetic coding sequence
atgatcaccaagacccacaaggtggacctgggcctgcctgagaagaagaagaagaagaaggtggtgaaggagcctgagacccgctacagcgtgctgaacaatgatgactactttgctgatgtgagccccctgcgggccaccagccccagcaagtctgtggcccacggccaggcccctgagatgcccctggtgaagaagaagaagaagaagaagaagggcgtgtccaccctgtgtgaggagcacgtggagcctgagaccaccctgcctgccaggagaacagagaagagccccagcctgaggaagcaggtgtttggccacctggagttcctgtctggagagaagaagaacaagaagagccccctggccatgagccacgccagcggcgtgaagaccagcccagacccccggcagggcgaggaggagaccagggtgggcaagaagctgaagaagcacaagaaggagaagaagggggcccaggaccccacagccttctctgtgcaggacccctggttctgtgaggcccgggaggccagagatgtgggggacacctgcagcgtgggcaagaaggatgaggagcaggccgccctgggccagaagaggaagaggaagagcccccgggagcacaacgggaaggtgaagaagaagaagaagatccaccaggagggagatgccctgcccggccacagcaagcccagccgctccatggagagcagccccaggaagggcagcaagaagaagcctgtgaaggtggaggcccctgagtacatccccatcagtgatgaccccaaggccagcgccaagaagaagatgaagagcaagaagaaggtggagcagcctgtgattgaggagcccgccctgaagaggaagaagaagaagaagaggaaggagagcggcgtggccggggacccctggaaggaggagacagacacagacctggaggtggtgctggagaagaagggcaacatggatgaggcccacatcgaccaggtgcggaggaaggccctgcaggaggagattgaccgggagagcggcaagacagaggccagcgagaccaggaagtggacaggcacccagtttggccagtgggacacagctggctttgaaaatgaagaccagaagctgaagttcctgcggctgatgggcggcttcaagaacctgagccccagcttcagcaggcctgccagcaccatcgcccggcccaacatggccctgggcaagaaggctgctgacagcctgcagcagaacctgcagagggactatgaccgggccatgtcctggaagtacagcagaggagctggcctgggcttcagcacagcccccaacaagatcttctacatcgacagaaatgccagcaagtctgtgaagctggaggactag

SEQ ID NO: 143480 - DNA, 2214 bp, Artificial Sequence
  Description of Artificial Sequence: Synthetic coding sequence
atggcccacaggaagctggagagcgtgggcagcggcatgctggaccaccgggtgcggcccggccctgtgccccacagccaggagcctgagagcgaggacatggagctgcccctggagggctacgtgcctgagggcctggagctggccgccctgcggcctgagagccctgcccctgaggagcaggagtgccacaaccacagcccagatggagacagcagcagtgactatgtgaacaacaccagcgaggaggaggactatgatgagggcctgcctgaggaggaggagggcatcacctactacatccgctactgcccagaagatgacagctacctggagggcatggactgcaatggagaggagtacctggcccacagcgcccaccctgtggacacagatgagtgccaggaggccgtggaggagtggacagacagcgctggcccccacccccacggccacgaggccgagggcagccaggactacccagatggccagctgcccatcccagaagatgagcccagcgtgctggaggcccatgaccaggaggaggatggccactactgtgccagcaaggagggctaccaggactactacccagaggaggccaacggcaacacaggagccagcccctaccgcctgcggagaggagatggagacctggaggaccaggaggaggacatcgaccagatcgtggccgagatcaagatgagcctgtccatgaccagcatcaccagcgccagcgaggccagccctgagcacggccctgagcccggcccagaagattctgtggaggcctgcccccccatcaaggccagctgcagccccagcagacatgaggcccggcccaagagcctgaacctgctgcctgaggccaagcaccctggggacccccagaggggcttcaagcccaagaccaggaccccagaggagcggctgaagtggccccatgagcaggtgtgcaatggcctggagcagcccaggaagcagcagaggagtgacctgaatggacctgtggacaacaacaacatccctgagaccaagaaggtggccagcttccccagctttgtggccgtgcccggcccctgtgagcctgaggacctgattgatggcatcatctttgctgccaactacctgggcagcacccagctgctgtctgagaggaaccccagcaagaacatccgcatgatgcaggcccaggaggccgtgtcccgggtgaagaacagtgaaggagatgcccagaccctgacagaggtggacctcttcatcagcacccagaggatcaaggtgctgaatgctgacacccaggagaccatgatggaccacgccctgcggaccatctcctacatcgctgacatcggcaacatcgtggtgctgatggcccggcggaggatgcccaggtctgccagccaggactgcatcgagaccacccctggggcccaggagggcaagaagcagtacaagatgatctgccacgtgtttgaaagtgaagatgcccagctgattgcccagagcatcggccaggccttctctgtggcctaccaggagttcctgcgggccaacggcatcaaccctgaggacctgagccagaaggagtacagcgacatcatcaacacccaggagatgtacaatgatgacctgatccacttcagcaacagcgagaactgcaaggagctgcagctggagaagcacaagggggagatcctgggcgtggtggtggtggagagcggctggggcagcatcctgcccaccgtcatcctggccaacatgatgaatggaggccctgctgcccggagcggcaagctgagcatcggggaccagatcatgagcatcaatggcaccagcctggtgggcctgcccctggccacctgccagggcatcatcaagggcctgaagaaccagacccaggtgaagctgaacatcgtgtcctgcccccctgtgaccaccgtgctgatcaagaggccagacctgaagtaccagctgggcttctctgtgcagaatggcatcatctgcagcctgatgaggggcggcattgctgagcggggcggcgtgcgggtgggccaccgcatcatcgagatcaatggccagagcgtggtggccacagcccacgagaagatcgtgcaggccctgagcaacagcgtgggggagatccacatgaagaccatgcctgctgccatgttccggctgctgaccggccaggagacccccctgtacatctag

SEQ ID NO: 143481 - DNA, 84 bp, Artificial Sequence
  Description of Artificial Sequence: Synthetic coding sequence
atggcccacaggaagctggagagcgtgggcagcggcatgctggaccaccgggtgcggcccggccctgtgccccacagccagtag

SEQ ID NO: 143482 - DNA, 2250 bp, Artificial Sequence
  Description of Artificial Sequence: Synthetic coding sequence
atggcccacaggaagctggagagcgtgggcagcggcatgctggaccaccgggtgcggcccggccctgtgccccacagccaggagcctgagagcgaggacatggagctgcccctggagggctacgtgcctgagggcctggagctggccgccctgcggcctgagagccctgcccctgaggagcaggagtgccacaaccacagcccagatggagacagcagcagtgactatgtgaacaacaccagcgaggaggaggactatgatgagggcctgcctgaggaggaggagggcatcacctactacatccgctactgcccagaagatgacagctacctggagggcatggactgcaatggagaggagtacctggcccacagcgcccaccctgtggacacagatgagtgccaggaggccgtggaggagtggacagacagcgctggcccccacccccacggccacgaggccgagggcagccaggactacccagatggccagctgcccatcccagaagatgagcccagcgtgctggaggcccatgaccaggaggaggatggccactactgtgccagcaaggagggctaccaggactactacccagaggaggccaacggcaacacaggagccagcccctaccgcctgcggagaggagatggagacctggaggaccaggaggaggacatcgaccagatcgtggccgagatcaagatgagcctgtccatgaccagcatcaccagcgccagcgaggccagccctgagcacggccctgagcccggcccagaagattctgtggaggcctgcccccccatcaaggccagctgcagccccagcagacatgaggcccggcccaagagcctgaacctgctgcctgaggccaagcaccctggggacccccagaggggcttcaagcccaagaccaggaccccagaggagcggctgaagtggccccatgagcaggtgtgcaatggcctggagcagcccaggaagcagcagaggagtgacctgaatggacctgtggacaacaacaacatccctgagaccaagaaggtggccagcttccccagctttgtggccgtgcccggcccctgtgagcctgaggacctgattgatggcatcatctttgctgccaactacctgggcagcacccagctgctgtctgagaggaaccccagcaagaacatccgcatgatgcaggcccaggaggccgtgtcccgggtgaagaggatgcagaaggccgccaagatcaagaagaaggccaacagtgaaggagatgcccagaccctgacagaggtggacctcttcatcagcacccagaggatcaaggtgctgaatgctgacacccaggagaccatgatggaccacgccctgcggaccatctcctacatcgctgacatcggcaacatcgtggtgctgatggcccggcggaggatgcccaggtctgccagccaggactgcatcgagaccacccctggggcccaggagggcaagaagcagtacaagatgatctgccacgtgtttgaaagtgaagatgcccagctgattgcccagagcatcggccaggccttctctgtggcctaccaggagttcctgcgggccaacggcatcaaccctgaggacctgagccagaaggagtacagcgacatcatcaacacccaggagatgtacaatgatgacctgatccacttcagcaacagcgagaactgcaaggagctgcagctggagaagcacaagggggagatcctgggcgtggtggtggtggagagcggctggggcagcatcctgcccaccgtcatcctggccaacatgatgaatggaggccctgctgcccggagcggcaagctgagcatcggggaccagatcatgagcatcaatggcaccagcctggtgggcctgcccctggccacctgccagggcatcatcaagggcctgaagaaccagacccaggtgaagctgaacatcgtgtcctgcccccctgtgaccaccgtgctgatcaagaggccagacctgaagtaccagctgggcttctctgtgcagaatggcatcatctgcagcctgatgaggggcggcattgctgagcggggcggcgtgcgggtgggccaccgcatcatcgagatcaatggccagagcgtggtggccacagcccacgagaagatcgtgcaggccctgagcaacagcgtgggggagatccacatgaagaccatgcctgctgccatgttccggctgctgaccggccaggagacccccctgtacatctag

SEQ ID NO: 143483 - DNA, 2214 bp, Artificial Sequence; identical to SEQ ID NO: 143480
  Description of Artificial Sequence: Synthetic coding sequence

SEQ ID NO: 143484 - DNA, 795 bp, Artificial Sequence
  Description of Artificial Sequence: Synthetic coding sequence
atggcccacaggaagctggagagcgtgggcagcggcatgctggaccaccgggtgcggcccggccctgtgccccacagccaggagcctgagagcgaggacatggagctgcccctggagggctacgtgcctgagggcctggagctggccgccctgcggcctgagagccctgcccctgaggagcaggagtgccacaaccacagcccagatggagacagcagcagtgactatgtgaacaacaccagcgaggaggaggactatgatgagggcctgcctgaggaggaggagggcatcacctactacatccgctactgcccagaagatgacagctacctggagggcatggactgcaatggagaggagtacctggcccacagcgcccaccctgtggacacagatgagtgccaggaggccgtggaggagtggacagacagcgctggcccccacccccacggccacgaggccgagggcagccaggactacccagatggccagctgcccatcccagaagatgagcccagcgtgctggaggcccatgaccaggaggaggatggccactactgtgccagcaaggagggctaccaggactactacccagaggaggccaacggcaacacaggagccagcccctaccgcctgcggagaggagatggagacctggaggaccaggaggaggacatcgaccagatcgtggccgagatcaagatgagcctgtccatgaccagcatcaccagcgccagcgaggccagccctgagcacggccctgagcccggcccagaagattctgtggaggcctag

SEQ ID NO: 143485 - DNA, 2250 bp, Artificial Sequence; identical to SEQ ID NO: 143482
  Description of Artificial Sequence: Synthetic coding sequence

SEQ ID NO: 143486 - DNA, 213 bp, Artificial Sequence
  Description of Artificial Sequence: Synthetic coding sequence
atggcccacaggaagctggagagcgtgggcagcggcatgctggaccaccgggtgcggcccggccctgtgccccacagccaggagcctgagagcgaggacatggagctgcccctggagggctacgtgcctgagggcctggagctggccgccctgcggcctgagagccctgcccctgaggagcaggagtgccacaaccacagcccagatggatag

SEQ ID NO: 143487 - DNA, 15 bp, Artificial Sequence
  Description of Artificial Sequence: Synthetic coding sequence
atggcccacaggtag

SEQ ID NO: 143488 - DNA, 339 bp, Artificial Sequence
  Description of Artificial Sequence: Synthetic coding sequence
atggcccacaggaagctggagagcgtgggcagcggcatgctggaccaccgggtgcggcccggccctgtgccccacagccaggagcctgagagcgaggacatggagctgcccctggagggctacgtgcctgagggcctggagctggccgccctgcggcctgagagccctgcccctgaggagcaggagtgccacaaccacagcccagatggagacagcagcagtgactatgtgaacaacaccagcgaggaggaggactatgatgagggcctgcctgaggaggaggagggcatcacctactacatccgctactgcccagaagatgacagctacctggagtag

SEQ ID NO: 143489 - DNA, 2250 bp, Artificial Sequence; identical to SEQ ID NO: 143482
  Description of Artificial Sequence: Synthetic coding sequence

SEQ ID NO: 143490 - DNA, 2127 bp, Artificial Sequence
  Description of Artificial Sequence: Synthetic coding sequence
atgtctgtgcccagcagcctgagccagagcgccatcaatgccaacagccatggaggccctgccctgagcctgcccctgcccctgcacgccgcccacaaccagctgctgaatgccaagctgcaggccacagctgtgggccccaaggacctgcggagcgccatgggagagggcggcggccctgagcccggccctgccaatgccaagtggctgaaggagggccagaaccagctgcggcgggccgccacagcccaccgggaccagaacagaaatgtgaccctgaccctggccgaggaggccagccaggagcctgagatggcccccctgggccccaagggcctcatccacctgtacagcgagctggagctgagcgcccacaatgctgccaacagaggcctgcggggccctggcctcatcatcagcacccaggagcagggcccagatgaaggagaggagaaggccgccggggaggccgaggaggaggaggaggatgatgatgatgaggaggaggaggaggacctgagcagccccccaggcctgcctgagcccctggagagcgtggaggccccaccccggccccaggccctgacagatggcccccgggagcacagcaagagcgccagcctgctgtttggcatgagaaattctgctgccagtgatgaggacagctcctgggccaccctgagccagggcagccccagctatggcagccctgaggacacagacagcttctggaaccccaatgcctttgaaacagacagcgacctgcctgctggctggatgagggtgcaggacaccagcggcacctactactggcacatccccaccggcaccacccagtgggagcccccaggccgggccagccccagccagggcagcagcccccaggaggagagccagctgacctggacaggctttgcccatggagagggctttgaagatggagagttctggaaggatgagcccagtgatgaggcccccatggagctgggcctgaaggagcctgaggagggcaccctgaccttccctgcccagagcctgagccctgagcccctgccccaggaggaggagaagctgcccccaagaaacaccaaccctggcatcaagtgctttgctgtgcgcagcctgggctgggtggagatgacagaggaggagctggcccctggccgcagctctgtggccgtgaacaactgcatccggcagctgagctaccacaagaacaacctgcatgaccccatgtctgggggctggggcgagggcaaggacctgctgctgcagctggaggatgagaccctgaagctggtggagccccagagccaggccctgctgcacgcccagcccatcatcagcatccgggtgtggggcgtgggccgggacagcggccgggactttgcctacgtggcccgggacaagctgacccagatgctgaagtgccacgtgttccgctgtgaggccccagccaagaacatcgccaccagcctgcacgagatctgcagcaagatcatggccgagaggagaaatgcccgctgcctggtgaatggcctgagcctggaccacagcaagctggtggatgtgcccttccaggtggagttccctgcccccaagaatgagctggtgcagaagttccaggtgtactacctgggcaatgtgcctgtggccaagcctgtgggcgtggatgtgatcaatggagccctggagagcgtgctgagcagcagcagccgggagcagtggacccccagccacgtgtctgtggccccagccaccctgaccatcctgcaccagcagacagaagctgtgctgggagaatgtcgggtgcgcttcctgtccttcctggccgtgggcagagatgtgcacacctttgccttcatcatggctgctggccctgccagcttctgctgccacatgttctggtgtgagcccaatgctgccagcctgtctgaggccgtgcaggccgcctgcatgctgcgctaccagaagtgcctggatgcccggagccaggccagcaccagctgcctgcctgcccccccagctgagagcgtggccaggagagtgggctggacagtgcggcggggcgtgcagagcctgtggggcagcctgaagcccaagaggctgggcgcccacaccccctag

SEQ ID NO: 143491 - DNA, 2127 bp, Artificial Sequence; identical to SEQ ID NO: 143490
  Description of Artificial Sequence: Synthetic coding sequence

SEQ ID NO: 143492 - DNA, 2133 bp, Artificial Sequence
  Description of Artificial Sequence: Synthetic coding sequence
atgtctgtgcccagcagcctgagccagagcgccatcaatgccaacagccatggaggccctgccctgagcctgcccctgcccctgcacgccgcccacaaccagctgctgaatgccaagctgcaggccacagctgtgggccccaaggacctgcggagcgccatgggagagggcggcggccctgagcccggccctgccaatgccaagtggctgaaggagggccagaaccagctgcggcgggccgccacagcccaccgggaccagaacagaaatgtgaccctgaccctggccgaggaggccagccaggagcctgagatggcccccctgggccccaagggcctcatccacctgtacagcgagctggagctgagcgcccacaatgctgccaacagaggcctgcggggccctggcctcatcatcagcacccaggagcagggcccagatgaaggagaggagaaggccgccggggaggccgaggaggaggaggaggatgatgatgatgaggaggaggaggaggacctgagcagccccccaggcctgcctgagcccctggagagcgtggaggccccaccccggccccaggccctgacagatggcccccgggagcacagcaagagcgccagcctgctgtttggcatgagaaattctgctgccagtgatgaggacagctcctgggccaccctgagccagggcagccccagctatggcagccctgaggacacagacagcttctggaaccccaatgcctttgaaacagacagcgacctgcctgctggctggatgagggtgcaggacaccagcggcacctactactggcacatccccaccggcaccacccagtgggagcccccaggccgggccagccccagccagggcagcagcccccaggaggagagccagctgacctggacaggctttgcccatggagagggctttgaagatggagagttctggaaggatgagcccagtgatgaggcccccatggagctgggcctgaaggagcctgaggagggcaccctgaccttccctgcccagagcctgagccctgagcccctgccccaggaggaggagaagctgcccccaagaaacaccaaccctggcatcaagtgctttgctgtgcgcagcctgggctgggtggagatgacagaggaggagctggcccctggccgcagctctgtggccgtgaacaactgcatccggcagctgagctaccacaagaacaacctgcatgaccccatgtctgggggctggggcgagggcaaggacctgctgctgcagctggaggatgagaccctgaagctggtggagccccagagccaggccctgctgcacgcccagcccatcatcagcatccgggtgtggggcgtgggccgggacagcggcagcaacagagactttgcctacgtggcccgggacaagctgacccagatgctgaagtgccacgtgttccgctgtgaggccccagccaagaacatcgccaccagcctgcacgagatctgcagcaagatcatggccgagaggagaaatgcccgctgcctggtgaatggcctgagcctggaccacagcaagctggtggatgtgcccttccaggtggagttccctgcccccaagaatgagctggtgcagaagttccaggtgtactacctgggcaatgtgcctgtggccaagcctgtgggcgtggatgtgatcaatggagccctggagagcgtgctgagcagcagcagccgggagcagtggacccccagccacgtgtctgtggccccagccaccctgaccatcctgcaccagcagacagaagctgtgctgggagaatgtcgggtgcgcttcctgtccttcctggccgtgggcagagatgtgcacacctttgccttcatcatggctgctggccctgccagcttctgctgccacatgttctggtgtgagcccaatgctgccagcctgtctgaggccgtgcaggccgcctgcatgctgcgctaccagaagtgcctggatgcccggagccaggccagcaccagctgcctgcctgcccccccagctgagagcgtggccaggagagtgggctggacagtgcggcggggcgtgcagagcctgtggggcagcctgaagcccaagaggctgggcgcccacaccccctag

SEQ ID NO: 143493 - DNA, 1356 bp, Artificial Sequence
  Description of Artificial Sequence: Synthetic coding sequence
atgagggtgcaggacaccagcggcacctactactggcacatccccaccggcaccacccagtgggagcccccaggccgggccagccccagccagggcagcagcccccaggaggagagccagctgacctggacaggctttgcccacggggagggctttgaagatggagagttctggaaggatgagcccagtgatgaggcccccatggagctgggcctgaaggagcctgaggagggcaccctgaccttccctgcccagagcctgagccctgagcccctgccccaggaggaggagaagctgccccccaggaacaccaaccctggcatcaagtgctttgctgtgcgcagcctgggctgggtggagatgacagaggaggagctggcccctggccgcagctctgtggccgtgaacaactgcatccggcagctgagctaccacaagaacaacctgcatgaccccatgtctgggggctggggcgagggcaaggacctgctgctgcagctggaggatgagaccctgaagctggtggagccccagagccaggccctgctgcacgcccagcccatcatcagcatccgggtgtggggcgtgggccgggacagcggcagcaacagagactttgcctacgtggcccgggacaagctgacccagatgctgaagtgccacgtgttccgctgtgaggccccagccaagaacatcgccaccagcctgcacgagatctgcagcaagatcatggccgagaggagaaatgcccgctgcctggtgaatggcctgagcctggaccacagcaagctggtggatgtgcccttccaggtggagttccctgcccccaagaatgagctggtgcagaagttccaggtgtactacctgggcaatgtgcctgtggccaagcctgtgggcgtggatgtgatcaacggggccctggagagcgtgctgagcagcagcagccgggagcagtggacccccagccacgtgtctgtggccccagccaccctgaccatcctgcaccagcagacagaggccgtgctgggggagtgccgggtgcgcttcctgtccttcctggccgtgggcagagatgtgcacacctttgccttcatcatggccgccggccctgccagcttctgctgccacatgttctggtgtgagcccaatgctgccagcctgtctgaggccgtgcaggccgcctgcatgctgcgctaccagaagtgcctggatgcccggagccaggccagcaccagctgcctgcctgcccctcctgctgagagcgtggcccggcgggtgggctggacagtgagaagaggagtgcagagcctgtggggcagcctgaagcccaagaggctgggcgcccacaccccctag

SEQ ID NO: 143494 - DNA, 1680 bp, Artificial Sequence
  Description of Artificial Sequence: Synthetic coding sequence
atgtctgtgcccagcagcctgagccagagcgccatcaatgccaacagccatggaggccctgccctgagcctgcccctgcccctgcacgccgcccacaaccagctgctgaatgccaagctgcaggccacagctgtgggccccaaggacctgcacagcaagagcgccagcctgctgtttggcatgaggaacagcgctgccagtgatgaggacagctcctgggccaccctgagccagggcagccccagctatggcagccctgaggacacagacagcttctggaaccccaatgcctttgaaacagacagcgacctgcctgctggctggatgagggtgcaggacaccagcggcacctactactggcacatccccaccggcaccacccagtgggagcccccaggccgggccagccccagccagggcagcagcccccaggaggagagccagctgacctggacaggctttgcccacggggagggctttgaagatggagagttctggaaggatgagcccagtgatgaggcccccatggagctgggcctgaaggagcctgaggagggcaccctgaccttccctgcccagagcctgagccctgagcccctgccccaggaggaggagaagctgccccccaggaacaccaaccctggcatcaagtgctttgctgtgcgcagcctgggctgggtggagatgacagaggaggagctggcccctggccgcagctctgtggccgtgaacaactgcatccggcagctgagctaccacaagaacaacctgcatgaccccatgtctgggggctggggcgagggcaaggacctgctgctgcagctggaggatgagaccctgaagctggtggagccccagagccaggccctgctgcacgcccagcccatcatcagcatccgggtgtggggcgtgggccgggacagcggcagcaacagagactttgcctacgtggcccgggacaagctgacccagatgctgaagtgccacgtgttccgctgtgaggccccagccaagaacatcgccaccagcctgcacgagatctgcagcaagatcatggccgagaggagaaatgcccgctgcctggtgaatggcctgagcctggaccacagcaagctggtggatgtgcccttccaggtggagttccctgcccccaagaatgagctggtgcagaagttccaggtgtactacctgggcaatgtgcctgtggccaagcctgtgggcgtggatgtgatcaacggggccctggagagcgtgctgagcagcagcagccgggagcagtggacccccagccacgtgtctgtggccccagccaccctgaccatcctgcaccagcagacagaggccgtgctgggggagtgccgggtgcgcttcctgtccttcctggccgtgggcagagatgtgcacacctttgccttcatcatggccgccggccctgccagcttctgctgccacatgttctggtgtgagcccaatgctgccagcctgtctgaggccgtgcaggccgcctgcatgctgcgctaccagaagtgcctggatgcccggagccaggccagcaccagctgcctgcctgcccctcctgctgagagcgtggcccggcgggtgggctggacagtgagaagaggagtgcagagcctgtggggcagcctgaagcccaagaggctgggcgcccacaccccctag

SEQ ID NO: 143495 - DNA, 1428 bp, Artificial Sequence
  Description of Artificial Sequence: Synthetic coding sequence
atgacccagatgagggacagcttctggaaccccaatgcctttgaaacagacagcgacctgcctgctggctggatgagggtgcaggacaccagcggcacctactactggcacatccccaccggcaccacccagtgggagcccccaggccgggccagccccagccagggcagcagcccccaggaggagagccagctgacctggacaggctttgcccacggggagggctttgaagatggagagttctggaaggatgagcccagtgatgaggcccccatggagctgggcctgaaggagcctgaggagggcaccctgaccttccctgcccagagcctgagccctgagcccctgccccaggaggaggagaagctgccccccaggaacaccaaccctggcatcaagtgctttgctgtgcgcagcctgggctgggtggagatgacagaggaggagctggcccctggccgcagctctgtggccgtgaacaactgcatccggcagctgagctaccacaagaacaacctgcatgaccccatgtctgggggctggggcgagggcaaggacctgctgctgcagctggaggatgagaccctgaagctggtggagccccagagccaggccctgctgcacgcccagcccatcatcagcatccgggtgtggggcgtgggccgggacagcggcagcaacagagactttgcctacgtggcccgggacaagctgacccagatgctgaagtgccacgtgttccgctgtgaggccccagccaagaacatcgccaccagcctgcacgagatctgcagcaagatcatggccgagaggagaaatgcccgctgcctggtgaatggcctgagcctggaccacagcaagctggtggatgtgcccttccaggtggagttccctgcccccaagaatgagctggtgcagaagttccaggtgtactacctgggcaatgtgcctgtggccaagcctgtgggcgtggatgtgatcaacggggccctggagagcgtgctgagcagcagcagccgggagcagtggacccccagccacgtgtctgtggccccagccaccctgaccatcctgcaccagcagacagaggccgtgctgggggagtgccgggtgcgcttcctgtccttcctggccgtgggcagagatgtgcacacctttgccttcatcatggccgccggccctgccagcttctgctgccacatgttctggtgtgagcccaatgctgccagcctgtctgaggccgtgcaggccgcctgcatgctgcgctaccagaagtgcctggatgcccggagccaggccagcaccagctgcctgcctgcccctcctgctgagagcgtggcccggcgggtgggctggacagtgagaagaggagtgcagagcctgtggggcagcctgaagcccaagaggctgggcgcccacaccccctag

SEQ ID NO: 143496 - DNA, 2277 bp, Artificial Sequence
  Description of Artificial Sequence: Synthetic coding sequence
atgtctgaggtgctgcctgctgacagcggcgtggacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagaagtatgccctgaccaacatccaggccgccatgggcctgagtgaccctgctgcccagcccctgctgggcaatggcagcgccaacatcaagctggtgaagaatggagagaaccagctgaggaaggctgctgagcagggccagcaggaccccaacaagaacctgagccccacagctgtgatcaacatcaccagcgagaagctggagggcaaggagccccacccccaggacagcagcagctgtgagatcctgcccagccagcccaggaggaccaagagcttcctgaactactatgctgacctggagaccagcgcccgggagctggagcagaacagaggcaaccaccacggcacagctgaggagaagagccagcctgtgcagggccaggccagcaccatcattggaaatggagacctgctgctgcagaagcccaaccggccccagagcagcccagaagatggccaggtggccaccgtgagcagcagccctgagaccaagaaggaccaccccaagacaggagccaagacagactgtgccctgcaccgcatccagaacctggcccccagtgatgaggagagctcctggaccaccctgagccaggacagcgccagccccagcagcccagatgaaacagacatctggagcgaccacagcttccagacagatcctgacctgcccccaggctggaagagggtgtctgacattgctggcacctactactggcacatccccaccggcaccacccagtgggagaggcctgtgtccatcccagctgacctgcagggcagcaggaagggcagcctgagctctgtgacccccagccccaccccagaaaatgagaagcagccctggagcgactttgctgtgctgaatggaggcaagatcaacagcgacatctggaaggacctgcacgccgccaccgtgaacccagaccccagcctgaaggagtttgagggcgccaccctgcgctatgccagcctgaagctgagaaatgccccccacccagatgatgatgacagctgcagcatcaacagcgaccctgaggccaagtgctttgctgtgcgcagcctgggctgggtggagatggccgaggaggacctggcccctgggaagagctctgtggccgtgaacaactgcatccggcagctgagctactgcaagaatgacatccgggacacagtgggcatctggggcgagggcaaggacatgtacctgatcctggagaatgacatgctgagcctggtggaccccatggacagatctgtgctgcacagccagcccatcgtgtccatccgggtgtggggcgtgggccgggacaatggccgggactttgcctacgtggcccgggacaaggacacccgcatcctgaagtgccacgtgttccgctgtgacaccccagccaaggccatcgccaccagcctgcacgagatctgcagcaagatcatggccgagaggaagaatgccaaggccctggcctgcagcagcctgcaggagcgggccaacgtgaacctggatgtgcccctgcaggtggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgaatgtcatgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgaccaggagagtgaccaccaacgtgaagaggggcgtgctgagcctgattgacaccctgaagcagaagaggcctgtgacagagatgccctag

SEQ ID NO: 143497 - DNA, 2274 bp, Artificial Sequence
  Description of Artificial Sequence: Synthetic coding sequence
agccactgcatcccagctgacagcggcgtggacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagaagtatgccctgaccaacatccaggccgccatgggcctgagtgaccctgctgcccagcccctgctgggcaatggaagtgccaacatcaagctggtgaagaatggagagaaccagctgaggaaggctgctgagcagggccagcaggaccccaacaagaacctgagccccacagctgtgatcaacatcaccagcgagaagctggagggcaaggagccccacccccaggacagcagcagctgtgagatcctgcccagccagcccaggaggaccaagagcttcctgaactactatgctgacctggagaccagcgcccgggagctggagcagaacagaggcaaccaccacggcacagctgaggagaagagccagcctgtgcagggccaggccagcaccatcattggaaatggagacctgctgctgcagaagcccaaccggccccagagcagcccagaagatggccaggtggccaccgtgagcagcagccctgagaccaagaaggaccaccccaagacaggagccaagacagactgtgccctgcaccgcatccagaacctggcccccagtgatgaggagagctcctggaccaccctgagccaggacagcgccagccccagcagcccagatgaaacagacatctggagcgaccacagcttccagacagatcctgacctgcccccaggctggaagagggtgtctgacattgctggcacctactactggcacatccccaccggcaccacccagtgggagaggcctgtgtccatcccagctgacctgcagggcagcaggaagggcagcctgagctctgtgacccccagccccaccccagaaaatgagaagcagccctggagcgactttgctgtgctgaatggaggcaagatcaacagcgacatctggaaggacctgcatgctgccaccgtgaacccagaccccagcctgaaggagtttgaaggagccaccctgcgctatgccagcctgaagctgagaaatgccccccacccagatgatgatgacagctgcagcatcaacagcgaccctgaggccaagtgctttgctgtgcgcagcctgggctgggtggagatggccgaggaggacctggcccctgggaagagctctgtggccgtgaacaactgcatccggcagctgagctactgcaagaatgacatccgggacacagtgggcatctggggcgagggcaaggacatgtacctgatcctggagaatgacatgctgagcctggtggaccccatggacagatctgtgctgcacagccagcccatcgtgtccatccgggtgtggggcgtgggccgggacaatggccgggactttgcctacgtggcccgggacaaggacacccgcatcctgaagtgccacgtgttccgctgtgacaccccagccaaggccatcgccaccagcctgcacgagatctgcagcaagatcatggccgagaggaagaatgccaaggccctggcctgcagcagcctgcaggagcgggccaacgtgaacctggatgtgcccctgcaggtggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgagtgccacgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgacccggcgggtgaccaccaacgtgaagaggggcgtgctgagcctgattgacaccctgaagcagaagaggcctgtgacagagatgccctag

SEQ ID NO: 143498 - DNA, 633 bp, Artificial Sequence
  Description of Artificial Sequence: Synthetic coding sequence
atggccgagaggaagaatgccaaggccctggcctgcagcagcctgcaggagcgggccaacgtgaacctggatgtgcccctgcaggtggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgaatgtcatgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgaccaggagagtgaccaccaacgtgaagaggggcgtgctgagcctgattgacaccctgaagcagaagaggcctgtgacagagatgccctag

SEQ ID NO: 143499 - DNA, 33 bp, Artificial Sequence
  Description of Artificial Sequence: Synthetic coding sequence
atgtctgaggtgctgcctgctgacagcggctag

SEQ ID NO: 143500 - DNA, 633 bp, Artificial Sequence; identical to SEQ ID NO: 143498
  Description of Artificial Sequence: Synthetic coding sequence

SEQ ID NO: 143501 - DNA, 2214 bp, Artificial Sequence
  Description of Artificial Sequence: Synthetic coding sequence
atgtctgaggtgctgcctgctgacagcggcgtggacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagaagtatgccctgaccaacatccaggccgccatgggcctgagtgaccctgctgcccagcccctgctgggcaatggcagcgccaacatcaagctggtgaagaatggagagaaccagctgaggaaggctgctgagcagggccagcaggaccccaacaagaacctgagccccacagctgtgatcaacatcaccagcgagaagctggagggcaaggagccccacccccaggacagcagcagctgtgagatcctgcccagccagcccaggaggaccaagagcttcctgaactactatgctgacctggagaccagcgcccgggagctggagcagaacagaggcaaccaccacggcacagctgaggagaagagccagcctgtgcagggccaggccagcaccatcattggaaatggagacctgctgctgcagaagcccaaccggccccagagcagcccagaagatggccaggtggccaccgtgagcagcagccctgagaccaagaaggaccaccccaagacaggagccaagacagactgtgccctgcaccgcatccagaacctggcccccagtgatgaggagagctcctggaccaccctgagccaggacagcgccagccccagcagcccagatgaaacagacatctggagcgaccacagcttccagacagatcctgacctgcccccaggctggaagagggtgtctgacattgctggcacctactactggcacatccccaccggcaccacccagtgggagaggcctgtgtccatcccagctgacctgcagggcagcaggaagggcagcctgagctctgtgacccccagccccaccccagaaaatgaagacctgcatgctgccaccgtgaacccagaccccagcctgaaggagtttgaaggagccaccctgcgctatgccagcctgaagctgagaaatgccccccacccagatgatgatgacagctgcagcatcaacagcgaccctgaggccaagtgctttgctgtgcgcagcctgggctgggtggagatggccgaggaggacctggcccctgggaagagctctgtggccgtgaacaactgcatccggcagctgagctactgcaagaatgacatccgggacacagtgggcatctggggcgagggcaaggacatgtacctgatcctggagaatgacatgctgagcctggtggaccccatggacagatctgtgctgcacagccagcccatcgtgtccatccgggtgtggggcgtgggccgggacaatggccgggactttgcctacgtggcccgggacaaggacacccgcatcctgaagtgccacgtgttccgctgtgacaccccagccaaggccatcgccaccagcctgcacgagatctgcagcaagatcatggccgagaggaagaatgccaaggccctggcctgcagcagcctgcaggagcgggccaacgtgaacctggatgtgcccctgcaggtggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgagtgccacgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgacccggcgggtgaccaccaacgtgaagaggggcgtgctgagcctgattgacaccctgaagcagaagaggcctgtgacagagatgccctag

SEQ ID NO: 143502 - DNA, 2280 bp, Artificial Sequence
  Description of Artificial Sequence: Synthetic coding sequence
atgtctgaggtgctgcctgctgacagcggcgtggacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagaagtatgccctgaccaacatccaggccgccatgggcctgagtgaccctgctgcccagcccctgctgggcaatggcagcgccaacatcaagctggtgaagaatggagagaaccagctgaggaaggctgctgagcagggccagcaggaccccaacaagaacctgagccccacagctgtgatcaacatcaccagcgagaagctggagggcaaggagccccacccccaggacagcagcagctgtgagatcctgcccagccagcccaggaggaccaagagcttcctgaactactatgctgacctggagaccagcgcccgggagctggagcagaacagaggcaaccaccacggcacagctgaggagaagagccagcctgtgcagggccaggccagcaccatcattggaaatggagacctgctgctgcagaagcccaaccggccccagagcagcccagaagatggccaggtggccaccgtgagcagcagccctgagaccaagaaggaccaccccaagacaggagccaagacagactgtgccctgcaccgcatccagaacctggcccccagtgatgaggagagctcctggaccaccctgagccaggacagcgccagccccagcagcccagatgaaacagctgacatctggagcgaccacagcttccagacagatcctgacctgcccccaggctggaagagggtgtctgacattgctggcacctactactggcacatccccaccggcaccacccagtgggagaggcctgtgtccatcccagctgacctgcagggcagcaggaagggcagcctgagctctgtgacccccagccccaccccagaaaatgagaagcagccctggagcgactttgctgtgctgaatggaggcaagatcaacagcgacatctggaaggacctgcatgctgccaccgtgaacccagaccccagcctgaaggagtttgaaggagccaccctgcgctatgccagcctgaagctgagaaatgccccccacccagatgatgatgacagctgcagcatcaacagcgaccctgaggccaagtgctttgctgtgcgcagcctgggctgggtggagatggccgaggaggacctggcccctgggaagagctctgtggccgtgaacaactgcatccggcagctgagctactgcaagaatgacatccgggacacagtgggcatctggggcgagggcaaggacatgtacctgatcctggagaatgacatgctgagcctggtggaccccatggacagatctgtgctgcacagccagcccatcgtgtccatccgggtgtggggcgtgggccgggacaatggccgggactttgcctacgtggcccgggacaaggacacccgcatcctgaagtgccacgtgttccgctgtgacaccccagccaaggccatcgccaccagcctgcacgagatctgcagcaagatcatggccgagaggaagaatgccaaggccctggcctgcagcagcctgcaggagcgggccaacgtgaacctggatgtgcccctgcaggtggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgagtgccacgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgacccggcgggtgaccaccaacgtgaagaggggcgtgctgagcctgattgacaccctgaagcagaagaggcctgtgacagagatgccctag

SEQ ID NO: 143503 - DNA, 84 bp, Artificial Sequence
  Description of Artificial Sequence: Synthetic coding sequence
atgtctgaggtgctgcctgctgacagcggcgtggacaccctggccgtgttcatggccagcagcggcaccacagatgtgacctag

SEQ ID NO: 143504 - DNA, 207 bp, Artificial Sequence
  Description of Artificial Sequence: Synthetic coding sequence
atgtctgaggtgctgcctgctgacagcggcgtggacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagtag

SEQ ID NO: 143505 - DNA, 2211 bp, Artificial Sequence
  Description of Artificial Sequence: Synthetic coding sequence
atgtctgaggtgctgcctgctgacagcggcgtggacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagaagtatgccctgaccaacatccaggccgccatgggcctgagtgaccctgctgcccagcccctgctgggcaatggcagcgccaacatcaagctggtgaagaatggagagaaccagctgaggaaggctgctgagcagggccagcaggaccccaacaagaacctgagccccacagctgtgatcaacatcaccagcgagaagctggagggcaaggagccccacccccaggacagcagcagctgtgagatcctgcccagccagcccaggaggaccaagagcttcctgaactactatgctgacctggagaccagcgcccgggagctggagcagaacagaggcaaccaccacggcacagctgaggagaagagccagcctgtgcagggccaggccagcaccatcattggaaatggagacctgctgctgcagaagcccaaccggccccagagcagcccagaagatggccaggtggccaccgtgagcagcagccctgagaccaagaaggaccaccccaagacaggagccaagacagactgtgccctgcaccgcatccagaacctggcccccagtgatgaggagagctcctggaccaccctgagccaggacagcgccagccccagcagcccagatgaaacagacatctggagcgaccacagcttccagacagatcctgacctgcccccaggctggaagagggtgtctgacattgctggcacctactactggcacatccccaccggcaccacccagtgggagaggcctgtgtccatcccagctgacctgcagggcagcaggaagggcagcctgagctctgtgacccccagccccaccccagaaaatgaagacctgcatgctgccaccgtgaacccagaccccagcctgaaggagtttgaaggagccaccctgcgctatgccagcctgaagctgagaaatgccccccacccagatgatgatgacagctgcagcatcaacagcgaccctgaggccaagtgctttgctgtgcgcagcctgggctgggtggagatggccgaggaggacctggcccctgggaagagctctgtggccgtgaacaactgcatccggcagctgagctactgcaagaatgacatccgggacacagtgggcatctggggcgagggcaaggacatgtacctgatcctggagaatgacatgctgagcctggtggaccccatggacagatctgtgctgcacagccagcccatcgtgtccatccgggtgtggggcgtgggccgggacaatggccgggactttgcctacgtggcccgggacaaggacacccgcatcctgaagtgccacgtgttccgctgtgacaccccagccaaggccatcgccaccagcctgcacgagatctgcagcaagatcatggccgagaggaagaatgccaaggccctggcctgcagcagcctgcaggagcgggccaacgtgaacctggatgtgcccctgcaggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgaatgtcatgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgaccaggagagtgaccaccaacgtgaagaggggcgtgctgagcctgattgacaccctgaagcagaagaggcctgtgacagagatgccctag

SEQ ID NO: 143506 - DNA, 2187 bp, Artificial Sequence
  Description of Artificial Sequence: Synthetic coding sequence
tgagacaccctggccgtgttcatggccagcagcggcaccacagatgtgaccaacagaaacagccctgccaccccacccaacaccctgaacctgcggagcagccacaatgagctgctgaatgctgagatcaagcacacagagaccaagaacagcaccccacccaagtgcaggaagaagtatgccctgaccaacatccaggccgccatgggcctgagtgaccctgctgcccagcccctgctgggcaatggcagcgccaacatcaagctggtgaagaatggagagaaccagctgaggaaggctgctgagcagggccagcaggaccccaacaagaacctgagccccacagctgtgatcaacatcaccagcgagaagctggagggcaaggagccccacccccaggacagcagcagctgtgagatcctgcccagccagcccaggaggaccaagagcttcctgaactactatgctgacctggagaccagcgcccgggagctggagcagaacagaggcaaccaccacggcacagctgaggagaagagccagcctgtgcagggccaggccagcaccatcattggaaatggagacctgctgctgcagaagcccaaccggccccagagcagcccagaagatggccaggtggccaccgtgagcagcagccctgagaccaagaaggaccaccccaagacaggagccaagacagactgtgccctgcaccgcatccagaacctggcccccagtgatgaggagagctcctggaccaccctgagccaggacagcgccagccccagcagcccagatgaaacagctgacatctggagcgaccacagcttccagacagatcctgacctgcccccaggctggaagagggtgtctgacattgctggcacctactactggcacatccccaccggcaccacccagtgggagaggcctgtgtccatcccagctgacctgcagggcagcaggaagggcagcctgagctctgtgacccccagccccaccccagaaaatgaagacctgcacgccgccaccgtgaacccagaccccagcctgaaggagtttgagggcgccaccctgcgctatgccagcctgaagctgagaaatgccccccacccagatgatgatgacagctgcagcatcaacagcgaccctgaggccaagtgctttgctgtgcgcagcctgggctgggtggagatggccgaggaggacctggcccctgggaagagctctgtggccgtgaacaactgcatccggcagctgagctactgcaagaatgacatccgggacacagtgggcatctggggcgagggcaaggacatgtacctgatcctggagaatgacatgctgagcctggtggaccccatggacagatctgtgctgcacagccagcccatcgtgtccatccgggtgtggggcgtgggccgggacaatggccgggactttgcctacgtggcccgggacaaggacacccgcatcctgaagtgccacgtgttccgctgtgacaccccagccaaggccatcgccaccagcctgcacgagatctgcagcaagatcatggccgagaggaagaatgccaaggccctggcctgcagcagcctgcaggagcgggccaacgtgaacctggatgtgcccctgcaggtggacttccccacccccaagacagagctggtgcagaagttccacgtgcagtacctgggcatgctgcctgtggacaagcctgtgggcatggacatcctgaacagcgccatcgagaacctgatgaccagcagcaacaaggaggactggctgtctgtgaacatgaatgtggctgatgccaccgtgaccgtcatcagcgagaagaatgaggaggaggtgctggtggagtgccgggtgcgcttcctgtccttcatgggcgtgggcaaggatgtgcacacctttgccttcatcatggacaccggcaaccagagatttgaatgtcatgtgttctggtgtgagcccaatgctggaaatgtgtctgaggccgtgcaggccgcctgcatgctgcgctaccagaagtgcctggtggcccggccccccagccagaaggtgcggcccccacctcctcctgctgacagcgtgaccaggagagtgaccaccaacgtgaagaggggcgtgctgagcctgattgacaccctgaagcagaagaggcctgtgacagagatgccctag

SEQ ID NO: 143507 - DNA, 633 bp, Artificial Sequence; identical to SEQ ID NO: 143498
  Description of Artificial Sequence: Synthetic coding sequence

SEQ ID NO: 143508 - DNA, 1476 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggtgcacatccgggtgtggggcgtgggcagcagcaagggccggcccatcagcgccccagcccgggactttgcctttgtggccagtgacaaggacagctgcatgctgaagtgccacgtgttctgctgtgatgtgcctgccaaggccatcgccagcgccctgcacggcctgtgtgcccagatcctgtctgagcgggtggaggtgtctggagatgccagctgctgcagcccagaccccatcagccctgaggacctgccccggcaggtggagctgctggatgctgtgtcccaggccgcccagaagtatgaggccctgtacatgggcaccctgcctgtgaccaaggccatgggcatggatgtgctgaatgaggccatcggcaccctgacagcccggggggacagaaatgcctgggtgcccaccatgctgtctgtgtctgacagcctgatgacagcccaccccatccaggccgaggccagcacagaggaggagcccctgtggcagtgccctgtgcggctggtgaccttcatcggcgtgggccgggacccccacaccttcggcctgattgctgacctgggccggcagagcttccagtgtgccgccttctggtgccagccccatgctgggggcctgtctgaggccgtgcaggccgcctgcatggtgcagtaccagaagtgcctggtggccagcgctgcccggggcaaggcctggggcgcccaggcccgggcccggctgcggctgaagaggaccagctccatggacagccctgggggccccctgcccctgcccctgctgaagggcggcgtgggcggggccggggccacccccaggaagaggggcgtcttctccttcctggatgccttccggctgaagcccagcctgctgcacatgccctag

SEQ ID NO: 143509 - DNA, 1461 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggtgcacatccgggtgtggggcgtgggcagcagcaagggccgggaccgggactttgcctttgtggccagtgacaaggacagctgcatgctgaagtgccacgtgttctgctgtgatgtgcctgccaaggccatcgccagcgccctgcacggcctgtgtgcccagatcctgtctgagcgggtggaggtgtctggagatgccagctgctgcagcccagaccccatcagccctgaggacctgccccggcaggtggagctgctggatgctgtgtcccaggccgcccagaagtatgaggccctgtacatgggcaccctgcctgtgaccaaggccatgggcatggatgtgctgaatgaggccatcggcaccctgacagcccggggggacagaaatgcctgggtgcccaccatgctgtctgtgtctgacagcctgatgacagcccaccccatccaggccgaggccagcacagaggaggagcccctgtggcagtgccctgtgcggctggtgaccttcatcggcgtgggccgggacccccacaccttcggcctgattgctgacctgggccggcagagcttccagtgtgccgccttctggtgccagccccacgccggcggcctgtctgaggccgtgcaggccgcctgcatggtgcagtaccagaagtgcctggtggccagcgctgcccggggcaaggcctggggcgcccaggcccgggcccggctgcggctgaagaggaccagctccatggacagccctgggggccccctgcccctgcccctgctgaagggcggcgtgggcggggccggggccacccccaggaagaggggcgtcttctccttcctggatgccttccggctgaagcccagcctgctgcacatgccctag

SEQ ID NO: 143510 - DNA, 1020 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggtgcacatccgggtgtggggcgtgggcagcagcaagggccgggaccgggactttgcctttgtggccagtgacaaggacagctgcatgctgaagtgccacgtgttctgctgtgatgtgcctgccaaggccatcgccagcgccctgcacggcctgtgtgcccagatcctgtctgagcgggtggaggtgtctggagatgccagctgctgcagcccagaccccatcagccctgaggacctgccccggcaggtggagctgctggatgctgtgtcccaggccgcccagaagtatgaggccctgtacatgggcaccctgcctgtgaccaaggccatgggccggggccagtaccggggcggggccatcgtggccgtgccctgtgccccctgtgacatctactggtgctggccccggcccacccacctgtggccccacaggtag

SEQ ID NO: 143511 - DNA, 1455 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggtgcacatccgggtgtggggcgtgggcagcagcaagggccgggactttgcctttgtggccagtgacaaggacagctgcatgctgaagtgccacgtgttctgctgtgatgtgcctgccaaggccatcgccagcgccctgcacggcctgtgtgcccagatcctgtctgagcgggtggaggtgtctggagatgccagctgctgcagcccagaccccatcagccctgaggacctgccccggcaggtggagctgctggatgctgtgtcccaggccgcccagaagtatgaggccctgtacatgggcaccctgcctgtgaccaaggccatgggcatggatgtgctgaatgaggccatcggcaccctgacagcccggggggacagaaatgcctgggtgcccaccatgctgtctgtgtctgacagcctgatgacagcccaccccatccaggccgaggccagcacagaggaggagcccctgtggcagtgccctgtgcggctggtgaccttcatcggcgtgggccgggacccccacaccttcggcctgattgctgacctgggccggcagagcttccagtgtgccgccttctggtgccagccccacgccggcggcctgtctgaggccgtgcaggccgcctgcatggtgcagtaccagaagtgcctggtggccagcgctgcccggggcaaggcctggggcgcccaggcccgggcccggctgcggctgaagaggaccagctccatggacagccctgggggccccctgcccctgcccctgctgaagggcggcgtgggcggggccggggccacccccaggaagaggggcgtcttctccttcctggatgccttccggctgaagcccagcctgctgcacatgccctag

SEQ ID NO: 143512 - DNA, 738 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggtgcacatccgggtgtggggcgtgggcagcagcaagggccgcagcagtgatgtggaccccggcctgctgcccctgcccggccctgccctggtgggggagggcggccccagcagcgctggcaccgtgtggggcgagagcgagcggctgggctag

SEQ ID NO: 143513 - DNA, 792 bp, Artificial Sequence
  Description of Artificial Sequence: Synthetic coding sequence
atgctgaagtgccacgtgttctgctgtgatgtgcctgccaaggccatcgccagcgccctgcacggcctgtgtgcccagatcctgtctgagcgggtggaggtgtctggagatgccagctgctgcagcccagaccccatcagccctgaggacctgccccggcaggtggagctgctggatgctgtgtcccaggccgcccagaagtatgaggccctgtacatgggcaccctgcctgtgaccaaggccatgggcatggatgtgctgaatgaggccatcggcaccctgacagcccggggggacagaaatgcctgggtgcccaccatgctgtctgtgtctgacagcctgatgacagcccaccccatccaggccgaggccagcacagaggaggagcccctgtggcagtgccctgtgcggctggtgaccttcatcggcgtgggccgggacccccacaccttcggcctgattgctgacctgggccggcagagcttccagtgtgccgccttctggtgccagccccatgctgggggcctgtctgaggccgtgcaggccgcctgcatggtgcagtaccagaagtgcctggtggccagcgctgcccggggcaaggcctggggcgcccaggcccgggcccggctgcggctgaagaggaccagctccatggacagccctgggggccccctgcccctgcccctgctgaagggcggcgtgggcggggccggggccacccccaggaagaggggcgtcttctccttcctggatgccttccggctgaagcccagcctgctgcacatgccctag

SEQ ID NO: 143514 - DNA, 645 bp, Artificial Sequence
  Description of Artificial Sequence: Synthetic coding sequence
atgctgggcaaggactacatgctggccatcatcctggtgaactgtgatgatgacctgtggggagaccacagcctggaggtggaggccggcctgcccccaggctggaggaagatccatgatgctgctggcacctactactggcacgtgcccagcggcagcacccagtggcagaggcccacctgggagctgggagatgctgaagatcctggcactggaacagagggcatctggggcctgcggccccccaagggccgctccttcagcagcctggagagcagcctggacaggagcaacagcctgtcctggtatggaggagagagctacatccagagcatggagcccggggccaagtgctttgctgtgcgcagcctgggctgggtggaggtgcctgaggaggacctggcccctgggaagagcagcattgctgtgaacaactgcatccagcagctggcccagaccaggagccgcagccagcccccagatggagcctggggcgagggccagaacatgctgatgatcctgaagaaggatgccatgagcctggtgaaccccctggaccacagcctcatccactgccagcccctggccgtcatccccacagatgctgacccccagtacctgaacccctggacccagatcctgtag

SEQ ID NO: 143515 - DNA, 378 bp, Artificial Sequence
  Description of Artificial Sequence: Synthetic coding sequence
atggagccagatggcacctatgagcccggctttgtgggcatccgcttctgccaggagtgcaacaacatgctgtaccccaaggaggacaaggaaaatcgcatcctgctgtatgcctgcaggaactgtgactaccagcaggaggccgacaacagctgcatctacgtgaacaagatcacccatgaggtggatgagctgacccagatcatcgcagatgtgtcccaggaccccaccctgcccaggacagaggaccacccctgccagaagtgtggccacaaggaggccgtgttcttccagagccacagcgcccgggcagaagatgccatgaggctgtactacgtgtgcacagccccccactgcggccaccgctggacagaatag

SEQ ID NO: 143516 - DNA, 1836 bp, Artificial Sequence
  Description of Artificial Sequence: Synthetic coding sequence
atgctggccagcctggagaaggacaagacagcccctggcagcgcccaggtggccggcctgtgtggccgcctgaccctgcaccgggacctgaggacaggccgctgggagccagacccccagaggagccgccgctgcctgcgggacccccagagggtgctggagtactgccggcagatgtacccagagctgcagatcgcccgggtggagcaggccacccaggccatccccatggagcgctggtgtggcggcagccgcagcggcagctgtgcccacccccaccaccaggtggtgcccttccgctgcctgcctggagaatttgtgtctgaggccctgctggtgcctgagggctgccgcttcctgcaccaggagaggatggaccagtgtgagagcagcaccaggaggcaccaggaggcccaggaggcctgcagcagccagggcctcatcctgcacggcagcggcatgctgctgccctgtggcagtgaccgcttccggggcgtggagtatgtgtgctgccccccacctggcaccccagaccccagcggcacagctgtgggggaccccagcaccaggtcctggcccccaggcagccgggtggagggcgcagaagatgaggaggaggaggagagcttcccccagcctgtggatgactactttgtggagcccccccaggccgaggaggaggaggagaccgtgcccccacccagcagccacaccctggccgtggtgggcaaggtgacccccaccccccggcccacagatggagtggacatctacttcggcatgcctggagagatcagcgagcacgagggcttcctgcgggccaagatggacctggaggagaggaggatgaggcagatcaatgaggtgatgagggagtgggccatggctgacaaccagagcaagaacctgcccaaggctgaccggcaggccctgaatgagcacttccagagcatcctgcagaccctggaggagcaggtgtctggagagcggcagaggctggtggagacccacgccaccagggtcatcgccctgatcaatgaccagaggagagctgccctggagggcttcctggccgccctgcaggccgaccccccccaggccgagcgggtgctgctggccctgcggcgctacctgcgggcagagcagaaggagcagaggcacaccctgcggcactaccagcacgtggccgctgtggaccctgagaaggcccagcagatgaggttccaggtgcacacccacctgcaggtgattgaggagcgggtgaaccagagcctgggcctgctggaccagaacccccacctggcccaggagctgcggccccagatccaggagctgctgcacagcgagcacctgggccccagcgagctggaggccccagcccctgggggcagcagcgaggacaagggcggcctgcagcccccagacagcaaggatgacacccccatgaccctgcccaagggcagcacagagcaggatgctgccagccctgagaaggagaagatgaaccccctggagcagtatgaaaggaaggtgaatgcctctgtgccccggggcttccccttccacagcagcgagatccagagagatgagctggccccagctggcaccggggtgtcccgggaggccgtgtctggcctgctgatcatgggcgccggcggcggcagcctgattgtgctgtccatgctgctgctgcggaggaagaagccctacggggccatcagccatggagtggtggaggtggaccccatgctgaccctggaggagcagcagctgcgggagctgcagagacatggctatgagaaccccacctaccgcttcctggaggagcggccctag

SEQ ID NO: 143517 - DNA, 2292 bp, Artificial Sequence
  Description of Artificial Sequence: Synthetic coding sequence
atggccgccaccggcacagctgctgctgctgccaccggccgcctgctgctgctgctgctggtgggcctgacagccccagccctggccctggccggctacatcgaggccctggccgccaatgccggcactggatttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacgtgatggaggccaaccagagggtgtccattgacaactggtgcagaagagacaagaagcagtgcaagagcagatttgtgacccccttcaagtgcctggtgggggagtttgtgtctgatgtgctgctggtgcctgagaagtgccagttcttccacaaggagaggatggaggtgtgtgagaaccaccagcactggcacacagtggtgaaggaggcctgcctgacccagggcatgaccctgtacagctatggcatgctgctgccctgtggggtggaccagttccacggcacagaatatgtgtgctgcccccagaccaagatcatcggctctgtgtccaaggaggaggaggaggaggatgaggaggaggaggaggaggaggatgaggaggaggactatgatgtgtacaagtctgagttccccacagaggccgacctggaggacttcacagaggccgctgtggatgaagatgatgaagatgaggaggagggggaggaggtggtggaggaccgggactactactatgacaccttcaagggagatgactacaatgaggagaaccccacagagcccggcagtgatggcaccatgtctgacaaggagatcacccatgatgtgaaggctgtgtgcagccaggaggccatgacaggcccctgcagagctgtgatgccccgctggtactttgacctgagcaagggcaaatgtgtgcgcttcatctacggcggctgcggcggcaacagaaacaactttgaaagtgaggactactgcatggctgtgtgcaaggccatgatcccccccacccccctgcccaccaatgatgtggatgtgtactttgagaccagcgcagatgacaatgaacatgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgagcagcgaggagagcgaggagatcccccccttccaccccttccaccccttccctgccctgcctgaaaatgaagacacccagcctgagctgtaccaccccatgaagaagggcagcggcgtgggggagcaggacggcggcctcatcggggctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtgattgtcatcagcctggtgatgctgaggaagaggcagtatggcaccatcagccacggcatcgtggaggtggaccccatgctgaccccagaggagcggcacctgaacaagatgcagaaccacggctatgagaaccccacctacaagtacctggagcagatgcagatctag

SEQ ID NO: 143518 - DNA, 2286 bp, Artificial Sequence
  Description of Artificial Sequence: Synthetic coding sequence
atgctgcgggcccctggagagctgccccggcaggccgcccgctgcagcctgtgccgcctgggccctggccggggccgggccttcttcaagtggcgctgcctgcctgcctctgtggaccggggcaaccccctgtgggccctggccgccaatgccggcactggatttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacgtgatggaggccaaccagagggtgtccattgacaactggtgcagaagagacaagaagcagtgcaagagcagatttgtgacccccttcaagtgcctggtgggggagtttgtgtctgatgtgctgctggtgcctgagaagtgccagttcttccacaaggagaggatggaggtgtgtgagaaccaccagcactggcacacagtggtgaaggaggcctgcctgacccagggcatgaccctgtacagctatggcatgctgctgccctgtggggtggaccagttccacggcacagaatatgtgtgctgcccccagaccaagatcatcggctctgtgtccaaggaggaggaggaggaggatgaggaggaggaggaggaggaggatgaggaggaggactatgatgtgtacaagtctgagttccccacagaggccgacctggaggacttcacagaggccgctgtggatgaagatgatgaagatgaggaggagggggaggaggtggtggaggaccgggactactactatgacaccttcaagggagatgactacaatgaggagaaccccacagagcccggcagtgatggcaccatgtctgacaaggagatcacccatgatgtgaaggctgtgtgcagccaggaggccatgacaggcccctgcagagctgtgatgccccgctggtactttgacctgagcaagggcaaatgtgtgcgcttcatctacggcggctgcggcggcaacagaaacaactttgaaagtgaggactactgcatggctgtgtgcaaggccatgatcccccccacccccctgcccaccaatgatgtggatgtgtactttgagaccagcgcagatgacaatgaacatgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgagcagcgaggagagcgaggagatcccccccttccaccccttccaccccttccctgccctgcctgaaaatgaaggcagcggcgtgggggagcaggacggcggcctcatcggggctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtgattgtcatcagcctggtgatgctgaggaagaggcagtatggcaccatcagccacggcatcgtggaggtggaccccatgctgaccccagaggagcggcacctgaacaagatgcagaaccacggctatgagaaccccacctacaagtacctggagcagatgcagatctag

SEQ ID NO: 143519 - DNA, 2256 bp, Artificial Sequence
  Description of Artificial Sequence: Synthetic coding sequence
atggccgccaccggcacagctgctgctgctgccaccggccgcctgctgctgctgctgctggtgggcctgacagccccagccctggccctggccggctacatcgaggccctggccgccaatgccggcactggatttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacgtgatggaggccaaccagagggtgtccattgacaactggtgcagaagagacaagaagcagtgcaagagcagatttgtgacccccttcaagtgcctggtgggggagtttgtgtctgatgtgctgctggtgcctgagaagtgccagttcttccacaaggagaggatggaggtgtgtgagaaccaccagcactggcacacagtggtgaaggaggcctgcctgacccagggcatgaccctgtacagctatggcatgctgctgccctgtggggtggaccagttccacggcacagaatatgtgtgctgcccccagaccaagatcatcggctctgtgtccaaggaggaggaggaggaggatgaggaggaggaggaggaggaggatgaggaggaggactatgatgtgtacaagtctgagttccccacagaggccgacctggaggacttcacagaggccgctgtggatgaagatgatgaagatgaggaggagggggaggaggtggtggaggaccgggactactactatgacaccttcaagggagatgactacaatgaggagaaccccacagagcccggcagtgatggcaccatgtctgacaaggagatcacccatgatgtgaaggctgtgtgcagccaggaggccatgacaggcccctgcagagctgtgatgccccgctggtactttgacctgagcaagggcaaatgtgtgcgcttcatctacggcggctgcggcggcaacagaaacaactttgaaagtgaggactactgcatggctgtgtgcaaggccatgatcccccccacccccctgcccaccaatgatgtggatgtgtactttgagaccagcgcagatgacaatgaacatgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgagcagcgaggagagcgaggagatcccccccttccaccccttccaccccttccctgccctgcctgaaaatgaaggcagcggcgtgggggagcaggacggcggcctcatcggggctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtgattgtcatcagcctggtgatgctgaggaagaggcagtatggcaccatcagccacggcatcgtggaggtggaccccatgctgaccccagaggagcggcacctgaacaagatgcagaaccacggctatgagaaccccacctacaagtacctggagcagatgcagatctag

SEQ ID NO: 143520 - DNA, 1569 bp, Artificial Sequence
  Description of Artificial Sequence: Synthetic coding sequence
atggccgccaccggcacagctgctgctgctgccaccggccgcctgctgctgctgctgctggtgggcctgacagccccagccctggccctggccggctacatcgaggccctggccgccaatgccggcactggatttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacgtgatggaggccaaccagagggtgtccattgacaactggtgcagaagagacaagaagcagtgcaagagcagatttgtgacccccttcaagtgcctggtgccccccacccccctgcccaccaatgatgtggatgtgtactttgagaccagcgcagatgacaatgagcacgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgtcctctgaggagagcgaggagatcccccccttccaccccttccaccccttccctgccctgcctgaaaatgaaggcagcggcgtgggggagcaggacggcggcctgattggagctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtcatcgtcatcagcctggtgatgctgaggaagaggcagtatggcaccatcagccatggaattgtggaggtggaccccatgctgaccccagaggagcggcacctgaacaagatgcagaaccacggctatgagaaccccacctacaagtacctggagcagatgcagatctag

SEQ ID NO: 143521 - DNA, 2088 bp, Artificial Sequence
  Description of Artificial Sequence: Synthetic coding sequence
atggccgccaccggcacagctgctgctgctgccaccggccgcctgctgctgctgctgctggtgggcctgacagccccagccctggccctggccggctacatcgaggccctggccgccaatgccggcactggatttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacgtgatggaggccaaccagagggtgtccattgacaactggtgcagaagagacaagaagcagtgcaagagcagatttgtgacccccttcaagtgcctggtgggggagtttgtgtctgatgtgctgctggtgcctgagaagtgccagttcttccacaaggagaggatggaggtgtgtgagaaccaccagcactggcacacagtggtgaaggaggcctgcctgacccagggcatgaccctgtacagctatggcatgctgctgccctgtggggtggaccagttccacggcacagaatatgtgtgctgcccccagaccaagatcatcggctctgtgtccaaggaggaggaggaggaggatgaggaggaggaggaggaggaggatgaggaggaggactatgatgtgtacaagtctgagttccccacagaggccgacctggaggacttcacagaggccgctgtggatgaagatgatgaagatgaggaggagggggaggaggtggtggaggaccgggactactactatgacaccttcaagggagatgactacaatgaggagaaccccacagagcccggcagtgatggcaccatgtctgacaaggagatcacccatgatgtgaaggtgccccccacccccctgcccaccaatgatgtggatgtgtactttgagaccagcgcagatgacaatgaacatgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgagcagcgaggagagcgaggagatcccccccttccaccccttccaccccttccctgccctgcctgaaaatgaaggcagcggcgtgggggagcaggacggcggcctcatcggggctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtgattgtcatcagcctggtgatgctgaggaagaggcagtatggcaccatcagccacggcatcgtggaggtggaccccatgctgaccccagaggagcggcacctgaacaagatgcagaaccacggctatgagaaccccacctacaagtacctggagcagatgcagatctag

SEQ ID NO: 143522 - DNA, 480 bp, Artificial Sequence
  Description of Artificial Sequence: Synthetic coding sequence
atggccgccaccggcacagctgctgctgctgccaccggccgcctgctgctgctgctgctggtgggcctgacagccccagccctggccctggccggctacatcgagagcagccagatctgctgcagccccaggagcttcctgatcagcaccctgaagtgcctgattgtggatgagatcaatgccctggccgccaatgccggcaccggctttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacgtgatggaggccaaccagagggtgtccattgacaactggtgccggcgggacaagaagcagtgcaagagcagatttgtgacccccttcaagtgcctgtag

SEQ ID NO: 143523 - DNA, 351 bp, Artificial Sequence
  Description of Artificial Sequence: Synthetic coding sequence
atggccgccaccggcacagctgctgctgctgccaccggccgcctgctgctgctgctgctggtgggcctgacagccccagccctggccctggccggctacatcgaggccctggccgccaatgccggcactggatttgctgtggccgagccccagatcgccatgttctgtgggaagctgaacatgcacgtgaacatccagacaggcaagtgggagccagaccccaccggcaccaagagctgctttgagaccaaggaggaggtgctgcagtactgccaggagatgtacccagagctgcagatcaccaacagcggctggaggtgtgtgcgcatcaccagcacaggcaccaggtag

SEQ ID NO: 143524 - DNA, 1656 bp, Artificial Sequence
  Description of Artificial Sequence: Synthetic coding sequence
atggaggtgtgtgagaaccaccagcactggcacacagtggtgaaggaggcctgcctgacccagggcatgaccctgtacagctatggcatgctgctgccctgtggggtggaccagttccacggcacagaatatgtgtgctgcccccagaccaagatcatcggctctgtgtccaaggaggaggaggaggaggatgaggaggaggaggaggaggaggatgaggaggaggactatgatgtgtacaagtctgagttccccacagaggccgacctggaggacttcacagaggccgctgtggatgaagatgatgaagatgaggaggagggggaggaggtggtggaggaccgggactactactatgacaccttcaagggagatgactacaatgaggagaaccccacagagcccggcagtgatggcaccatgtctgacaaggagatcacccatgatgtgaaggtgccccccacccccctgcccaccaatgatgtggatgtgtactttgagaccagcgcagatgacaatgaacatgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgagcagcgaggagagcgaggagatcccccccttccaccccttccaccccttccctgccctgcctgaaaatgaagacacccagcctgagctgtaccaccccatgaagaagggcagcggcgtgggggagcaggacggcggcctcatcggggctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtgattgtcatcagcctggtgatgctgaggaagaggcagtatggcaccatcagccacggcatcgtggaggtggaccccatgctgaccccagaggagcggcacctgaacaagatgcagaaccacggctatgagaaccccacctacaagtacctggagcagatgcagatctag

SEQ ID NO: 143525 - DNA, 1977 bp, Artificial Sequence
  Description of Artificial Sequence: Synthetic coding sequence
atgtacccagagctgcagatcaccaacgtgatggaggccaaccagagggtgtccattgacaactggtgccggcgggacaagaagcagtgcaagagcagatttgtgacccccttcaagtgcctggtgggggagtttgtgtctgatgtgctgctggtgcctgagaagtgccagttcttccacaaggagaggatggaggtgtgtgagaaccaccagcactggcacacagtggtgaaggaggcctgcctgacccagggcatgaccctgtacagctatggcatgctgctgccctgtggggtggaccagttccatggaacagaatatgtgtgctgcccccagaccaagatcatcggctctgtgtccaaggaggaggaggaggaggatgaggaggaggaggaggaggaggatgaggaggaggactatgatgtgtacaagtctgagttccccacagaagctgacctggaggacttcacagaagctgctgtggatgaagatgatgaagatgaggaggagggggaggaggtggtggaggaccgggactactactatgacaccttcaagggagatgactacaatgaggagaaccccacagagcccggcagtgatggcaccatgtctgacaaggagatcacccatgatgtgaaggctgtgtgcagccaggaggccatgacaggcccctgcagagctgtgatgccccgctggtactttgacctgagcaaaggaaaatgtgtgcgcttcatctatggaggctgcggcggcaacagaaacaactttgaaagtgaggactactgcatggctgtgtgcaaggccatgatcccccccacccccctgcccaccaatgatgtggatgtgtactttgagaccagcgcagatgacaatgagcacgcccgcttccagaaggccaaggagcagctggagatccgccacaggaacaggatggacagagtgaagaaggagtgggaggaggccgagctgcaggccaagaacctgcccaaggccgagcggcagaccctcatccagcacttccaggccatggtgaaggccctggagaaggaggccgccagcgagaagcagcagctggtggagacccacctggcccgggtggaggccatgctgaatgacagaagaaggatggccctggagaactacctggccgccctgcagagcgaccccccccggccccaccgcatcctgcaggccctgcggcgctacgtgcgggcagagaacaaggaccggctgcacaccatccgccactaccagcacgtgctggccgtggaccctgagaaggccgcccagatgaagagccaggtgatgacccacctgcacgtgattgaggagaggaggaaccagagcctgagcctgctgtacaaggtgccctacgtggcccaggagatccaggaggagattgatgagctgctgcaggagcagagagctgacatggaccagttcaccgccagcatcagcgagacccctgtggatgtgcgggtgtcctctgaggagagcgaggagatcccccccttccaccccttccaccccttccctgccctgcctgaaaatgaaggcagcggcgtgggggagcaggacggcggcctgattggagctgaggagaaggtgatcaacagcaagaacaaggtggatgagaacatggtgattgatgagaccctggatgtgaaggagatgatcttcaatgctgagcgggtgggcggcctggaggaggagcgggagagcgtgggccccctgcgggaggacttcagcctgagcagcagcgccctgattggcctgctggtgattgctgtggccatcgccaccgtcatcgtcatcagcctggtgatgctgaggaagaggcagtatggcaccatcagccatggaattgtggaggtggaccccatgctgaccccagaggagcggcacctgaacaagatgcagaaccacggctatgagaaccccacctacaagtacctggagcagatgcagatctag

SEQ ID NO: 143526 - DNA, 1758 bp, Artificial Sequence
  Description of Artificial Sequence: Synthetic coding sequence
atggctgctgtggagctggagtggatccctgagaccctgtacaacacagccatctctgctgtggtggacaactacatccgcagcagaagagacatccgcagcctgcctgagaacatccagtttgatgtgtactacaagctgtaccagcagggccgcctgtgccagctgggcagcgagttctgtgagctggaggtgtttgccaaggtgctgcgggccctggacaagaggcacctgctgcaccactgcttccaggccctgatggaccatggagtgaaggtggcctctgtgctggcctacagcttcagccgccgctgcagctacatcgccgagagtgatgctgctgtgaaggagaaggccatccaggtgggctttgtgctgggcggcttcctgagtgatgctggctggtacagtgatgctgagaaggtgttcctgagctgcctgcagctgtgcaccctgcatgatgagatgctgcactggttccgggctgtggagtgctgcgtgcggctgctgcacgtgagaaatggaaactgcaagtaccacctgggggaggagaccttcaagctggcccagacctacatggacaagctgagcaagcacggccagcaggccaacaaggccgccctgtatggagagctgtgtgccctgctgtttgccaagagccactatgatgaggcctacaagtggtgcatcgaggccatgaaggagatcacagctggcctgcctgtgaaggtggtggtggatgtgctgcggcaggccagcaaggcctgtgtggtgaagcgggagttcaagaaggccgagcagctgatcaagcatgctgtgtacctggcccgggaccacttcggcagcaagcaccccaagtacagcgacaccctgctggactatggcttctacctgctgaatgtggacaacatctgccagagcgtggccatctaccaggccgccctggacatccggcagagcgtgtttggaggcaagaacatccacgtggccacagcccacgaggacctggcctacagcagctatgtgcaccagtacagcagcggcaagtttgacaatgccctcttccacgccgagcgggccatcggcatcatcacccacatcctgcctgaggaccacctgctgctggccagcagcaagagggtgaaggccctgatcctggaggagatcgccatcgactgccacaacaaggagacagagcagaggctgctgcaggaggcccatgacctgcacctgagcagcctgcagctggccaagaaggcctttggagagttcaacgtgcagacagccaagcactacggcaacctgggccgcctgtaccagagcatgaggaagttcaaggaggccgaggagatgcacatcaaggccatccagatcaaggagcagctgctgggccaggaggactatgaggtggccctgtctgtgggccacctggccagcctgtacaactatgacatgaaccagtatgaaaatgctgagaagctgtacctgcggagcatcgccatcggcaagaagctgtttggagagggctacagcggcctggagtatgactaccggggcctcatcaagctgtacaacagcatcggcaactatgagaaggtgtttgagtaccacaacgtgctgagcaactggaaccggctgcgggaccggcagtacagcgtgacagatgccctggaggatgtgtccaccagcccccagagcacagaggaggtggtgcagagcttcctgatcagccagaatgtggagggccccagctgctag

SEQ ID NO: 143527 - DNA, 4974 bp, Artificial Sequence
  Description of Artificial Sequence: Synthetic coding sequence
atggacagcaagaagaggagcagcacagaagctgagggcagcaaggagcggggcctggtgcacatctggcaggccggcagcttccccatcaccccagagcggctgcccggctggggcggcaagacagtgctgcaggccgccctgggcgtgaagcacggcgtgctgctgacagaagatggagaggtgtacagctttggcaccctgccctggaggagcggccctgtggagatctgccccagcagccccatcctggagaatgccctggtgggccagtatgtgatcaccgtggccaccggcagcttccacagcggggctgtgacagacaatggagtggcctacatgtggggagaaaattctgctggccagtgtgctgtggccaaccagcagtatgtgcctgagcccaaccctgtgtccattgctgacagcgaggccagccccctgctggccgtgcgcatcctgcagctggcctgtggggaggagcacaccctggccctgagcatcagccgggagatctgggcctggggcaccggctgccagctgggcctcatcaccacagccttccctgtgaccaagccccagaaggtggagcacctggccggccgggtggtgctgcaggtggcctgtggggccttccacagcctggccctggtgcagtgcctgcccagccaggacctgaagcctgtgcctgagcgctgcaaccagtgcagccagctgctgatcaccatgacagacaaggaggaccacgtgatcatcagtgacagccactgctgccccctgggcgtgaccctgacagagagccaggctgaaaatcatgccagcacagccctgagccccagcacagagaccctggaccggcaggaggaggtgtttgagaacaccctggtggccaatgaccagagcgtggccacagagctgaatgctgtgtctgcccagatcaccagcagtgatgccatgagcagccagcagaatgtgatgggcaccacagagatcagcagcgccaggaacatccccagctacccagacacccaggccgtgaatgagtacctgaggaagctgagtgaccacagcgtgagagaagattctgaacatggagagaagcctgtgcccagccagcccctgctggaggaggccatccccaacctgcacagcccccccaccaccagcaccagcgccctgaacagcctggtggtgtcctgtgccagcgctgtgggcgtgcgggtggccgccacctatgaagctggggccctgagcctgaagaaggtgatgaacttctacagcaccaccccctgtgagaccggggcccaggccggcagcagcgccatcggccctgagggcctgaaggacagccgggaggagcaggtgaagcaggagagcatgcagggcaagaagagcagcagcctggtggacatccgggaggaggagacagaaggaggcagccggcggctgagcctgcccggcctgctgagccaggtgagcccccggctgctgaggaaggccgcccgggtgaagaccaggacagtggtgctgacccccacctacagcggggaggctgatgccctgctgcccagcctgaggacagaggtgtggacctggggcaagggcaaggagggccagctgggccatggagatgtgctgccccggctgcagcccctgtgtgtgaagtgcctggatggcaaggaggtgatccacctggaggccggcggctaccacagcctggccctgacagccaagagccaggtgtacagctggggcagcaacaccttcggccagctgggccacagcgacttccccaccaccgtgccccggctggccaagatcagcagtgaaaatggagtgtggagcattgctgctggccgggactacagcctcttcctggtggacacagaggacttccagcccggcctgtactacagcggccggcaggaccccacagaaggagacaacctgcctgagaaccacagcggcagcaagacccctgtgctgctgagctgcagcaagctgggctacatcagccgggtgacagctgggaaggacagctacctggccctggtggacaagaacatcatgggctacatcgccagcctgcacgagctggccaccacagaaagacgcttctacagcaagctgagtgacatcaagagccagatcctgcggcccctgctgagcctggagaacctgggcaccaccaccaccgtgcagctgctgcaggaggtggccagccgcttcagcaagctgtgctacctgattggccagcacggggccagcctgagcagcttcctgcatggagtgaaggaggcccggagcctggtgatcctgaagcacagcagcctcttcctggacagctacacagagtactgcaccagcatcaccaacttcctggtgatgggcggcttccagctgctggccaagccagccatcgacttcctgaacaagaaccaggagctgctgcaggacctgtctgaggtgaatgatgagaacacccagctgatggagatcctgaacaccctcttcttcctgcccatccggcggctgcacaactatgccaaggtgctgctgaagctggccacctgctttgaggtggccagccctgagtaccagaagctgcaggacagcagcagctgctatgagtgcctggccctgcacctgggcaggaagaggaaggaggccgagtacaccctgggcttctggaagaccttccctgggaagatgacagacagcctgaggaagccagagcggcggctgctgtgtgagagcagcaacagagccctgagcctgcagcacgccggccgcttctctgtgaactggttcatcctcttcaatgatgccctggtgcacgcccagttcagcacccaccacgtgttccccctggccaccctgtgggccgagcccctgtctgaggaggccggcggcgtgaatggcctgaagatcaccaccccagaggagcagttcaccctcatcagcagcaccccccaggagaagaccaagtggctgcgggccatcagccaggccgtggaccaggccctgcggggcatgtctgacctgcccccctacggcagcggcagctctgtgcagaggcaggagccccccatcagccgcagcgccaagtacaccttctacaaggacccccggctgaaggatgccacctatgatggccgctggctgagcggcaagccccacggccggggcgtgctgaagtggccagatggcaagatgtacagcggcatgttcagaaatggcctggaggatggctacggggagtaccgcatccccaacaaggccatgaacaaggaggaccactacgtgggccactggaaggagggcaagatgtgtggccagggcgtgtacagctatgccagcggggaggtgtttgagggctgcttccaggacaacatgagacatggccacggcctgctgcggagcggcaagctgaccagcagcagccccagcatgttcatcggccagtgggtgatggacaagaaggccggctatggagtgtttgatgacatcaccagaggagagaagtacatgggcatgtggcaggatgatgtgtgccagggcaatggagtggtggtgacccagtttggcctgtactatgagggcaacttccacctgaacaagatgatgggaaatggagtgctgctgtctgaagatgacaccatctatgaaggagagttcagtgatgactggaccctgagcggcaagggcaccctgaccatgcccaatggagactacatcgagggctacttcagcggggagtggggcagcggcatcaagatcaccggcacctacttcaagcccagcctgtatgaaagtgacaaggaccggcccaaggtgttcaggaagctgggcaacctggccgtgcctgcagatgagaagtggaaggctgtgtttgatgagtgctggaggcagctgggctgtgagggccctggccagggcgaggtgtggaaggcctgggacaacattgctgtggccctgaccaccagccggcggcagcaccgggacagccctgagatcctgagccgcagccagacccagaccctggagagcctggagttcatcccccagcacgtgggcgccttctctgtggagaagtatgatgacatcaggaagtacctgatcaaggcctgtgacacccccctgcaccccctgggccgcctggtggagaccctggtggccgtgtacaggatgacctacgtgggcgtgggcgccaacagaaggctgctgcaggaggccgtgaaggagatcaagagctacctgaagaggatcttccagctggtgcgcttcctgtttcctgagctgcctgaggagggcagcaccatccccctgagcgcccccctgcccacagagaggaagagcttctgcaccgggaagagtgacagccgctctgagagccctgagcccggctacgtggtgaccagcagcggcctgctgctgcctgtgctgctgccccggctgtacccacccctcttcatgctgtatgccctggacaatgaccgggaggaggacatctactgggagtgtgtgctgcggctgaacaagcagcctgacatcgccctgctgggcttcctgggcgtgcagaggaagttctggccagccaccctgagcatcctgggggagagcaagaaggtgctgcccaccaccaaggatgcctgctttgccagcgctgtggagtgcctgcagcagatcagcaccaccttcacccccagcgacaagctgaaggtgatccagcagacctttgaggagatcagccagagcgtgctggccagcctgcacgaggacttcctgtggagcatggatgacctcttccctgtgttcctgtatgtggtgctgcgggcccgcatccggaacctgggcagcgaggtgcacctgattgaggacctgatggacccctacctgcagcacggggagcagggcatcatgttcaccaccctgaaggcctgctactaccagatccagcgggagaagctgaactag

SEQ ID NO: 143528 - DNA, 420 bp, Artificial Sequence
  Description of Artificial Sequence: Synthetic coding sequence
atggacagcaagaagaggagcagcacagaagctgagggcagcaaggagcggggcctggtgcacatctggcaggccggcagcttccccatcaccccagagcggctgcccggctggggcggcaagacagtgctgcaggccgccctgggcgtgaagcacggcgtgctgctgacagaagatggagaggtgtacagctttggcaccctgccctggaggagcggccctgtggagatctgccccagcagccccatcctggagaatgccctggtgggccagtatgtgatcaccgtggccaccggcagcttccacagcggggctgtgacagacaatggagtggcctacatgtggggagaaaattctgctggccagtgtgctgtggccaaccagcagtatgtgcctgagcccaaccctgtgtccatctag

SEQ ID NO: 143529 - DNA, 321 bp, Artificial Sequence
  Description of Artificial Sequence: Synthetic coding sequence
atggacagcaagaagaggagcagcacagaagctgagggcagcaaggagcggggcctggtgcacatctggcaggccggcagcttccccatcaccccagagcggctgcccggctggggcggcaagacagtgctgcaggccgccctgggcgtgaagcacggcgtgctgctgacagaagatggagaggtgtacagctttggcaccctgccctggaggagcggccctgtggagatctgccccagcagccccatcctggagaatgccctggtgggccagtatgtgatcaccgtggccaccggcagcttccacagcggggctgtgtag

SEQ ID NO: 143530 - DNA, 1758 bp, Artificial Sequence
  Description of Artificial Sequence: Synthetic coding sequence
tgactggccctggtggacaagaacatcatgggctacatcgccagcctgcacgagctggccaccacagagcggcgcttctacagcaagctgagtgacatcaagagccagatcctgcggcccctgctgagcctggagaacctgggcaccaccaccaccgtgcagctgctgcaggaggtggccagccgcttcagcaagctgtgctacctgattggccagcacggggccagcctgagcagcttcctgcacggcgtgaaggaggcccggagcctggtgatcctgaagcacagcagcctcttcctggacagctacacagagtactgcaccagcatcaccaacttcctggtgatgggcggcttccagctgctggccaagccagccatcgacttcctgaacaagaaccaggagctgctgcaggacctgtctgaggtgaatgatgagaacacccagctgatggagatcctgaacaccctcttcttcctgcccatccggcggctgcacaactatgccaaggtgctgctgaagctggccacctgctttgaggtggccagccctgagtaccagaagctgcaggacagcagcagctgctatgaatgtctggccctgcacctgggcaggaagaggaaggaggccgagtacaccctgggcttctggaagaccttccctgggaagatgacagacagcctgaggaagccagagcggcggctgctgtgtgagagcagcaacagagccctgagcctgcagcacgccggccgcttctctgtgaactggttcatcctcttcaatgatgccctggtgcacgcccagttcagcacccaccacgtgttccccctggccaccctgtgggccgagcccctgtctgaggaggccggcggcgtgaatggcctgaagatcaccaccccagaggagcagttcaccctcatcagcagcaccccccaggagaagaccaagtggctgcgggccatcagccaggccgtggaccaggccctgcggggcatgtctgacctgcccccctacggcagcggcagctctgtgcagaggcaggagccccccatcagccgcagcgccaagtacaccttctacaaggacccccggctgaaggatgccacctatgatggccgctggctgagcggcaagccccacggccggggcgtgctgaagtggccagatggcaagatgtacagcggcatgttcagaaatggcctggaggatggctatggagagtaccgcatccccaacaaggccatgaacaaggaggaccactacgtgggccactggaaggagggcaagatgtgtggccagggcgtgtacagctatgccagcggggaggtgtttgagggctgcttccaggacaacatgagacatggccacggcctgctgcggagcggcaagctgaccagcagcagccccagcatgtttattggccagtgggtgatggacaagaaggccggctacggcgtgtttgatgacatcaccagaggagagaagtacatgggcatgtggcaggatgatgtgtgccagggcaatggagtggtggtgacccagtttggcctgtactatgagggcaacttccacctgaacaagatgatgggaaatggagtgctgctgtctgaagatgacaccatctatgaaggagagttcagtgatgactggaccctgagcggcaaggacaacagcggcctgattgagcaggtgggcaagtgcagcctgctgccctacttcctgaaggtgtgtgaggccctggtgctcttcctgctgtag

SEQ ID NO: 143531 - DNA, 1731 bp, Artificial Sequence
  Description of Artificial Sequence: Synthetic coding sequence
atgggctacatcgccagcctgcacgagctggccaccacagaaagacgcttctacagcaagctgagtgacatcaagagccagatcctgcggcccctgctgagcctggagaacctgggcaccaccaccaccgtgcagctgctgcaggaggtggccagccgcttcagcaagctgtgctacctgattggccagcacggggccagcctgagcagcttcctgcatggagtgaaggaggcccggagcctggtgatcctgaagcacagcagcctcttcctggacagctacacagagtactgcaccagcatcaccaacttcctggtgatgggcggcttccagctgctggccaagccagccatcgacttcctgaacaagaaccaggagctgctgcaggacctgtctgaggtgaatgatgagaacacccagctgatggagatcctgaacaccctcttcttcctgcccatccggcggctgcacaactatgccaaggtgctgctgaagctggccacctgctttgaggtggccagccctgagtaccagaagctgcaggacagcagcagctgctatgagtgcctggccctgcacctgggcaggaagaggaaggaggccgagtacaccctgggcttctggaagaccttccctgggaagatgacagacagcctgaggaagccagagcggcggctgctgtgtgagagcagcaacagagccctgagcctgcagcacgccggccgcttctctgtgaactggttcatcctcttcaatgatgccctggtgcacgcccagttcagcacccaccacgtgttccccctggccaccctgtgggccgagcccctgtctgaggaggccggcggcgtgaatggcctgaagatcaccaccccagaggagcagttcaccctcatcagcagcaccccccaggagaagaccaagtggctgcgggccatcagccaggccgtggaccaggccctgcggggcatgtctgacctgcccccctacggcagcggcagctctgtgcagaggcaggagccccccatcagccgcagcgccaagtacaccttctacaaggacccccggctgaaggatgccacctatgatggccgctggctgagcggcaagccccacggccggggcgtgctgaagtggccagatggcaagatgtacagcggcatgttcagaaatggcctggaggatggctacggggagtaccgcatccccaacaaggccatgaacaaggaggaccactacgtgggccactggaaggagggcaagatgtgtggccagggcgtgtacagctatgccagcggggaggtgtttgagggctgcttccaggacaacatgagacatggccacggcctgctgcggagcggcaagctgaccagcagcagccccagcatgttcatcggccagtgggtgatggacaagaaggccggctatggagtgtttgatgacatcaccagaggagagaagtacatgggcatgtggcaggatgatgtgtgccagggcaatggagtggtggtgacccagtttggcctgtactatgagggcaacttccacctgaacaagatgatgggaaatggagtgctgctgtctgaagatgacaccatctatgaaggagagttcagtgatgactggaccctgagcggcaaggacaacagcggcctcatcgagcaggtgggcaagtgcagcctgctgccctacttcctgaaggtgtgtgaggccctggtgctcttcctgctgtag

SEQ ID NO: 143532 - DNA, 1191 bp, Artificial Sequence
  Description of Artificial Sequence: Synthetic coding sequence
atggacagcaagaagaggagcagcacagaagctgagggcagcaaggagcggggcctggtgcacatctggcaggccggcagcttccccatcaccccagagcggctgcccggctggggcggcaagacagtgctgcaggccgccctgggcgtgaagcacggcgtgctgctgacagaagatggagaggtgtacagctttggcaccctgccctggaggagcggccctgtggagatctgccccagcagccccatcctggagaatgccctggtgggccagtatgtgatcaccgtggccaccggcagcttccacagcggggctgtgacagacaatggagtggcctacatgtggggagaaaattctgctggccagtgtgctgtggccaaccagcagtatgtgcctgagcccaaccctgtgtccattgctgacagcgaggccagccccctgctggccgtgcgcatcctgcagctggcctgtggggaggagcacaccctggccctgagcatcagccgggagatctgggcctggggcaccggctgccagctgggcctcatcaccacagccttccctgtgaccaagccccagaaggtggagcacctggccggccgggtggtgctgcaggtggcctgtggggccttccacagcctggccctggtgcagtgcctgcccagccaggacctgaagcctgtgcctgagcgctgcaaccagtgcagccagctgctgatcaccatgacagacaaggaggaccacgtgatcatcagtgacagccactgctgccccctgggcgtgaccctgacagagagccaggctgaaaatcatgccagcacagccctgagccccagcacagagaccctggaccggcaggaggaggtgtttgagaacaccctggtggccaatgaccagagcgtggccacagagctgaatgctgtgtctgcccagatcaccagcagtgatgccatgagcagccagcagaatgtgatgggcaccacagagatcagcagcgccaggaacatccccagctacccagacacccaggccgtgaatgagtacctgaggaagctgagtgaccacagcgtgagagaagattctgaacatggagagaagcctgtgcccagccaggtgcctgcccagttctacaagatcaaggtgtgcctggagctgaactgcatgggcttcagcctggagaccctgaagtag

SEQ ID NO: 143533 - DNA, 2178 bp, Artificial Sequence
  Description of Artificial Sequence: Synthetic coding sequence
atggagcagagcaatgacagcctgcgggtgaaccacaatgatggagaggagagcaagaccagcgcccaggtgtttgagcacctgatctgcatggacagccgggacagcagctttggccagaatgacagccccaccgtgctgcccatcaccacccgggaggccaacaacagcctcatcagccagaacatccctggccccctgacccagacccagaccctgtctgctgagcagttccacctggtggaccagaatggccaggccatccagtatgagctgcagagcctgggggagagcaatgcccagatgatgattgtggccagccccacagaaaatggccaggtgctgcgggtcatcccccccacccagacaggcatggcccaggtgatcatcccccagggccagctggtggatgtgaacagccccagagatgtgcctgaggagaagcccagcaacagaaacctgcccaccgtgcgggtggacaccctggccgacaacaccagcaactacatcctgcacccccagaccagcttccccctgcccaagaagtctgtgacaggcatgctggaggagcccctgctgggccccctgcagcccctgagcagcaacacccccatctgggcctgccgcctgcggagctgtgagaagatcggggacagctaccggggctactgtgtgtctgaaacagagctggagagcgtgctgaccttccacaagcagcagacccagagcgtgtggggcacccggcagagccccagccctgccaagccagccacccggctgatgtggaagagccagtatgtgccctatgatggcatcccctttgtgaatgccggcagcagagctgtggtgatggagtgccagtatggccccaggaggaagggcttccagctgaagaaggtgtctgagcaggagagccgcagctgccagctgtacaaggccacctgcccagcccgcatctacatcaagaaggtgcagaagtttcctgagtacagagtgcccacagaccccaagattgacaagaagatcatccgcatggagcaggagaaggccttcaacatgctgaagaagaacctggtggatgctggaggagtgctgcgctggtacgtgcagctgcccacccagcaggcccaccagtaccacgagctggagaccccctgcctgaccctgagccccagccccttccctgtgagcagcctggaggaggaggagacagctgtgagagatgagaactgtgccctgcccagccggctgcacccccaggtggcccacaagatccaggagctggtgtcccagggcatcgagcaggtgtatgctgtgaggaagcagctgaggaagtttgtggagcgggagctgttcaagccagatgaggtgcctgagcggcacaacctgtccttcttccccaccgtgaatgacatcaagaaccacatccacgaggtgcagaagagcctgagaaatggagacacagtgtacaacagcgagatcatcccagccaccctgcagtggaccacagattctggcaacatcctgaaggagaccatgacagtgacctttgctgagggcaacagccctggagagagcatcaccaccaaggtggagaccaaccagacccggggcagcctgagccctgagcccacccacctgctgagcagcctgagcagcttccagcccaagatcttcacccagctgcagggcctgcagctgcagccccgctacaccagcccagatgagagccctgctgtggtgtctgtgaacaaccagcccagcagcagccccagcggcctgctggacaccatcggcagcgctgtgatgaacaacaacagcctgctgctgggccagagccacagcctgcagagggacacctgcctgacccagaacaacagcacagccagcaccatgggcaacctgcctgagccagaccagaacctggtggccatggatgagctggtggaggtgggagatgtggaggacaccggcaacctggagggcaccgtgcaccgcatcctgctgggagatgtgcagaccatccccatccagatcatcgacaaccacagcgccctgattgaagaaaatcctgagagcaccatctctgtgtcccaggtgaagcaggagcccaaggagcccgccctgtccatggaggccaagaagacagtggactacaagaagctgagcgccacctag

SEQ ID NO: 143534 - DNA, 2178 bp, Artificial Sequence; identical to SEQ ID NO: 143533
  Description of Artificial Sequence: Synthetic coding sequence

SEQ ID NO: 143535 - DNA, 165 bp, Artificial Sequence
  Description of Artificial Sequence: Synthetic coding sequence
atggagcagagcaatgacagcctgcgggtgaaccacaatgatggagaggagagcaagaccagcgcccaggtgtttgagcacctgatctgcatggacagccgggacagcagctttggccagaatgacagccccaccgtgctgcccatcaccacccgggaggcctag

SEQ ID NO: 143536 - DNA, 396 bp, Artificial Sequence
  Description of Artificial Sequence: Synthetic coding sequence
atggagcagagcaatgacagcctgcgggtgaaccacaatgatggagaggagagcaagaccagcgcccaggtgtttgagcacctgatctgcatggacagccgggacagcagctttggccagaatgacagccccaccgtgctgcccatcaccacccgggaggccaacaacagcctcatcagccagaacatccctggccccctgacccagacccagaccctgtctgctgagcagttccacctggtggaccagaatggccaggccatccagtatgagctgcagagcctgggggagagcaatgcccagatgatgattgtggccagccccacagaaaatggccaggtgctgcgggtcatcccccccacccagacaggcatggcccaggtgatcatcccctag

SEQ ID NO: 143537 - DNA, 66 bp, Artificial Sequence
  Description of Artificial Sequence: Synthetic coding sequence
atggagcagagcaatgacagcctgcgggtgaaccacaatgatggagaggagagcaagaccagctag

SEQ ID NO: 143538 - DNA, 222 bp, Artificial Sequence
  Description of Artificial Sequence: Synthetic coding sequence
atggagcagagcaatgacagcctgcgggtgaaccacaatgatggagaggagagcaagaccagcgcccaggtgtttgagcacctgatctgcatggacagccgggacagcagctttggccagaatgacagccccaccgtgctgcccatcaccacccgggaggccaacaacagcctcatcagccagaacatccctggccccctgacccagacccagaccctgtag

SEQ ID NO: 143539 - DNA, 2178 bp, Artificial Sequence; identical to SEQ ID NO: 143533
  Description of Artificial Sequence: Synthetic coding sequence

SEQ ID NO: 143540 - DNA, 222 bp, Artificial Sequence; identical to SEQ ID NO: 143538
  Description of Artificial Sequence: Synthetic coding sequence

SEQ ID NO: 143541 - DNA, 288 bp, Artificial Sequence
  Description of Artificial Sequence: Synthetic coding sequence
atggagcagagcaatgacagcctgcgggtgaaccacaatgatggagaggagagcaagaccagcgcccaggtgtttgagcacctgatctgcatggacagccgggacagcagctttggccagaatgacagccccaccgtgctgcccatcaccacccgggaggccaacaacagcctcatcagccagaacatccctggccccctgacccagacccagaccctgtctgctgagcagttccacctggtggaccagaatggccaggccatccagtatgagctgcagagcctgtag

SEQ ID NO: 143542 - DNA, 624 bp, Artificial Sequence
  Description of Artificial Sequence: Synthetic coding sequence
atgctggaggcctggaacctgaacctgagccactacctgaagcacctgatctgcatggacagccgggacagcagctttggccagaatgacagccccaccgtgctgcccatcaccacccgggaggccaacaacagcctcatcagccagaacatccctggccccctgacccagacccagaccctgtctgctgagcagttccacctggtggaccagaatggccaggccatccagtatgagctgcagagcctgggggagagcaatgcccagatgatgattgtggccagccccacagaaaatggccaggtgctgcgggtcatcccccccacccagacaggcatggcccaggtgatcatcccccagggccagctggtggatgtgaacagccccagagatgtgcctgaggagaagcccagcaacagaaacctgcccaccgtgcgggtggacaccctggccgacaacaccagcaactacatcctgcacccccagaccagcttccccctgcccaagaagtctgtgacaggcatgctggaggagcccctgctgggccccctgcagcccctgagcagcaacacccccatctgggcctgccgcctgcggagctgtgaaggagtggagctgtggtag

SEQ ID NO: 143543 - DNA, 1914 bp, Artificial Sequence
  Description of Artificial Sequence: Synthetic coding sequence
atgctggaggcctggaacctgaacctgagccactacctgaagatgattgtggccagccccacagaaaatggccaggtgctgcgggtcatcccccccacccagacaggcatggcccaggtgatcatcccccagggccagctggtggatgtgaacagccccagagatgtgcctgaggagaagcccagcaacagaaacctgcccaccgtgcgggtggacaccctggccgacaacaccagcaactacatcctgcacccccagaccagcttccccctgcccaagaagtctgtgacaggcatgctggaggagcccctgctgggccccctgcagcccctgagcagcaacacccccatctgggcctgccgcctgcggagctgtgagaagatcggggacagctaccggggctactgtgtgtctgaaacagagctggagagcgtgctgaccttccacaagcagcagacccagagcgtgtggggcacccggcagagccccagccctgccaagccagccacccggctgatgtggaagagccagtatgtgccctatgatggcatcccctttgtgaatgccggcagcagagctgtggtgatggagtgccagtatggccccaggaggaagggcttccagctgaagaaggtgtctgagcaggagagccgcagctgccagctgtacaaggccacctgcccagcccgcatctacatcaagaaggtgcagaagtttcctgagtacagagtgcccacagaccccaagattgacaagaagatcatccgcatggagcaggagaaggccttcaacatgctgaagaagaacctggtggatgctggaggagtgctgcgctggtacgtgcagctgcccacccagcaggcccaccagtaccacgagctggagaccccctgcctgaccctgagccccagccccttccctgtgagcagcctggaggaggaggagacagctgtgagagatgagaactgtgccctgcccagccggctgcacccccaggtggcccacaagatccaggagctggtgtcccagggcatcgagcaggtgtatgctgtgaggaagcagctgaggaagtttgtggagcgggagctgttcaagccagatgaggtgcctgagcggcacaacctgtccttcttccccaccgtgaatgacatcaagaaccacatccacgaggtgcagaagagcctgagaaatggagacacagtgtacaacagcgagatcatcccagccaccctgcagtggaccacagattctggcaacatcctgaaggagaccatgacagtgacctttgctgagggcaacagccctggagagagcatcaccaccaaggtggagaccaaccagacccggggcagcctgagccctgagcccacccacctgctgagcagcctgagcagcttccagcccaagatcttcacccagctgcagggcctgcagctgcagccccgctacaccagcccagatgagagccctgctgtggtgtctgtgaacaaccagcccagcagcagccccagcggcctgctggacaccatcggcagcgctgtgatgaacaacaacagcctgctgctgggccagagccacagcctgcagagggacacctgcctgacccagaacaacagcacagccagcaccatgggcaacctgcctgagccagaccagaacctggtggccatggatgagctggtggaggtgggagatgtggaggacaccggcaacctggagggcaccgtgcaccgcatcctgctgggagatgtgcagaccatccccatccagatcatcgacaaccacagcgccctgattgaagaaaatcctgagagcaccatctctgtgtcccaggtgaagcaggagcccaaggagcccgccctgtccatggaggccaagaagacagtggactacaagaagctgagcgccacctag

SEQ ID NO: 143544 - DNA, 1950 bp, Artificial Sequence
  Description of Artificial Sequence: Synthetic coding sequence
atggagcagagcaatgacagcctgcgggtgaaccacaatgatggagaggagagcaagaccagcgcccaggtgtttgagatgattgtggccagccccacagaaaatggccaggtgctgcgggtcatcccccccacccagacaggcatggcccaggtgatcatcccccagggccagctggtggatgtgaacagccccagagatgtgcctgaggagaagcccagcaacagaaacctgcccaccgtgcgggtggacaccctggccgacaacaccagcaactacatcctgcacccccagaccagcttccccctgcccaagaagtctgtgacaggcatgctggaggagcccctgctgggccccctgcagcccctgagcagcaacacccccatctgggcctgccgcctgcggagctgtgagaagatcggggacagctaccggggctactgtgtgtctgaaacagagctggagagcgtgctgaccttccacaagcagcagacccagagcgtgtggggcacccggcagagccccagccctgccaagccagccacccggctgatgtggaagagccagtatgtgccctatgatggcatcccctttgtgaatgccggcagcagagctgtggtgatggagtgccagtatggccccaggaggaagggcttccagctgaagaaggtgtctgagcaggagagccgcagctgccagctgtacaaggccacctgcccagcccgcatctacatcaagaaggtgcagaagtttcctgagtacagagtgcccacagaccccaagattgacaagaagatcatccgcatggagcaggagaaggccttcaacatgctgaagaagaacctggtggatgctggaggagtgctgcgctggtacgtgcagctgcccacccagcaggcccaccagtaccacgagctggagaccccctgcctgaccctgagccccagccccttccctgtgagcagcctggaggaggaggagacagctgtgagagatgagaactgtgccctgcccagccggctgcacccccaggtggcccacaagatccaggagctggtgtcccagggcatcgagcaggtgtatgctgtgaggaagcagctgaggaagtttgtggagcgggagctgttcaagccagatgaggtgcctgagcggcacaacctgtccttcttccccaccgtgaatgacatcaagaaccacatccacgaggtgcagaagagcctgagaaatggagacacagtgtacaacagcgagatcatcccagccaccctgcagtggaccacagattctggcaacatcctgaaggagaccatgacagtgacctttgctgagggcaacagccctggagagagcatcaccaccaaggtggagaccaaccagacccggggcagcctgagccctgagcccacccacctgctgagcagcctgagcagcttccagcccaagatcttcacccagctgcagggcctgcagctgcagccccgctacaccagcccagatgagagccctgctgtggtgtctgtgaacaaccagcccagcagcagccccagcggcctgctggacaccatcggcagcgctgtgatgaacaacaacagcctgctgctgggccagagccacagcctgcagagggacacctgcctgacccagaacaacagcacagccagcaccatgggcaacctgcctgagccagaccagaacctggtggccatggatgagctggtggaggtgggagatgtggaggacaccggcaacctggagggcaccgtgcaccgcatcctgctgggagatgtgcagaccatccccatccagatcatcgacaaccacagcgccctgattgaagaaaatcctgagagcaccatctctgtgtcccaggtgaagcaggagcccaaggagcccgccctgtccatggaggccaagaagacagtggactacaagaagctgagcgccacctag

SEQ ID NO: 143545 - DNA, 558 bp, Artificial Sequence
  Description of Artificial Sequence: Synthetic coding sequence
atgaccacccccaacaagaccccacctggagctgaccccaagcagctggagaggactggaacagtgcgggagatcggcagccaggccgtgtggagcctgagcagctgcaagccaggcttcggcgtggaccagctgagagatgacaacctggagacctactggcagagtgatggcagccagccccacctggtgaacatccagttccggaggaagaccaccgtgaagaccctgtgcatctatgctgactacaagagtgatgagagctacacccccagcaagatctctgtgcgggtgggcaacaacttccacaacctgcaggagatccggcagctggagctggtggagcccagcggctggattcatgtgcccctgacagacaaccacaagaagcccaccaggaccttcatgatccagattgctgtgctggccaaccaccagaatggccgggacacccacatgaggcagatcaagatctacacccctgtggaggagagcagcatcggcaagttcccccgctgcaccaccatcgacttcatgatgtaccgcagcatcagatag

SEQ ID NO: 143546 - DNA, 558 bp, Artificial Sequence; identical to SEQ ID NO: 143545
  Description of Artificial Sequence: Synthetic coding sequence

SEQ ID NO: 143547 - DNA, 207 bp, Artificial Sequence
  Description of Artificial Sequence: Synthetic coding sequence
atgaccacccccaacaagaccccacctggagctgaccccaagcagctggagaggactggaacagtgcgggagatcggcagccaggccgtgtggagcctgagcagctgcaagccaggcttcggcgtggaccagctgagagatgacaacctggagacctactggcagagtgatggcagccagccccacctggtgaacatccagttctag

SEQ ID NO: 143548 - DNA, 330 bp, Artificial Sequence
  Description of Artificial Sequence: Synthetic coding sequence
atgaccacccccaacaagaccccacctggagctgaccccaagcagctggagaggactggaacagtgcgggagatcggcagccaggccgtgtggagcctgagcagctgcaagccaggcttcggcgtggaccagctgagagatgacaacctggagacctactggcagagtgatggcagccagccccacctggtgaacatccagttccggaggaagaccaccgtgaagaccctgtgcatctatgctgactacaagagtgatgagagctacacccccagcaagatctctgtgcgggtgggcaacaacttccacaacctgcaggagatcagatag

SEQ ID NO: 143549 - DNA, 558 bp, Artificial Sequence; identical to SEQ ID NO: 143545
  Description of Artificial Sequence: Synthetic coding sequence

SEQ ID NO: 143550 - DNA, 477 bp, Artificial Sequence
  Description of Artificial Sequence: Synthetic coding sequence
atgaccacccccaacaagaccccacctggagctgaccccaagcagctggagaggactggaacagtgcgggagatcggcagccaggccgtgtggagcctgagcagctgcaagccaggcttcggcgtggaccagctgagagatgacaacctggagacctactggcagagtgatggcagccagccccacctggtgaacatccagttccggaggaagaccaccgtgaagaccctgtgcatctatgctgactacaagagtgatgagagctacacccccagcaagatctctgtgcgggtgggcaacaacttccacaacctgcaggagatccggcagctggagctggtggagcccagcggctggattcatgtgcccctgacagacaaccacaagaagcccaccaggaccttcatgatccagattgctgtgctggccaaccaccagaatggccgggacacccacatgaggcagatcaagatctag

SEQ ID NO: 143551 - DNA, 477 bp, Artificial Sequence; identical to SEQ ID NO: 143550
  Description of Artificial Sequence: Synthetic coding sequence

SEQ ID NO: 143552 - DNA, 333 bp, Artificial Sequence
  Description of Artificial Sequence: Synthetic coding sequence
atggccgccagcagcagcagcagcagcgctgggggcgtgtctggcagctctgtgactggaagtggcttctctgtgtctgacctggccccacccaggaaggccctcttcacctaccccaagggggccggggagatgctggaggatggcagcgagcgcttcctgtgtgagagcgtcttctcctaccaggtggccagcaccctgaagcaggtgaagcatgaccagcaggtggccaggatggagaagctggccggcctggtggaggagctggaggctgatgagtggaggttcaagcccatcgagcagctgctgggcttcacccccagcagtggatag

SEQ ID NO: 143553 - DNA, 2427 bp, Artificial Sequence
  Description of Artificial Sequence: Synthetic coding sequence
atgctgcgcttccccacctgcttccccagcttccgggtggtgggggagaagcagctgccccaggagatcatcttcctggtgtggagccccaagagggacctgattgccctggccaacacagctggggaggtgctgctgcaccggctggccagcttccaccgggtgtggagcttccccccaaatgaaaatacaggcaaggaggtgacctgcctggcctggaggccagatggcaagctgctggcctttgccctggccgacaccaagaagatcgtgctgtgtgatgtggagaagccagagagcctgcacagcttctctgtggaggcccctgtgtcctgcatgcactggatggaggtgacagtggagagctctgtgctgaccagcttctacaatgcagaagatgagagcaacctgctgctgcccaagctgcccaccctgcccaagaactacagcaacaccagcaagatcttctctgaagaaaattctgatgagatcatcaagctgctgggagatgtgcggctgaacatcctggtgctgggcggcagcagcggcttcatcgagctgtatgcctacggcatgttcaagatcgcccgggtgactggaattgctggcacctgcctggccctgtgcctgagcagtgacctgaagagcctgtctgtggtgacagaggtgtccaccaacggggccagcgaggtgtcctacttccagctggagaccaacctgctgtacagcttcctgcctgaggtgaccaggatggccaggaagttcacccacatcagcgccctgctgcagtacatcaacctgagcctgacctgcatgtgtgaggcctgggaggagatcctgatgcagatggacagccggctgaccaagtttgtgcaggagaagaacaccaccacctctgtgcaggatgagttcatgcacctgctgctgtggggcaaggccagcgctgagctgcagaccctgctgatgaaccagctgactgtgaagggcctgaagaagctgggccagagcattgagagcagctacagcagcatccagaagctggtgatcagccacctgcagagcggcagcgagagcctgctgtaccacctgtctgagctgaagggcatggcctcctggaagcagaagtatgagcccctgggcctggatgctgctggcatcgaggaggccatcacagctgtgggcagcttcatcctgaaggccaatgagctgctgcaggtgattgacagctccatgaagaacttcaaggccttcttccgctggctgtatgtggccatgctgaggatgacagaggaccacgtgctgcctgagctgaacaagatgacccagaaggacatcacctttgtggccgagttcctgacagagcacttcaatgaggccccagacctgtacaacaggaagggcaagtacttcaacgtggagcgggtgggccagtacctgaaggatgaagatgatgacctggtgtccccacccaacacagagggcaaccagtggtatgacttcctgcagaacagcagccacctgaaggagagccccctgctcttcccctactaccccaggaagagcctgcactttgtgaagaggaggatggagaacatcatcgaccagtgcctgcagaagccagcagatgtgattggcaagtccatgaaccaggccatctgcatccccctgtacagagacaccaggtctgaggacagcaccaggaggctcttcaagttccccttcctgtggaacaacaagaccagcaacctgcactacctgctcttcaccatcctggaggacagcctgtacaagatgtgcatcctgcggcggcacacagacatcagccagagcgtgtccaatggcctcatcgccatcaagtttggcagcttcacctacgccaccacagagaaggtgcggcgcagcatctacagctgcctggatgcccagttctatgatgatgagaccgtgacagtggtgctgaaggacacagtgggccgggagggccgggaccggctgctggtgcagctgcccctgagcctggtgtacaacagcgaggacagcgctgagtaccagttcaccggcacctacagcacccggctggatgagcagtgcagcgccatccccaccaggaccatgcactttgagaagcactggaggctgctggagagcatgaaggcccagtatgtggccggaaatggcttcaggaaggtgtcctgtgtgctgagcagcaacctgcggcacgtgcgggtgtttgagatggacattgatgatgagtgggagctggatgagagcagtgatgaggaggaggaggccagcaacaagcctgtgaagatcaaggaggaggtgctgtctgagagcgaggccgagaaccagcaggccggggctgctgccctggcccctgagatcgtcatcaaggtggagaagctggaccctgagctggacagctag

SEQ ID NO: 143554 - DNA, 489 bp, Artificial Sequence
  Description of Artificial Sequence: Synthetic coding sequence
atgctgcgcttccccacctgcttccccagcttccgggtggtgggggagaagcagctgccccaggagatcatcttcctggtgtggagccccaagagggacctgattgccctggccaacacagctggggaggtgctgctgcaccggctggccagcttccaccgggtgtggagcttccccccaaatgaaaatacaggcaaggaggtgacctgcctggcctggaggccagatggcaagctgctggcctttgccctggccgacaccaagaagatcgtgctgtgtgatgtggagaagccagagagcctgcacagcttctctgtggaggcccctgtgtcctgcatgcactggatggaggtgacagtggagagctctgtgctgaccagcttctacaatgcagaagatgagagcaacctgctgctgcccaagctgcccaccctgcccaagaactacagcaacaccagcaagatcttctctgaagaaaattctgactag

SEQ ID NO: 143555 - DNA, 2430 bp, Artificial Sequence
  Description of Artificial Sequence: Synthetic coding sequence
atgctgcgcttccccacctgcttccccagcttccgggtggtgggggagaagcagctgccccaggagatcatcttcctggtgtggagccccaagagggacctgattgccctggccaacacagctggggaggtgctgctgcaccggctggccagcttccaccgggtgtggagcttccccccaaatgaaaatacaggcaaggaggtgacctgcctggcctggaggccagatggcaagctgctggcctttgccctggccgacaccaagaagatcgtgctgtgtgatgtggagaagccagagagcctgcacagcttctctgtggaggcccctgtgtcctgcatgcactggatggaggtgacagtggagagctctgtgctgaccagcttctacaatgcagaagatgagagcaacctgctgctgcccaagctgcccaccctgcccaagaactacagcaacaccagcaagatcttctctgaagaaaattctgatgagatcatcaagctgctgggagatgtgcggctgaacatcctggtgctgggcggcagcagcggcttcatcgagctgtatgcctacggcatgttcaagatcgcccgggtgactggaattgctggcacctgcctggccctgtgcctgagcagtgacctgaagagcctgtctgtggtgacagaggtgtccaccaacggggccagcgaggtgtcctacttccagctggagaccaacctgctgtacagcttcctgcctgaggtgaccaggatggccaggaagttcacccacatcagcgccctgctgcagtacatcaacctgagcctgacctgcatgtgtgaggcctgggaggagatcctgatgcagatggacagccggctgaccaagtttgtgcaggagaagaacaccaccacctctgtgcaggatgagttcatgcacctgctgctgtggggcaaggccagcgctgagctgcagaccctgctgatgaaccagctgactgtgaagggcctgaagaagctgggccagagcattgagagcagctacagcagcatccagaagctggtgatcagccacctgcagagcggcagcgagagcctgctgtaccacctgtctgagctgaagggcatggcctcctggaagcagaagtatgagcccctgggcctggatgctgctggcatcgaggaggccatcacagctgtgggcagcttcatcctgaaggccaatgagctgctgcaggtgattgacagctccatgaagaacttcaaggccttcttccgctggctgtatgtggccatgctgaggatgacagaggaccacgtgctgcctgagctgaacaaggtgatgacccagaaggacatcacctttgtggccgagttcctgacagagcacttcaatgaggccccagacctgtacaacaggaagggcaagtacttcaacgtggagcgggtgggccagtacctgaaggatgaagatgatgacctggtgagcccccccaacacagagggcaaccagtggtatgacttcctgcagaacagcagccacctgaaggagagccccctgctcttcccctactaccccaggaagagcctgcactttgtgaagaggaggatggagaacatcatcgaccagtgcctgcagaagccagcagatgtgattggcaagtccatgaaccaggccatctgcatccccctgtacagagacaccaggtctgaggacagcacccggcggctcttcaagttccccttcctgtggaacaacaagaccagcaacctgcactacctgctcttcaccatcctggaggacagcctgtacaagatgtgcatcctgcggcggcacacagacatcagccagagcgtgtccaatggcctgattgccatcaagtttggcagcttcacctacgccaccacagagaaggtgagaagaagcatctacagctgcctggatgcccagttctatgatgatgaaacagtgacagtggtgctgaaggacacagtgggccgggagggccgggaccggctgctggtgcagctgcccctgagcctggtgtacaacagtgaagattctgctgagtaccagttcaccggcacctacagcacccggctggatgagcagtgcagcgccatccccaccaggaccatgcactttgagaagcactggaggctgctggagagcatgaaggcccagtatgtggccggaaatggcttcaggaaggtgtcctgtgtgctgagcagcaacctgcggcacgtgcgggtgtttgagatggacattgatgatgagtgggagctggatgagagcagtgatgaggaggaggaggccagcaacaagcctgtgaagatcaaggaggaggtgctgtctgagagcgaggccgagaaccagcaggccggggccgccgccctggcccctgagatcgtcatcaaggtggagaagctggaccctgagctggacagctag

SEQ ID NO: 143556 - DNA, 2268 bp, Artificial Sequence
  Description of Artificial Sequence: Synthetic coding sequence
atggcctctgtgcatgagagcctgtacttcaaccccatgatgaccaacggggtggtgcacgccaacgtgtttggcatcaaggactgggtgaccccctacaagattgctgtgctggtgctgctgaatgagatgagcaggactggagagggcgctgtgtccctgatggagcggcggcggctgaaccagctgctgctgcccctgctgcagggccctgacatcaccctgagcaagctgtacaagctgattgaggagagctgcccccagctggccaacagcgtgcagatccgcatcaagctgatggccgagggggagctgaaggacatggagcagttctttgatgacctgagtgacagcttcagcggcacagagcctgaggtgcacaagacctctgtggtgggcctcttcctgcggcacatgatcctggcctacagcaagctgtccttcagccaggtgttcaagctgtacacagccctgcagcagtacttccagaatggagagaagaagacagtggaggatgctgacatggagctgaccagcagagatgaaggagagaggaagatggagaaggaggagctggatgtgtctgtgcgggaggaggaggtgtcctgcagcggccccctgagccagaagcaggccgagttcttcctgagccagcaggccagcctgctgaagaatgatgagaccaaggccctgaccccagccagcctgcagaaggagctgaacaacctgctgaagttcaacccagactttgctgaggcccactacctgagctacctgaacaacctgcgggtgcaggatgtgttcagcagcacccacagcctgctgcactactttgacaggctcatcctgaccggggctgagagcaagagcaatggagaggagggctacggccgcagcctgcgctatgctgccctgaacctggccgccctgcactgccgcttcggccactaccagcaggccgagctggccctgcaggaggccatccgcatcgcccaggagagcaatgaccacgtgtgcctgcagcactgcctgtcctggctgtatgtgctgggccagaagagaagtgacagctatgtgctgctggagcacagcgtgaagaaggctgtgcacttcggcctgccctacctggccagcctgggcatccagagcctggtgcagcagagggcctttgctgggaagacagccaacaagctgatggatgccctgaaggacagcgacctgctgcactggaagcacagcctgtctgagctgattgacatcagcatcgcccagaagacagccatctggaggctgtatggccgcagcaccatggccctgcagcaggcccagatgctgctgtccatgaacagcctggaggccgtgaatgctggggtgcagcagaacaacacagagagctttgctgtggccctgtgccacctggccgagctgcacgccgagcagggctgctttgctgctgccagcgaggtgctgaagcacctgaaggagcgcttcccccccaacagccagcacgcccagctgtggatgctgtgtgaccagaagatccagtttgaccgggccatgaatgatggcaagtaccacctggccgacagcctggtgacaggcatcacagccctgaacagcattgaaggagtgtacaggaaggctgtggtgctgcaggcccagaaccagatgtctgaggcccacaagctgctgcagaagctgctggtgcactgccagaagctgaagaacacagagatggtgatctctgtgctgctgtctgtggccgagctgtactggaggagcagcagccccaccatcgccctgcccatgctgctgcaggccctggccctgagcaaggagtaccgcctgcagtacctggccagcgagaccgtgctgaacctggcctttgcccagctgatcctgggcatccctgagcaggccctgagcctgctgcacatggccatcgagcccatcctggctgatggagccatcctggacaagggccgggccatgttcctggtggccaagtgccaggtggccagcgctgccagctatgaccagcccaagaaggccgaggccctggaggccgccatcgagaacctgaatgaggccaagaactactttgccaaggtggactgcaaggagcgcatcagagatgtggtgtacttccaggcccggctgtaccacaccctgggcaagacccaggagaggaacagatgtgccatgctgttccggcagctgcaccaggagctgcccagccatggagtgcccctcatcaaccacctgtag

SEQ ID NO: 143557 - DNA, 1932 bp, Artificial Sequence
  Description of Artificial Sequence: Synthetic coding sequence
atggccgagggggagctgaaggacatggagcagttctttgatgacctgagtgacagcttctctggaacagagcctgaggtgcacaagacctctgtggtgggcctcttcctgcggcacatgatcctggcctacagcaagctgtccttcagccaggtgttcaagctgtacacagccctgcagcagtacttccagaatggagagaagaagacagtggaggatgctgacatggagctgaccagcagagatgaaggagagaggaagatggagaaggaggagctggatgtgtctgtgcgggaggaggaggtgtcctgcagcggccccctgagccagaagcaggccgagttcttcctgagccagcaggccagcctgctgaagaatgatgagaccaaggccctgaccccagccagcctgcagaaggagctgaacaacctgctgaagttcaacccagactttgctgaggcccactacctgagctacctgaacaacctgcgggtgcaggatgtgttcagcagcacccacagcctgctgcactactttgacaggctcatcctgactggagctgagagcaagagcaatggagaggagggctacggccgcagcctgcgctatgctgccctgaacctggccgccctgcactgccgcttcggccactaccagcaggccgagctggccctgcaggaggccatcagaattgcccaggagagcaatgaccacgtgtgcctgcagcactgcctgtcctggctgtatgtgctgggccagaagagaagtgacagctatgtgctgctggagcacagcgtgaagaaggctgtgcacttcggcctgccccgggcctttgctgggaagacagccaacaagctgatggatgccctgaaggacagcgacctgctgcactggaagcacagcctgtctgagctgattgacatcagcatcgcccagaagacagccatctggaggctgtatggccgcagcaccatggccctgcagcaggcccagatgctgctgtccatgaacagcctggaggccgtgaatgctggggtgcagcagaacaacacagagagctttgctgtggccctgtgccacctggccgagctgcacgccgagcagggctgctttgctgctgccagcgaggtgctgaagcacctgaaggagcgcttcccccccaacagccagcacgcccagctgtggatgctgtgtgaccagaagatccagtttgaccgggccatgaatgatggcaagtaccacctggccgacagcctggtgacaggcatcacagccctgaacagcattgaaggagtgtacaggaaggctgtggtgctgcaggcccagaaccagatgtctgaggcccacaagctgctgcagaagctgctggtgcactgccagaagctgaagaacacagagatggtgatctctgtgctgctgtctgtggccgagctgtactggaggagcagcagccccaccatcgccctgcccatgctgctgcaggccctggccctgagcaaggagtaccgcctgcagtacctggccagcgagaccgtgctgaacctggcctttgcccagctgatcctgggcatccctgagcaggccctgagcctgctgcacatggccatcgagcccatcctggctgatggagccatcctggacaagggccgggccatgttcctggtggccaagtgccaggtggccagcgctgccagctatgaccagcccaagaaggccgaggccctggaggccgccatcgagaacctgaatgaggccaagaactactttgccaaggtggactgcaaggagcgcatcagagatgtggtgtacttccaggcccggctgtaccacaccctgggcaagacccaggagaggaacagatgtgccatgctgttccggcagctgcaccaggagctgcccagccatggagtgcccctcatcaaccacctgtag

SEQ ID NO: 143558 - DNA, 1932 bp, Artificial Sequence; identical to SEQ ID NO: 143557
  Description of Artificial Sequence: Synthetic coding sequence

SEQ ID NO: 143559 - DNA, 660 bp, Artificial Sequence
  Description of Artificial Sequence: Synthetic coding sequence
atgctgagcccctgcctgagcagctactttgtgggcctcttcctgcggcacatgatcctggcctacagcaagctgtccttcagccaggtgttcaagctgtacacagccctgcagcagtacttccagaatggagagaagaagacagtggaggatgctgacatggagctgaccagcagagatgaaggagagaggaagatggagaaggaggagctggatgtgtctgtgcgggaggaggaggtgtcctgcagcggccccctgagccagaagcaggccgagttcttcctgagccagcaggccagcctgctgaagaatgatgagaccaaggccctgaccccagccagcctgcagaaggagctgaacaacctgctgaagttcaacccagactttgctgaggcccactacctgagctacctgaacaacctgcgggtgcaggatgtgttcagcagcacccacagcctgctgcactactttgacaggctcatcctgactggagctgagagcaagagcaatggagaggagggctacggccgcagcctgcgctatgctgccctgaacctggccgccctgcactgccgcttcggccactacaccagccccccctgggagtacagccccctcttcaaccgggagctgctgctgggccggcggcagaccagctag

SEQ ID NO: 143560 - DNA, 135 bp, Artificial Sequence
  Description of Artificial Sequence: Synthetic coding sequence
atggccgagggggagctgaaggacatggagcagttctttgatgacctgagtgacagcttctctggaacagagcctgaggtgcacaagacctctgtggtgggcctcttcctgcggcacatgatcctggcctactag

SEQ ID NO: 143561 - DNA, 1074 bp, Artificial Sequence
  Description of Artificial Sequence: Synthetic coding sequence
atggatgccctgaaggacagcgacctgctgcactggaagcacagcctgtctgagctgattgacatcagcatcgcccagaagacagccatctggaggctgtatggccgcagcaccatggccctgcagcaggcccagatgctgctgtccatgaacagcctggaggccgtgaatgctggggtgcagcagaacaacacagagagctttgctgtggccctgtgccacctggccgagctgcacgccgagcagggctgctttgctgctgccagcgaggtgctgaagcacctgaaggagcgcttcccccccaacagccagcacgcccagctgtggatgctgtgtgaccagaagatccagtttgaccgggccatgaatgatggcaagtaccacctggccgacagcctggtgacaggcatcacagccctgaacagcattgaaggagtgtacaggaaggctgtggtgctgcaggcccagaaccagatgtctgaggcccacaagctgctgcagaagctgctggtgcactgccagaagctgaagaacacagagatggtgatctctgtgctgctgtctgtggccgagctgtactggaggagcagcagccccaccatcgccctgcccatgctgctgcaggccctggccctgagcaaggagtaccgcctgcagtacctggccagcgagaccgtgctgaacctggcctttgcccagctgatcctgggcatccctgagcaggccctgagcctgctgcacatggccatcgagcccatcctggctgatggagccatcctggacaagggccgggccatgttcctggtggccaagtgccaggtggccagcgctgccagctatgaccagcccaagaaggccgaggccctggaggccgccatcgagaacctgaatgaggccaagaactactttgccaaggtggactgcaaggagcgcatcagagatgtggtgtacttccaggcccggctgtaccacaccctgggcaagacccaggagaggaacagatgtgccatgctgttccggcagctgcaccaggagctgcccagccatggagtgcccctcatcaaccacctgtag

SEQ ID NO: 143562 - DNA, 2229 bp, Artificial Sequence
  Description of Artificial Sequence: Synthetic coding sequence
atggcctctgtgcatgagagcctgtacttcaaccccatgatgaccaacggggtggtgcacgccaacgtgtttggcatcaaggactgggtgaccccctacaagattgctgtgctggtgctgctgaatgagatgagcaggactggagagggcgctgtgtccctgatggagcggcggcggctgaaccagctgctgctgcccctgctgcagggccctgacatcaccctgagcaagctgtacaagctgattgaggagagctgcccccagctggccaacagcgtgcagatccgcatcaagctgatggccgagggggagctgaaggacatggagcagttctttgatgacctgagtgacagcttcagcggcacagagcctgaggtgcacaagacctctgtggtgggcctcttcctgcggcacatgatcctggcctacagcaagctgtccttcagccaggtgttcaagctgtacacagccctgcagcagtacttccagaatggagagaagaagacagtggaggatgctgacatggagctgaccagcagagatgaaggagagaggaagatggagaaggaggagctggatgtgtctgtgcgggaggaggaggtgtcctgcagcggccccctgagccagaagcaggccgagttcttcctgagccagcaggccagcctgctgaagaatgatgagaccaaggccctgaccccagccagcctgcagaaggagctgaacaacctgctgaagttcaacccagactttgctgaggcccactacctgagctacctgaacaacctgcgggtgcaggatgtgttcagcagcacccacagcctgctgcactactttgacaggctcatcctgaccggggctgagagcaagagcaatggagaggagggctacggccgcagcctgcgctatgctgccctgaacctggccgccctgcactgccgcttcggccactaccagcaggccgagctggccctgcaggaggccatccgcatcgcccaggagagcaatgaccacgtgtgcctgcagcactgcctgtcctggctgtatgtgctgggccagaagagaagtgacagctatgtgctgctggagcacagcgtgaagaaggctgtgcacttcggcctgccccgggcctttgctgggaagacagccaacaagctgatggatgccctgaaggacagcgacctgctgcactggaagcacagcctgtctgagctgattgacatcagcatcgcccagaagacagccatctggaggctgtatggccgcagcaccatggccctgcagcaggcccagatgctgctgtccatgaacagcctggaggccgtgaatgccggcgtgcagcagaacaacacagagagctttgctgtggccctgtgccacctggccgagctgcatgctgagcagggctgctttgctgctgccagcgaggtgctgaagcacctgaaggagcgcttcccccccaacagccagcacgcccagctgtggatgctgtgtgaccagaagatccagtttgaccgggccatgaatgatggcaagtaccacctggccgacagcctggtgacaggcatcacagccctgaacagcattgagggcgtgtacaggaaggctgtggtgctgcaggcccagaaccagatgtctgaggcccacaagctgctgcagaagctgctggtgcactgccagaagctgaagaacacagagatggtgatctctgtgctgctgtctgtggccgagctgtactggaggagcagcagccccaccatcgccctgcccatgctgctgcaggccctggccctgagcaaggagtaccgcctgcagtacctggccagcgagaccgtgctgaacctggcctttgcccagctgatcctgggcatccctgagcaggccctgagcctgctgcacatggccatcgagcccatcctggctgatggagccatcctggacaagggccgggccatgttcctggtggccaagtgccaggtggccagcgctgccagctatgaccagcccaagaaggccgaggccctggaggccgccatcgagaacctgaatgaggccaagaactactttgccaaggtggactgcaaggagcgcatcagagatgtggtgtacttccaggcccggctgtaccacaccctgggcaagacccaggagaggaacagatgtgccatgctgttccggcagctgcaccaggagctgcccagccacggcgtgcccctcatcaaccacctgtag

SEQ ID NO: 143563 - DNA, 1425 bp, Artificial Sequence
  Description of Artificial Sequence: Synthetic coding sequence
atggagctgcccagcggccctggccctgagcggctgtttgacagccaccggctgcccggggactgcttcctgctgctggtgctgctgctgtatgcccctgtgggcttctgcctgctggtgctgcggctcttcctgggcatccacgtgttcctggtgtcctgtgccctgcctgattctgtgctgcggagatttgtggtgaggaccatgtgtgctgtgctgggcctggtggcccggcaggaggacagcggcctgcgggaccacagcgtgcgggtgctgatcagcaaccacgtgaccccatttgaccacaacatcgtgaacctgctgaccacctgcagcacagtgtctgagagcgaggccgagagcgccaccggccgcttccctggggcccagctgaaggcccccctgagccccctggccttccccatggaggacacagagctgcccctgacccccatcctgtaccccacctgccagttcttcttcatcttcctgaacatcttcctgctggccttcagcagccctggcagccagcccctgctgaacagccccccatcctttgtgtgctggagccggggcttcatggagatgaatggccgcggggagctggtggagagcctgaagcgcttctgtgccagcacccggctgccccccacccccctgctgctcttccctgaggaggaggccaccaacggccgggagggcctgctgcgcttcagctcctggcccttcagcatccaggatgtggtgcagcccctgaccctgcaggtgcagaggcccctggtgtctgtgacagtgtctgatgcctcctgggtgtctgagctgctgtggagcctgtttgtgcccttcaccgtgtaccaggtgcgctggctgcggcctgtgcaccggcagctgggggaggccaatgaggagtttgccctgcgggtgcagcagctggtggccaaggagctgggccagacaggcacccggctgaccccagctgacaaggccgagcacatgaagaggcagaggcacccccggctgcggccccagagcgcccagagcagcttcccccccagccctggccccagcccagatgtgcagctggccaccctggcccagagggtgaaggaggtgctgccccacgtgcccctgggcgtcatccagagggacctggccaagacaggctgtgtggacctgaccatcaccaacctgctggagggcgctgtggccttcatgcctgaggacatcaccaagggcacccagagcctgcccacagccagcgccagcaagttccccagcagcggccctgtgaccccccagcccacagccctgacctttgccaagagctcctgggcccggcaggagagcctgcaggagaggaagcaggccctgtatgaatatgcccggcggcgcttcacagagcggcgggcccaggaggccgactag

SEQ ID NO: 143564 - DNA, 1233 bp, Artificial Sequence
  Description of Artificial Sequence: Synthetic coding sequence
atggagctgcccagcggccctggccctgagcggctgtttgacagccaccggctgcccggggactgcttcctgctgctggtgctgctgctgtatgcccctgtgggcttctgcctgctggtgctgcggctcttcctgggcatccacgtgttcctggtgtcctgtgccctgcctgattctgtgctgcggagatttgtggtgaggaccatgtgtgctgtgctgggcctggtggcccggcaggaggacagcggcctgcgggaccacagcgtgcgggtgctgatcagcaaccacgtgaccccatttgaccacaacatcgtgaacctgctgaccacctgcagcacccccctgctgaacagccccccatcctttgtgtgctggagccggggcttcatggagatgaatggccgcggggagctggtggagagcctgaagcgcttctgtgccagcacccggctgccccccacccccctgctgctcttccctgaggaggaggccaccaacggccgggagggcctgctgcgcttcagctcctggcccttcagcatccaggatgtggtgcagcccctgaccctgcaggtgcagaggcccctggtgtctgtgacagtgtctgatgcctcctgggtgtctgagctgctgtggagcctgtttgtgcccttcaccgtgtaccaggtgcgctggctgcggcctgtgcaccggcagctgggggaggccaatgaggagtttgccctgcgggtgcagcagctggtggccaaggagctgggccagacaggcacccggctgaccccagctgacaaggccgagcacatgaagaggcagaggcacccccggctgcggccccagagcgcccagagcagcttcccccccagccctggccccagcccagatgtgcagctggccaccctggcccagagggtgaaggaggtgctgccccacgtgcccctgggcgtcatccagagggacctggccaagacaggctgtgtggacctgaccatcaccaacctgctggagggcgctgtggccttcatgcctgaggacatcaccaagggcacccagagcctgcccacagccagcgccagcaagttccccagcagcggccctgtgaccccccagcccacagccctgacctttgccaagagctcctgggcccggcaggagagcctgcaggagaggaagcaggccctgtatgaatatgcccggcggcgcttcacagagcggcgggcccaggaggccgactag

SEQ ID NO: 143565 - DNA, 1128 bp, Artificial Sequence
  Description of Artificial Sequence: Synthetic coding sequence
atggagctgcccagcggccctggccctgagcggctgtttgacagccaccggctgcccggggactgcttcctgctgctggtgctgctgctgtatgcccctgtgggcttctgcctgctggtgctgcggctcttcctgggcatccacgtgttcctggtgtcctgtgccctgcctgattctgtgctgcggcgcttccgctttgtggtgaggaccatgtgtgctgtgctgggcctggtggcccggcaggaggacagcggcctgcgggaccacagcgtgcgggtgctgatcagcaaccacgtgaccccatttgaccacaacatcgtgaacctgctgaccacctgcagcacccccctgctgaacagccccccatcctttgtgtgctggagccggggcttcatggagatgaatggccgcggggagctggtggagagcctgaagcgcttctgtgccagcacccggctgccccccacccccctgctgctcttccctgaggaggaggccaccaacggccgggagggcctgctgcgcttcagctcctggcccttcagcatccaggatgtggtgcagcccctgaccctgcaggtgcagaggcccctggtgtctgtgacagtgtctgatgcctcctgggtgtctgagctgctgtggagcctgtttgtgcccttcaccgtgtaccaggtgcgctggctgcggcctgtgcaccggcagctgggggaggccaatgaggagtttgccctgcgggtgcagcagctggtggccaaggagctgggccagacaggcacccggctgaccccagctgacaaggccgagcacatgaagaggcagaggcacccccggctgcggccccagagcgcccagagcagcttcccccccagccctggccccagcccagatgtgcagctggccaccctggcccagagggtgaaggaggtgctgccccacgtgcccctgggcgtcatccagagggacctggccaagacaggctgtgtggacctgaccatcaccaacctgctggagggcgctgtggccttcatgcctgaggacatcaccaagggcacccagagcctgcccacagccagcgccagcaaggcctttgatgcctgcctgatgatgatgaccccccaggccctgtag

SEQ ID NO: 143566 - DNA, 2145 bp, Artificial Sequence
  Description of Artificial Sequence: Synthetic coding sequence
atggccagcgaggcccccagcccccccaggagccccccaccacccaccagccctgagcctgagctggcccagctgcggaggaaggtggagaagctggagcgggagctgcggagctgcaagaggcaggtgcgggagattgagaagctgctgcaccacacagagcggctgtaccagaatgctgagagcaacaaccaggagctgcggacccaggtggaggagctgagcaagatcctgcagagaggaagaaatgaagacaacaagaagagtgatgtggaggtgcagacagagaaccacgccccctggagcatcagtgactacttctaccagacctactacaatgatgtgtccctgcccaacaaggtgacagagctgagtgaccagcaggaccaggccatcgagaccagcatcctgaacagcaaggaccacctgcaggtggagaatgatgcctacccaggcacagacagaacagaaaatgtgaagtaccggcaggtggaccactttgccagcaacagccaggagcccgccagcgccctggccacagaggacaccagcctggagggcagcagcctggccgagagcctgcgggctgctgctgaggccgctgtgtcccagacaggcttctcctatgatgaaaatacaggcctgtactttgaccacagcacaggcttctactatgattctgagaaccagctgtactatgaccccagcacaggcatctactactactgtgatgtggagagcggccgctaccagttccacagccgggtggacctgcagccctaccccaccagcagcaccaagcagagcaaggacaagaagctgaagaagaagaggaaggaccctgacagcagcgccaccaatgaggagaaggacctgaacagcgaggaccagaaggccttctctgtggagcacaccagctgcaatgaggaggagaactttgccaacatgaagaagaaggccaagattggcatccaccacaagaacagcccccccaaggtgacagtgcccaccagcggcaacaccatcgagagccccctgcacgagaacatcagcaacagcaccagcttcaaggatgagaagatcatggagacagacagcgagcctgaggagggggagatcacagacagccagacagaagattcctatgatgaggccatcaccagcgagggcaatgtgacagcagaagattctgaagatgaagatgaggacaagatctggccaccctgcatccgggtgattgtcatccgcagccctgtgctgcagatcggcagcctcttcatcatcacagctgtgaacccagccaccatcggccgggagaaggacatggagcacaccctgcgcatccctgaggtgggcgtgtccaagttccacgccgagatctactttgaccatgacctgcagagctatgtgctggtggaccagggcagccagaatggcaccatcgtgaatggcaagcagatcctgcagcccaagaccaagtgtgacccctacgtgctggagcacggagatgaggtgaagattggagagaccgtgctgtccttccacatccaccctggcagtgacacctgtgatggctgtgagcccggccaggtgcgggcccacctgcggctggacaagaaggatgagagctttgtgggccccaccctgagcaaggaggagaaggagctggagaggaggaaggagctgaagaagatccgggtgaagtatggcctgcagaacacagaatatgaagatgagaagaccctgaagaaccccaagtacaaggacagagctgggaagaggcgggagcaggtgggcagcgagggcaccttccagagagatgatgccccagcctctgtgcacagcgagatcacagacagcaacaagggcaggaagatgctggagaagatgggctggaagaagggggagggcctgggcaaggatggcggcggcatgaagacccccatccagctgcagctgcggaggacccacgccggcctgggcaccgggaagcccagcagctttgaagatgtgcacctgctgcagaacaagaacaagaagaactgggacaaggcccgggagcgcttcacagagaacttccctgagaccaagccccagaaggatgatcctggcaccatgccctgggtgaagggcaccctggagtag

SEQ ID NO: 143567 - DNA, 531 bp, Artificial Sequence
  Description of Artificial Sequence: Synthetic coding sequence
atggccagcgaggcccccagcccccccaggagccccccaccacccaccagccctgagcctgagctggcccagctgcggaggaaggtggagaagctggagcgggagctgcggagctgcaagaggcaggtgcgggagattgagaagctgctgcaccacacagagcggctgtaccagaatgctgagagcaacaaccaggagctgcggacccaggtggaggagctgagcaagatcctgcagagaggaagaaatgaagacaacaagaagagtgatgtggaggtgcagacagagaaccacgccccctggagcatcagtgactacttctaccagacctactacaatgatgtgtccctgcccaacaaggtgacagagctgagtgaccagcaggaccaggccatcgagaccagcatcctgaacagcaaggaccacctgcaggtggagaatgatgcctacccaggcacagacagaacagaaaatgtgaagtaccggcaggtggaccactttgccagcaacagccaggtgatcaagtgctag

SEQ ID NO: 143568 - DNA, 2028 bp, Artificial Sequence
  Description of Artificial Sequence: Synthetic coding sequence
atgccccgggcccagcccagcagcgccagctaccagcctgtgcctgctgacccctttgccatcgtgtcccgggcccagcagatggtggagatcctgagtgatgaaaatagaaacctgcggcaggagctggagggctgctatgagaaggtggcccggctgcagaaggtggagacagagatccagagggtgtctgaggcctatgagaacctggtgaagagcagcagcaagcgggaggccctggagaaggccatgaggaacaagctggagggggagatccggaggatgcatgacttcaacagagacctgcgggagcggctggagacagccaacaagcagctggccgagaaggagtatgagggcagcgaggacaccaggaagaccatcagccagctgtttgccaagaacaaggagagccagcgggagaaggagaagctggaggccgagctggccacagcccggagcaccaatgaagaccagaggaggcacatcgagatccgggaccaggccctgagcaatgcccaggccaaggtggtgaagctggaggaggagctgaagaagaagcaggtgtatgtggacaaggtggagaagatgcagcaggccctggtgcagctgcaggccgcctgtgagaagcgggagcagctggagcaccggctgcggacccggctggagcgggagctggagagcctgcgcatccagcagaggcagggcaactgccagcccaccaacgtgtctgagtacaatgctgctgccctgatggagctgctgcgggagaaggaggagcgcatcctggccctggaggccgacatgaccaagtgggagcagaagtacctggaggagaatgtgatgaggcactttgccctggatgctgctgccaccgtggccgcccagagggacaccaccgtcatcagccacagccccaacaccagctatgacacagccctggaggcccgcatccagaaggaggaggaggagatcctgatggccaacaagcgctgcctggacatggagggccgcatcaagaccctgcacgcccagatcatcgagaaggatgccatgatcaaggtgctgcagcagaggagcaggaaggagcccagcaagacagagcagctgagctgcatgaggcctgccaagagcctgatgagcatcagcaatgccggcagcggcctgctgagccacagcagcaccctgaccggcagccccatcatggaggagaagagagatgacaagtcctggaagggcagcctgggcatcctgctgggcggggactacagagcagaatatgtgcccagcacccccagccctgtgccccccagcacccccctgctgagcgcccacagcaagacaggcagccgggactgcagcacccagacagagcggggcacagagagcaacaagacagctgctgtggcccccatctctgtgcctgcccctgtggccgctgctgccacagctgctgccatcacagccacagctgccaccatcaccaccaccatggtggccgccgcccctgtggccgtggccgctgctgctgccccagctgctgctgctgcccccagccctgccacagctgctgccacagctgctgctgtgtccccagctgctgctggccagatcccagctgctgcctctgtggccagcgctgctgctgtggcccccagcgctgctgctgctgctgctgtgcaggtggccccagctgccccagcccctgtgcctgccccagccctggtgcctgtgcctgccccagctgctgcccaggccagcgccccagcccagacccaggcccccaccagcgccccagctgtggcccccaccccagcccccacccccaccccagctgtggcccaggccgaggtgcctgccagccctgccaccggccctggcccccaccggctgagcatccccagcctgacctgcaacccagacaagacagatggccctgtgttccacagcaacaccctggagaggaagacccccatccagatcctgggccaggagccagatgctgagatggtggagtacctgatctag

SEQ ID NO: 143569 - DNA, 1794 bp, Artificial Sequence
  Description of Artificial Sequence: Synthetic coding sequence
atggagcaccggggccccccacctgagtaccccttcaagggcatgccaccccagagcgtggtgtgcaagccccaggagcccggccacttctacagcgagcaccggctgaaccagcccggccgcacagagggccagctgatgagataccagcaccccccagaatatggagctgcccggcctgcccaggacatcagcctgcccctgagcgccaggaacagccagccccacagccccaccagcagcctgaccagcggcggcagcctgcccctgctgcagagcccccccagcacccggctgagccctgcccggcaccccctggtgcccaaccagggcgaccacagcgcccacctgccccggccccagcagcacttcctgcccaaccaggcccaccagggcgaccactaccgcctgagccagcccggcctgagccagcagcagcagcagcagcagcagcagcaccaccaccaccaccaccaccagcagcagcagcagcagcagccccagcagcagcctggagaggcctacagcgccatgccccgggcccagcccagcagcgccagctaccagcctgtgcctgctgacccctttgccatcgtgtcccgggcccagcagatggtggagatcctgagtgatgagaacagaaacctgcggcaggagctggagggctgctatgagaaggtggcccggctgcagaaggtggagacagagatccagagggtgtctgaggcctatgagaacctggtgaagagcagcagcaagcgggaggccctggagaaggccatgaggaacaagctggagggggagatccggaggatgcatgacttcaacagagacctgcgggagcggctggagacagccaacaagcagctggccgagaaggagtatgagggcagcgaggacaccaggaagaccatcagccagctgtttgccaagaacaaggagagccagcgggagaaggagaagctggaggccgagctggccacagcccggagcaccaatgaagaccagaggaggcacatcgagatccgggaccaggccctgagcaatgcccaggccaaggtggtgaagctggaggaggagctgaagaagaagcaggtgtatgtggacaaggtggagaagatgcagcaggccctggtgcagctgcaggccgcctgtgagaagcgggagcagctggagcaccggctgcggacccggctggagcgggagctggagagcctgcgcatccagcagaggcagggcaactgccagcccaccaacgtgtctgagtacaatgctgctgccctgatggagctgctgcgggagaaggaggagcgcatcctggccctggaggccgacatgaccaagtgggagcagaagtacctggaggagaatgtgatgaggcactttgccctggatgctgctgccaccgtggccgcccagagggacaccaccgtcatcagccacagccccaacaccagctatgacacagccctggaggcccgcatccagaaggaggaggaggagatcctgatggccaacaagcgctgcctggacatggagggccgcatcaagaccctgcacgcccagatcatcgagaaggatgccatgatcaaggtgctgcagcagaggagcaggaaggagcccagcaagacagagcagctgagctgcatgaggcctgccaagagcctgatgagcatcagcaatgccggcagcggcctgctgagccacagcagcaccctgaccggcagccccatcatggaggagaagagagatgacaagtcctggaagggcagcctgggcaatgacagcaagtag

SEQ ID NO: 143570 - DNA, 3255 bp, Artificial Sequence
  Description of Artificial Sequence: Synthetic coding sequence
atgaggaacagcgaggagcagcccagcggcggcaccaccgtgctgcagaggctgctgcaggagcagctgcgctatggcaaccccagcgagaacagaagcctgctggccatccaccagcaggccactggaaatggcccccccttccccagcggcagcggcaaccctggcccccagagtgatgtgctgagcccccaggaccaccaccagcagctggtggcccatgctgcccggcaggagccccagggccaggagatccagagcgagaacctgatcatggagaagcagctgagccccaggatgcagaacaatgaggagctgcccacctatgaggaggccaaggtgcagagccagtacttccggggccagcagcacgcctctgtgggcgccgccttctacgtgactggagtgaccaaccagaagatgaggacagagggccggcccagcgtgcagaggctgaaccctgggaagatgcaccaggatgagggcctgcgggacctgaagcagggccacgtgcgcagcctgtctgagcggctgatgcagatgagcctggccaccagcggcgtgaaggcccacccccctgtgaccagcgcccccctgagccccccccagcccaatgacctgtacaagaaccccaccagcagcagcgagttctacaaggcccagggccccctgcccaaccagcacagcctgaagggcatggagcaccggggccccccacctgagtaccccttcaagggcatgccaccccagagcgtggtgtgcaagccccaggagcccggccacttctacagcgagcaccggctgaaccagcccggccgcacagagggccagctgatgagataccagcaccccccagaatatggagctgcccggcctgcccaggacatcagcctgcccctgagcgccaggaacagccagccccacagccccaccagcagcctgaccagcggcggcagcctgcccctgctgcagagcccccccagcacccggctgagccctgcccggcaccccctggtgcccaaccagggcgaccacagcgcccacctgccccggccccagcagcacttcctgcccaaccaggcccaccagggcgaccactaccgcctgagccagcccggcctgagccagcagcagcagcagcagcagcagcagcaccaccaccaccaccaccaccagcagcagcagcagcagcagccccagcagcagcctggagaggcctacagcgccatgccccgggcccagcccagcagcgccagctaccagcctgtgcctgctgacccctttgccatcgtgtcccgggcccagcagatggtggagatcctgagtgatgagaacagaaacctgcggcaggagctggagggctgctatgagaaggtggcccggctgcagaaggtggagacagagatccagagggtgtctgaggcctatgagaacctggtgaagagcagcagcaagcgggaggccctggagaaggccatgaggaacaagctggagggggagatccggaggatgcatgacttcaacagagacctgcgggagcggctggagacagccaacaagcagctggccgagaaggagtatgagggcagcgaggacaccaggaagaccatcagccagctgtttgccaagaacaaggagagccagcgggagaaggagaagctggaggccgagctggccacagcccggagcaccaatgaagaccagaggaggcacatcgagatccgggaccaggccctgagcaatgcccaggccaaggtggtgaagctggaggaggagctgaagaagaagcaggtgtatgtggacaaggtggagaagatgcagcaggccctggtgcagctgcaggccgcctgtgagaagcgggagcagctggagcaccggctgcggacccggctggagcgggagctggagagcctgcgcatccagcagaggcagggcaactgccagcccaccaacgtgtctgagtacaatgctgctgccctgatggagctgctgcgggagaaggaggagcgcatcctggccctggaggccgacatgaccaagtgggagcagaagtacctggaggagaatgtgatgaggcactttgccctggatgctgctgccaccgtggccgcccagagggacaccaccgtcatcagccacagccccaacaccagctatgacacagccctggaggcccgcatccagaaggaggaggaggagatcctgatggccaacaagcgctgcctggacatggagggccgcatcaagaccctgcacgcccagatcatcgagaaggatgccatgatcaaggtgctgcagcagaggagcaggaaggagcccagcaagacagagcagctgagctgcatgaggcctgccaagagcctgatgagcatcagcaatgccggcagcggcctgctgagccacagcagcaccctgaccggcagccccatcatggaggagaagagagatgacaagtcctggaagggcagcctgggcatcctgctgggcggggactacagagcagaatatgtgcccagcacccccagccctgtgccccccagcacccccctgctgagcgcccacagcaagacaggcagccgggactgcagcacccagacagagcggggcacagagagcaacaagacagctgctgtggcccccatctctgtgcctgcccctgtggccgccgccgccacagctgctgccatcacagccacagctgccaccatcaccaccaccatggtggccgccgcccctgtggccgtggccgctgctgctgccccagctgctgctgctgcccccagccctgccacagctgctgccacagctgctgctgtgtccccagctgctgctggccagatcccagctgctgcctctgtggccagcgctgctgctgtggcccccagcgctgctgctgctgctgctgtgcaggtggccccagctgccccagcccctgtgcctgccccagccctggtgcctgtgcctgccccagctgctgcccaggccagcgccccagcccagacccaggcccccaccagcgccccagctgtggcccccaccccagcccccacccccaccccagctgtggcccaggccgaggtgcctgccagccctgccactggacctggcccccaccggctgagcatccccagcctgacctgcaacccagacaagacagatggccctgtgttccacagcaacaccctggagaggaagacccccatccagatcctgggccaggagccagatgctgagatggtggagtacctgatctag

SEQ ID NO: 143571 - DNA, 2559 bp, Artificial Sequence
  Description of Artificial Sequence: Synthetic coding sequence
atggagcaccggggccccccacctgagtaccccttcaagggcatgccaccccagagcgtggtgtgcaagccccaggagcccggccacttctacagcgagcaccggctgaaccagcccggccgcacagagggccagctgatgagataccagcaccccccagaatatggagctgcccggcctgcccaggacatcagcctgcccctgagcgccaggaacagccagccccacagccccaccagcagcctgaccagcggcggcagcctgcccctgctgcagagcccccccagcacccggctgagccctgcccggcaccccctggtgcccaaccagggcgaccacagcgcccacctgccccggccccagcagcacttcctgcccaaccaggcccaccagggcgaccactaccgcctgagccagcccggcctgagccagcagcagcagcagcagcagcagcagcaccaccaccaccaccaccaccagcagcagcagcagcagcagccccagcagcagcctggagaggcctacagcgccatgccccgggcccagcccagcagcgccagctaccagcctgtgcctgctgacccctttgccatcgtgtcccgggcccagcagatggtggagatcctgagtgatgagaacagaaacctgcggcaggagctggagggctgctatgagaaggtggcccggctgcagaaggtggagacagagatccagagggtgtctgaggcctatgagaacctggtgaagagcagcagcaagcgggaggccctggagaaggccatgaggaacaagctggagggggagatccggaggatgcatgacttcaacagagacctgcgggagcggctggagacagccaacaagcagctggccgagaaggagtatgagggcagcgaggacaccaggaagaccatcagccagctgtttgccaagaacaaggagagccagcgggagaaggagaagctggaggccgagctggccacagcccggagcaccaatgaagaccagaggaggcacatcgagatccgggaccaggccctgagcaatgcccaggccaaggtggtgaagctggaggaggagctgaagaagaagcaggtgtatgtggacaaggtggagaagatgcagcaggccctggtgcagctgcaggccgcctgtgagaagcgggagcagctggagcaccggctgcggacccggctggagcgggagctggagagcctgcgcatccagcagaggcagggcaactgccagcccaccaacgtgtctgagtacaatgctgctgccctgatggagctgctgcgggagaaggaggagcgcatcctggccctggaggccgacatgaccaagtgggagcagaagtacctggaggagaatgtgatgaggcactttgccctggatgctgctgccaccgtggccgcccagagggacaccaccgtcatcagccacagccccaacaccagctatgacacagccctggaggcccgcatccagaaggaggaggaggagatcctgatggccaacaagcgctgcctggacatggagggccgcatcaagaccctgcacgcccagatcatcgagaaggatgccatgatcaaggtgctgcagcagaggagcaggaaggagcccagcaagacagagcagctgagctgcatgaggcctgccaagagcctgatgagcatcagcaatgccggcagcggcctgctgagccacagcagcaccctgaccggcagccccatcatggaggagaagagagatgacaagtcctggaagggcagcctgggcatcctgctgggcggggactacagagcagaatatgtgcccagcacccccagccctgtgccccccagcacccccctgctgagcgcccacagcaagacaggcagccgggactgcagcacccagacagagcggggcacagagagcaacaagacagctgctgtggcccccatctctgtgcctgcccctgtggccgccgccgccacagctgctgccatcacagccacagctgccaccatcaccaccaccatggtggccgccgcccctgtggccgtggccgctgctgctgccccagctgctgctgctgcccccagccctgccacagctgctgccacagctgctgctgtgtccccagctgctgctggccagatcccagctgctgcctctgtggccagcgctgctgctgtggcccccagcgctgctgctgctgctgctgtgcaggtggccccagctgccccagcccctgtgcctgccccagccctggtgcctgtgcctgccccagctgctgcccaggccagcgccccagcccagacccaggcccccaccagcgccccagctgtggcccccaccccagcccccacccccaccccagctgtggcccaggccgaggtgcctgccagccctgccactggacctggcccccaccggctgagcatccccagcctgacctgcaacccagacaagacagatggccctgtgttccacagcaacaccctggagaggaagacccccatccagatcctgggccaggagccagatgctgagatggtggagtacctgatctag

SEQ ID NO: 143572 - DNA, 549 bp, Artificial Sequence
  Description of Artificial Sequence: Synthetic coding sequence
atgatcaaggtgctgcagcagaggagcaggaaggagcccagcaagacagagcagctgagctgcatgaggcctgccaagagcctgatgagcatcagcaatgccggcagcggcctgctgagccacagcagcaccctgaccggcagccccatcatggaggagaagagagatgacaagtcctggaagggcagcctgggcatcctgctgggcggggactacagagcagaatatgtgcccagcacccccagccctgtgccccccagcacccccctgctgagcgcccacagcaagacaggcagccgggactgcagcacccagacagagcggggcacagagagcaacaagacagctgctgtggcccccatctctgtgcctgcccctgtggccgccgccgccacagctgctgccatcacagccacagctgccaccatcaccaccaccatggctgctgctgctgcccccagccctgccacagctgctgccacagctgctgctgtgtccccagctgctgctggccagatcccagctgctgcctctgtggccagcgcctag

SEQ ID NO: 143573 - DNA, 3255 bp, Artificial Sequence; identical to SEQ ID NO: 143570
  Description of Artificial Sequence: Synthetic coding sequence

SEQ ID NO: 143574 - DNA, 1512 bp, Artificial Sequence
  Description of Artificial Sequence: Synthetic coding sequence
atgctgagccagctggccatgctgcagggcagcctgctgctggtggtggccaccatgtctgtggcccagcagacccggcaggaggccgaccggggctgtgagaccctggtggtgcagcacggccactgcagctacaccttcctgctgcccaagtctgagccctgccccccaggccctgaggtgtcccgggacagcaacaccctgcagcgggagagcctggccaaccccctgcacctgggcaagctgcccacccagcaggtgaagcagctggagcaggccctgcagaacaacacccagtggctgaagaagctggagcgggccatcaagaccatcctgcggagcaagctggagcaggtgcagcagcagatggcccagaaccagacagcccccatgctggagctgggcaccagcctgctgaaccagaccacagcccagatcaggaagctgacagacatggaggcccagctgctgaaccagaccagcaggatggatgcccagatgcctgagaccttcctgagcaccaacaagctggagaaccagctgctgctgcagaggcagaagctgcagcagctgcagggccagaacagcgccctggagaagaggctgcaggccctggagaccaagcagcaggaggagctggccagcatcctgagcaagaaggccaagctgctgaacaccctgagccggcagagcgctgccctgaccaacatcgagcggggcctgcggggcgtgcgccacaacagcagcctgctgcaggaccagcagcacagcctgcggcagctgctggtgctgctgcggcacctggtgcaggagcgggccaatgccagcgccccagccttcatcatggccggggagcaggtgttccaggactgtgccgagatccagaggtctggggccagcgccagcggcgtgtacaccatccaggtgtccaatgccaccaagcccaggaaggtgttctgtgacctgcagagcagcggcggccgctggaccctcatccagaggcgggagaatggaacagtgaacttccagaggaactggaaggactacaagcagggctttggagaccctgctggggagcactggctgggcaatgaggtggtgcaccagctgacccggcgggccgcctacagcctgcgggtggagctgcaggactgggagggccacgaggcctatgcccagtatgagcacttccacctgggcagcgagaaccagctgtaccgcctgtctgtggtgggctacagcggcagcgctggccggcagagcagcctggtgctgcagaacaccagcttcagcaccctggacagcgacaatgaccactgcctgtgcaagtgtgcccaggtgatgtctgggggctggtggtttgatgcctgtggcctgagcaacctgaatggagtgtactaccacgccccagacaacaagtacaagatggatggcatccgctggcactacttcaagggccccagctacagcctgcgggccagcaggatgatgatccggcccctggacatctag

SEQ ID NO: 143575 - DNA, 1233 bp, Artificial Sequence
  Description of Artificial Sequence: Synthetic coding sequence
atgctgagccagctggccatgctgcagggcagcctgctgctggtggtggccaccatgtctgtggcccagcagacccggcaggaggccgaccggggctgtgagaccctggtggtgcagcacggccactgcagctacaccttcctgctgcccaagtctgagccctgccccccaggccctgaggtgtcccgggacagcaacaccctgcagcgggagagcctggccaaccccctgcacctgggcaagctgcccacccagcaggtgaagcagctggagcaggccctgcagaacaacacccagtggctgaagaagctggagcgggccatcaagaccatcctgcggagcaagctggagcaggtgcagcagcagatggcccagaaccagacagcccccatgctggagctgggcaccagcctgctgaaccagaccacagcccagatcaggaagctgacagacatggaggcccagctgctgaaccagaccagcaggatggatgcccagatgcctgagaccttcctgagcaccaacaagctggagaaccagctgctgctgcagaggcagaagctgcagcagctgcagggccagaacagcgccctggagaagaggctgcaggccctggagaccaagcagcaggaggagctggccagcatcctgagcaagaaggccaagctgctgaacaccctgagccggcagagcgctgccctgaccaacatcgagcggggcctgcggggcgtgcgccacaacagcagcctgctgcaggaccagcagcacagcctgcggcagctgctggtgctgctgcggcacctggtgcaggagcgggccaatgccagcgccccagccttcatcatggccggggagcaggtgttccaggactgtgccgagatccagaggtctggggccagcgccagcggcgtgtacaccatccaggtgtccaatgccaccaagcccaggaaggtgttctgtgacctgcagagcagcggcggccgctggaccctcatccagaggcgggagaatggaacagtgaacttccagaggaactggaaggactacaagcagggctttggagaccctgctggggagcactggctgggcaatgaggtggtgcaccagctgacccggcgggccgcctacagcctgcgggtggagctgcaggactgggagggccacgaggcctatgcccagtatgagcacttccacctgggcagcgagaaccagctgtacagagtggtggtgtag

SEQ ID NO: 143576 - DNA, 1383 bp, Artificial Sequence
  Description of Artificial Sequence: Synthetic coding sequence
atgttcaccatcaagctgctgctcttcatcgtgcccctggtgatcagcagcagaattgaccaggacaacagcagctttgacagcctgagccctgagcccaagagcagatttgccatgctggatgatgtgaagatcctggccaacggcctgctgcagctgggccacggcctgaaggactttgtgcacaagaccaagggccagatcaatgacatcttccagaagctgaacatctttgaccagagcttctatgacctgagcctgcagaccagcgagatcaaggaggaggagaaggagctgcggaggaccacctacaagctgcaggtgaagaatgaggaggtgaagaacatgagcctggagctgaacagcaagctggagagcctgctggaggagaagatcctgctgcagcagaaggtgaagtacctggaggagcagctgaccaacctgatccagaaccagcctgagaccccagagcaccctgaggtgaccagcctgaagacctttgtggagaagcaggacaacagcatcaaggacctgctgcagacagtggaggaccagtacaagcagctgaaccagcagcacagccagatcaaggagattgagaaccagctgcggaggaccagcatccaggagcccacagagatcagcctgagcagcaagccccgggcccccaggaccacccccttcctgcagctgaatgagatcagaaatgtgaagcatgatggcatcccagcagaatgtaccaccatctacaacagaggagagcacaccagcggcatgtatgccatccggcccagcaacagccaggtgttccacgtgtactgtgatgtgatcagcggcagcccctggaccctcatccagcacagaattgatggcagccagaacttcaatgagacctgggagaactacaagtatggcttcggccgcctggatggagagttctggctgggcctggagaagatctacagcatcgtgaagcagagcaactacgtgctgagaattgagctggaggactggaaggacaacaagcactacatcgagtacagcttctacctgggcaaccacgagaccaactacaccctgcacctggtggccatcactggaaatgtgcccaatgccatccctgagaacaaggacctggtgttcagcacctgggaccacaaggccaagggccacttcaactgcccagagggctacagcggcggctggtggtggcatgatgaatgtggggagaacaacctgaatggcaagtacaacaagccccgggccaagagcaagccagagaggagaagaggcctgtcctggaagagccagaatggccgcctgtacagcatcaagagcaccaagatgctgatccaccccacagacagcgagagctttgaatag

SEQ ID NO: 143577 - DNA, 1167 bp, Artificial Sequence
  Description of Artificial Sequence: Synthetic coding sequence
atgatgagccccagccaggccagcctgctcttcctgaatgtgtgcatcttcatctgtggggaggccgtgcagggcaactgtgtgcaccacagcacagacagctctgtggtgaacatcgtggaggatggcagcaatgccaaggatgagagcaagagcaatgacacagtgtgcaaggaggactgtgaggagagctgtgatgtgaagaccaagatcacccgggaggagaagcacttcatgtgcaggaacctgcagaacagcatcgtgtcctacaccaggagcaccaagaagctgctgaggaacatgatggatgagcagcaggccagcctggactacctgagcaaccaggtgaatgagctgatgaacagagtgctgctgctgaccacagaggtgttcaggaagcagctggaccccttcccccacaggcctgtgcagagccacggcctggactgcacagacatcaaggacaccatcggctctgtgaccaagaccccatctggcctgtacatcatccaccctgagggcagcagctacccctttgaggtgatgtgtgacatggactacagaggaggcggccgcaccgtcatccagaagagaattgatggcatcatcgacttccagaggctgtggtgtgactacctggatggctttggagacctgctgggggagttctggctgggcctgaagaagatcttctacatcgtgaaccagaagaacaccagcttcatgctgtatgtggccctggagagtgaagatgacaccctggcctatgccagctatgacaacttctggctggaggatgagacccgcttcttcaagatgcacctgggccgctacagcggaaatgctggagatgccttccggggcctgaagaaggaggacaaccagaatgccatgcccttcagcaccagtgatgtggacaatgatggctgcaggcctgcctgcctggtgaatggccagagcgtgaagagctgcagccacctgcacaacaagacaggctggtggttcaatgaatgtggcctggccaacctgaatggcatccaccacttcagcggcaagctgctggccaccggcatccagtggggcacctggaccaagaacaacagccctgtgaagatcaagtctgtgtccatgaagatccggaggatgtacaacccctacttcaagtag

SEQ ID NO: 143578 - DNA, 1413 bp, Artificial Sequence
  Description of Artificial Sequence: Synthetic coding sequence
atgggcaagccctggctgcgggccctgcagctgctgctgctgctgggcgcctcctgggcccgggccggggccccccgctgcacctacacctttgtgctgcccccccagaagttcaccggggctgtgtgctggagcggccctgccagcacccgggccaccccagaggccgccaatgccagcgagctggccgccctgaggatgagggtgggcagacatgaggagctgctgcgggagctgcagaggctggccgctgctgatggagctgtggccggggaggtgcgggccctgaggaaggagagccggggcctgagcgcccggctgggccagctgcgggcccagctgcagcacgaggccggccctggggccggccctggagctgacctgggcgctgagcctgctgctgccctggccctgctgggggagcgggtgctgaatgccagcgctgaggcccagagagctgctgcccgcttccaccagctggatgtgaagttccgggagctggcccagctggtgacccagcagagcagcctcatcgcccggctggagcggctgtgccctgggggcgccggcggccagcagcaggtgctgcccccaccacccctggtgcctgtggtgcctgtgcggctggtgggcagcaccagtgacaccagcaggatgctggaccctgcccctgagccccagagggaccagacccagaggcagcaggagcccatggccagccccatgcctgctggccaccctgctgtgcccaccaagcctgtgggcccctggcaggactgtgccgaggcccggcaggccggccacgagcagagcggcgtgtatgagctgcgggtgggcagacatgtggtgtctgtgtggtgtgagcagcagctggagggcggcggctggacagtcatccagaggcggcaggacggctctgtgaacttcttcaccacctggcagcactacaaggccggcttcggccgcccagatggagagtactggctgggcctggagcctgtgtaccagctgaccagcagaggagaccacgagctgctggtgctgctggaggactggggcggccgcggggcccgggcccactatgatggcttcagcctggagcctgagagtgaccactaccgcctgcggctgggccagtaccatggagatgctggggacagcctgtcctggcacaatgacaagcccttcagcacagtggaccgggaccgggacagctacagcggcaactgtgccctgtaccagaggggcggctggtggtaccacgcctgtgcccacagcaacctgaatggagtgtggcaccacggcggccactaccgcagccgctaccaggatggagtgtactgggccgagttccggggcggggcctacagcctgaggaaggccgccatgctgatccggcccctgaagctgtag

SEQ ID NO: 143579 - DNA, 2199 bp, Artificial Sequence
  Description of Artificial Sequence: Synthetic coding sequence
atgggccagggctgggccacagctggcctgcccagcctgctcttcctgctgctgtgctacggccaccccctgctggtgcccagccaggaggccagccagcaggtgacagtgacccacggcaccagcagccaggccaccaccagcagccagaccaccacccaccaggccacagcccaccagaccagcgcccagagccccaacctggtgacagatgaagctgaggccagcaagtttgtggaggagtatgacaggaccagccaggtggtgtggaatgaatatgcagaggccaactggaactacaacaccaacatcaccacagagaccagcaagatcctgctgcagaagaacatgcagatcgccaaccacaccctgaagtatggcacccaggccaggaagtttgatgtgaaccagctgcagaacaccaccatcaagaggatcatcaagaaggtgcaggacctggagcgggccgccctgcctgcccaggagctggaggagtacaacaagatcctgctggacatggagaccacctacagcgtggccaccgtgtgccaccccaacggcagctgcctgcagctggagccagacctgaccaacgtgatggccaccagcaggaaatatgaggacctgctgtgggcctgggagggctggagggacaaggccggccgggccatcctgcagttctaccccaagtatgtggagctgatcaaccaggccgcccggctgaatggctacgtggatgctggggacagctggaggtccatgtatgagacccccagcctggagcaggacctggagcggctcttccaggagctgcagcccctgtacctgaacctgcacgcctacgtgagaagagccctgcaccgccactacggggcccagcacatcaacctggagggccccatcccagcccacctgctgggcaacatgtgggcccagacctggagcaacatctatgacctggtggtgcccttccccagcgcccccagcatggacaccacagaggccatgctgaagcagggctggacccccaggaggatgttcaaggaggctgatgacttcttcaccagcctgggcctgctgcctgtgcccccagagttctggaacaagtccatgctggagaagcccacagatggccgggaggtggtgtgccacgccagcgcctgggacttctacaacgggaaggacttccgcatcaagcagtgcaccaccgtgaacctggaggacctggtggtggcccaccacgagatgggccacatccagtacttcatgcagtacaaggacctgcctgtggccctgcgggagggcgccaaccctggcttccacgaggccatcggagatgtgctggccctgtctgtgtccacccccaagcacctgcacagcctgaacctgctgagcagcgagggcggcagtgatgaacatgacatcaacttcctgatgaagatggccctggacaagatcgccttcatccccttctcctacctggtggaccagtggcgctggagggtgtttgatggcagcatcaccaaggagaactacaaccaggagtggtggagcctgcggctgaagtaccagggcctgtgcccccctgtgcccaggacccagggcgactttgatcctggggccaagttccacatccccagctctgtgccctacatccgctactttgtgtccttcatcatccagttccagttccacgaggccctgtgccaggccgccggccacacaggccccctgcacaagtgtgacatctaccagagcaaggaggccggccagaggctggccacagccatgaagctgggcttcagccggccctggccagaggccatgcagctgatcaccggccagcccaacatgtctgccagcgccatgctgagctacttcaagcccctgctggactggctgaggacagaaaatgagctgcatggagagaagctgggctggccccagtacaactggacccccaacagcgcccggtctgagggccccctgcctgacagcggccgggtgtccttcctgggcctggacctggatgcccagcaggcccgggtgggccagtggctgctgctcttcctgggcatcgccctgctggtggccaccctgggcctgagccagaggctcttcagcatccgccacaggagcctgcaccgccacagccacggcccccagtttggaagtgaggtggagctgcggcacagctag

SEQ ID NO: 143580 - DNA, 3921 bp, Artificial Sequence
  Description of Artificial Sequence: Synthetic coding sequence
atgggcgccgccagcggcagaagaggccctggcctgctgctgcccctgcccctgctgctgctgctgcccccccagcctgccctggccctggaccccggcctgcagcccggcaacttcagcgcagatgaggccggggcccagctgtttgcccagagctacaacagcagcgctgagcaggtgctcttccagagcgtggccgcctcctgggcccatgacaccaacatcacagcagaaaatgcccggcggcaggaggaggccgccctgctgagccaggagtttgctgaggcctggggccagaaggccaaggagctgtatgagcccatctggcagaacttcacagacccccagctgcggcgcatcattggagctgtgaggaccctgggcagcgccaacctgcccctggccaagaggcagcagtacaatgccctgctgagcaacatgagccgcatctacagcacagccaaggtgtgcctgcccaacaagacagccacctgctggagcctggaccctgacctgaccaacatcctggccagcagccgctcctatgccatgctgctgtttgcctgggagggctggcacaatgctgctggcatccccctgaagcccctgtatgaggacttcaccgccctgagcaatgaggcctacaagcaggacggcttcacagacacaggagcctactggaggtcctggtacaacagccccacctttgaagatgacctggagcacctgtaccagcagctggagcccctgtacctgaacctgcacgcctttgtgagaagagccctgcaccggcgctacggggaccgctacatcaacctgcggggccccatcccagcccacctgctgggggacatgtgggcccagagctgggagaacatctatgacatggtggtgcccttcccagacaagcccaacctggatgtgaccagcaccatgctgcagcagggctggaatgccacccacatgttccgggtggccgaggagttcttcaccagcctggagctgagccccatgcctcctgagttctgggagggctccatgctggagaagccagcagatggccgggaggtggtgtgccacgccagcgcctgggacttctacaacaggaaggacttccgcatcaagcagtgcaccagggtgaccatggaccagctgagcacagtgcaccacgagatgggccacatccagtactacctgcagtacaaggacctgcctgtgtccctgcggcggggggccaaccctggcttccacgaggccatcggagatgtgctggccctgtctgtgtccaccccagagcacctgcacaagattggcctgctggacagagtgaccaatgacacagaaagtgacatcaactacctgctgaagatggccctggagaagatcgccttcctgcccttcggctacctggtggaccagtggcgctggggcgtcttcagcggccgcaccccacccagccgctacaactttgactggtggtacctgcggaccaagtaccagggcatctgcccccctgtgaccagaaatgagacccactttgatgctggggccaagttccacgtgcccaacgtgaccccctacatccgctactttgtgtcctttgtgctgcagttccagttccacgaggccctgtgcaaggaggccggctatgagggccccctgcaccagtgtgacatctaccgcagcaccaaggccggggccaagctgaggaaggtgctgcaggccggcagcagccggccctggcaggaggtgctgaaggacatggtgggcctggatgccctggatgcccagcccctgctgaagtacttccagcctgtgacccagtggctgcaggagcagaaccagcagaatggagaggtgctgggctggccagagtaccagtggcacccccccctgcctgacaactacccagagggcatcgacctggtgacagatgaagctgaggccagcaagtttgtggaggagtatgacaggaccagccaggtggtgtggaatgaatatgcagaggccaactggaactacaacaccaacatcaccacagagaccagcaagatcctgctgcagaagaacatgcagatcgccaaccacaccctgaagtatggcacccaggccaggaagtttgatgtgaaccagctgcagaacaccaccatcaagaggatcatcaagaaggtgcaggacctggagcgggccgccctgcctgcccaggagctggaggagtacaacaagatcctgctggacatggagaccacctacagcgtggccaccgtgtgccaccccaacggcagctgcctgcagctggagccagacctgaccaacgtgatggccaccagcaggaaatatgaggacctgctgtgggcctgggagggctggagggacaaggccggccgggccatcctgcagttctaccccaagtatgtggagctgatcaaccaggccgcccggctgaatggctacgtggatgctggggacagctggaggtccatgtatgagacccccagcctggagcaggacctggagcggctcttccaggagctgcagcccctgtacctgaacctgcacgcctacgtgagaagagccctgcaccgccactacggggcccagcacatcaacctggagggccccatcccagcccacctgctgggcaacatgtgggcccagacctggagcaacatctatgacctggtggtgcccttccccagcgcccccagcatggacaccacagaggccatgctgaagcagggctggacccccaggaggatgttcaaggaggctgatgacttcttcaccagcctgggcctgctgcctgtgcccccagagttctggaacaagtccatgctggagaagcccacagatggccgggaggtggtgtgccacgccagcgcctgggacttctacaacgggaaggacttccgcatcaagcagtgcaccaccgtgaacctggaggacctggtggtggcccaccacgagatgggccacatccagtacttcatgcagtacaaggacctgcctgtggccctgcgggagggcgccaaccctggcttccacgaggccatcggagatgtgctggccctgtctgtgtccacccccaagcacctgcacagcctgaacctgctgagcagcgagggcggcagtgatgaacatgacatcaacttcctgatgaagatggccctggacaagatcgccttcatccccttctcctacctggtggaccagtggcgctggagggtgtttgatggcagcatcaccaaggagaactacaaccaggagtggtggagcctgcggctgaagtaccagggcctgtgcccccctgtgcccaggacccagggcgactttgatcctggggccaagttccacatccccagctctgtgccctacatccgctactttgtgtccttcatcatccagttccagttccacgaggccctgtgccaggccgccggccacacaggccccctgcacaagtgtgacatctaccagagcaaggaggccggccagaggctggccacagccatgaagctgggcttcagccggccctggccagaggccatgcagctgatcaccggccagcccaacatgtctgccagcgccatgctgagctacttcaagcccctgctggactggctgaggacagaaaatgagctgcatggagagaagctgggctggccccagtacaactggacccccaacagcgcccggtctgagggccccctgcctgacagcggccgggtgtccttcctgggcctggacctggatgcccagcaggcccgggtgggccagtggctgctgctcttcctgggcatcgccctgctggtggccaccctgggcctgagccagaggctcttcagcatccgccacaggagcctgcaccgccacagccacggcccccagtttggaagtgaggtggagctgcggcacagctag

SEQ ID NO: 143581 - DNA, 2076 bp, Artificial Sequence
  Description of Artificial Sequence: Synthetic coding sequence
atgggccagggctgggccacagctggcctgcccagcctgctcttcctgctgctgtgctacggccaccccctgctggtgcccagccaggaggccagccagcaggtgacagtgacccacggcaccagcagccaggccaccaccagcagccagaccaccacccaccaggccacagcccaccagaccagcgcccagagccccaacctggtgacagatgaagctgaggccagcaagtttgtggaggagtatgacaggaccagccaggtggtgtggaatgaatatgcagaggccaactggaactacaacaccaacatcaccacagagaccagcaagatcctgctgcagaagaacatgcagatcgccaaccacaccctgaagtatggcacccaggccaggaagtttgatgtgaaccagctgcagaacaccaccatcaagaggatcatcaagaaggtgcaggacctggagcgggccgccctgcctgcccaggagctggaggagtacaacaagatcctgctggacatggagaccacctacagcgtggccaccgtgtgccaccccaacggcagctgcctgcagctggagccagacctgaccaacgtgatggccaccagcaggaaatatgaggacctgctgtgggcctgggagggctggagggacaaggccggccgggccatcctgcagttctaccccaagtatgtggagctgatcaaccaggccgcccggctgaatggctacgtggatgctggggacagctggaggtccatgtatgagacccccagcctggagcaggacctggagcggctcttccaggagctgcagcccctgtacctgaacctgcacgcctacgtgagaagagccctgcaccgccactacggggcccagcacatcaacctggagggccccatcccagcccacctgctgggcaacatgtgggcccagacctggagcaacatctatgacctggtggtgcccttccccagcgcccccagcatggacaccacagaggccatgctgaagcagggctggacccccaggaggatgttcaaggaggctgatgacttcttcaccagcctgggcctgctgcctgtgcccccagagttctggaacaagtccatgctggagaagcccacagatggccgggaggtggtgtgccacgccagcgcctgggacttctacaacgggaaggacttccgcatcaagcagtgcaccaccgtgaacctggaggacctggtggtggcccaccacgagatgggccacatccagtacttcatgcagtacaaggacctgcctgtggccctgcgggagggcgccaaccctggcttccacgaggccatcggagatgtgctggccctgtctgtgtccacccccaagcacctgcacagcctgaacctgctgagcagcgagggcggcagtgatgaacatgacatcaacttcctgatgaagatggccctggacaagatcgccttcatccccttctcctacctggtggaccagtggcgctggagggtgtttgatggcagcatcaccaaggagaactacaaccaggagtggtggagcctgcggctgaagtaccagggcctgtgcccccctgtgcccaggacccagggcgactttgatcctggggccaagttccacatccccagctctgtgccctacatcagaacagccatgaagctgggcttcagccggccctggccagaggccatgcagctgatcaccggccagcccaacatgtctgccagcgccatgctgagctacttcaagcccctgctggactggctgaggacagaaaatgagctgcacggggagaagctgggctggccccagtacaactggacccccaacagcgcccggtctgagggccccctgcctgattctggccgggtgtccttcctgggcctggacctggatgcccagcaggcccgggtgggccagtggctgctgctcttcctgggcatcgccctgctggtggccaccctgggcctgagccagaggctcttcagcatccgccacaggagcctgcaccgccacagccacggcccccagtttggcagcgaggtggagctgcggcacagctag

SEQ ID NO: 143582 - DNA, 1536 bp, Artificial Sequence
  Description of Artificial Sequence: Synthetic coding sequence
atgcagatcgccaaccacaccctgaagtatggcacccaggccaggaagtttgatgtgaaccagctgcagaacaccaccatcaagaggatcatcaagaaggtgcaggacctggagcgggccgccctgcctgcccaggagctggaggagtacaacaagatcctgctggacatggagaccacctacagcgtggccaccgtgtgccaccccaacggcagctgcctgcagctggagccagacctgaccaacgtgatggccaccagcaggaaatatgaggacctgctgtgggcctgggagggctggagggacaaggccggccgggccatcctgcagttctaccccaagtatgtggagctgatcaaccaggccgcccggctgaatggaaacatgtgggcccagacctggagcaacatctatgacctggtggtgcccttccccagcgcccccagcatggacaccacagaggccatgctgaagcagggctggacccccaggaggatgttcaaggaggctgatgacttcttcaccagcctgggcctgctgcctgtgcccccagagttctggaacaagtccatgctggagaagcccacagatggccgggaggtggtgtgccacgccagcgcctgggacttctacaacgggaaggacttccgcatcaagcagtgcaccaccgtgaacctggaggacctggtggtggcccaccacgagatgggccacatccagtacttcatgcagtacaaggacctgcctgtggccctgcgggagggcgccaaccctggcttccacgaggccatcggagatgtgctggccctgtctgtgtccacccccaagcacctgcacagcctgaacctgctgagcagcgagggcggcagtgatgaacatgacatcaacttcctgatgaagatggccctggacaagatcgccttcatccccttctcctacctggtggaccagtggcgctggagggtgtttgatggcagcatcaccaaggagaactacaaccaggagtggtggagcctgcggctgaagtaccagggcctgtgcccccctgtgcccaggacccagggcgactttgatcctggggccaagttccacatccccagctctgtgccctacatcagaacagccatgaagctgggcttcagccggccctggccagaggccatgcagctgatcaccggccagcccaacatgtctgccagcgccatgctgagctacttcaagcccctgctggactggctgaggacagaaaatgagctgcacggggagaagctgggctggccccagtacaactggacccccaacagcgcccggtctgagggccccctgcctgattctggccgggtgtccttcctgggcctggacctggatgcccagcaggcccgggtgggccagtggctgctgctcttcctgggcatcgccctgctggtggccaccctgggcctgagccagaggctcttcagcatccgccacaggagcctgcaccgccacagccacggcccccagtttggcagcgaggtggagctgcggcacagctag

SEQ ID NO: 143583 - DNA, 3438 bp, Artificial Sequence
  Description of Artificial Sequence: Synthetic coding sequence
atgggcgccgccagcggcagaagaggccctggcctgctgctgcccctgcccctgctgctgctgctgcccccccagcctgccctggccctggaccccggcctgcagcccggcaacttcagcgcagatgaggccggggcccagctgtttgcccagagctacaacagcagcgctgagcaggtgctcttccagagcgtggccgcctcctgggcccatgacaccaacatcacagcagaaaatgcccggcggcaggaggaggccgccctgctgagccaggagtttgctgaggcctggggccagaaggccaaggagctgtatgagcccatctggcagaacttcacagacccccagctgcggcgcatcattggagctgtgaggaccctgggcagcgccaacctgcccctggccaagaggcagcagtacaatgccctgctgagcaacatgagccgcatctacagcacagccaaggtgtgcctgcccaacaagacagccacctgctggagcctggaccctgacctgaccaacatcctggccagcagccgctcctatgccatgctgctgtttgcctgggagggctggcacaatgctgctggcatccccctgaagcccctgtatgaggacttcaccgccctgagcaatgaggcctacaagcaggacggcttcacagacacaggagcctactggaggtcctggtacaacagccccacctttgaagatgacctggagcacctgtaccagcagctggagcccctgtacctgaacctgcacgcctttgtgagaagagccctgcaccggcgctacggggaccgctacatcaacctgcggggccccatcccagcccacctgctgggggacatgtgggcccagagctgggagaacatctatgacatggtggtgcccttcccagacaagcccaacctggatgtgaccagcaccatgctgcagcagggctggaatgccacccacatgttccgggtggccgaggagttcttcaccagcctggagctgagccccatgcctcctgagttctgggagggctccatgctggagaagccagcagatggccgggaggtggtgtgccacgccagcgcctgggacttctacaacaggaaggacttccgcatcaagcagtgcaccagggtgaccatggaccagctgagcacagtgcaccacgagatgggccacatccagtactacctgcagtacaaggacctgcctgtgtccctgcggcggggggccaaccctggcttccacgaggccatcggagatgtgctggccctgtctgtgtccaccccagagcacctgcacaagattggcctgctggacagagtgaccaatgacacagaaagtgacatcaactacctgctgaagatggccctggagaagatcgccttcctgcccttcggctacctggtggaccagtggcgctggggcgtcttcagcggccgcaccccacccagccgctacaactttgactggtggtacctgcggaccaagtaccagggcatctgcccccctgtgaccagaaatgagacccactttgatgctggggccaagttccacgtgcccaacgtgaccccctacatccgctactttgtgtcctttgtgctgcagttccagttccacgaggccctgtgcaaggaggccggctatgagggccccctgcaccagtgtgacatctaccgcagcaccaaggccggggccaagctgaggaaggtgctgcaggccggcagcagccggccctggcaggaggtgctgaaggacatggtgggcctggatgccctggatgcccagcccctgctgaagtacttccagcctgtgacccagtggctgcaggagcagaaccagcagaatggagaggtgctgggctggccagagtaccagtggcacccccccctgcctgacaactacccagagggcatcgacctggtgacagatgaagctgaggccagcaagtttgtggaggagtatgacaggaccagccaggtggtgtggaatgaatatgcagaggccaactggaactacaacaccaacatcaccacagagaccagcaagatcctgctgcagaagaacatgcagatcgccaaccacaccctgaagtatggcacccaggccaggaagtttgatgtgaaccagctgcagaacaccaccatcaagaggatcatcaagaaggtgcaggacctggagcgggccgccctgcctgcccaggagctggaggagtacaacaagatcctgctggacatggagaccacctacagcgtggccaccgtgtgccaccccaacggcagctgcctgcagctggagccagacctgaccaacgtgatggccaccagcaggaaatatgaggacctgctgtgggcctgggagggctggagggacaaggccggccgggccatcctgcagttctaccccaagtatgtggagctgatcaaccaggccgcccggctgaatggctacgtggatgctggggacagctggaggtccatgtatgagacccccagcctggagcaggacctggagcggctcttccaggagctgcagcccctgtacctgaacctgcacgcctacgtgagaagagccctgcaccgccactacggggcccagcacatcaacctggagggccccatcccagcccacctgctgggcaacatgtgggcccagacctggagcaacatctatgacctggtggtgcccttccccagcgcccccagcatggacaccacagaggccatgctgaagcagggctggacccccaggaggatgttcaaggaggctgatgacttcttcaccagcctgggcctgctgcctgtgcccccagagttctggaacaagtccatgctggagaagcccacagatggccgggaggtggtgtgccacgccagcgcctgggacttctacaacgggaaggacttccgcatcaagcagtgcaccaccgtgaacctggaggacctggtggtggcccaccacgagatgggccacatccagtacttcatgcagtacaaggacctgcctgtggccctgcgggagggcgccaaccctggcttccacgaggccatcggagatgtgctggccctgtctgtgtccacccccaagcacctgcacagcctgaacctgctgagcagcgagggcggcagtgatgaacatgacatcaacttcctgatgaagatggccctggacaagatcgccttcatccccttctcctacctggtggaccagtggcgctggagggtgtttgatggcagcatcaccaaggagaactacaaccaggagtggtggagcctgcggctgaagtaccagggcctgtgcccccctgtgcccaggacccagggcgactttgatcctggggccaagttccacatccccagctctgtgccctacatccgctactttgtgtccttcatcatccagttccaccccttcagccagcacacagctgcctag

SEQ ID NO: 143584 - DNA, 1428 bp, Artificial Sequence
  Description of Artificial Sequence: Synthetic coding sequence
atgggcgccgccagcggcagaagaggccctggcctgctgctgcccctgcccctgctgctgctgctgcccccccagcctgccctggccctggaccccggcctgcagcccggcaacttcagcgcagatgaggccggggcccagctgtttgcccagagctacaacagcagcgctgagcaggtgctcttccagagcgtggccgcctcctgggcccatgacaccaacatcacagcagaaaatgcccggcggcaggaggaggccgccctgctgagccaggagtttgctgaggcctggggccagaaggccaaggagctgtatgagcccatctggcagaacttcacagacccccagctgcggcgcatcattggagctgtgaggaccctgggcagcgccaacctgcccctggccaagaggcagcagtacaatgccctgctgagcaacatgagccgcatctacagcacagccaaggtgtgcctgcccaacaagacagccacctgctggagcctggaccctgacctgaccaacatcctggccagcagccgctcctatgccatgctgctgtttgcctgggagggctggcacaatgctgctggcatccccctgaagcccctgtatgaggacttcaccgccctgagcaatgaggcctacaagcaggacggcttcacagacacaggagcctactggaggtcctggtacaacagccccacctttgaagatgacctggagcacctgtaccagcagctggagcccctgtacctgaacctgcacgcctttgtgagaagagccctgcaccggcgctacggggaccgctacatcaacctgcggggccccatcccagcccacctgctgggggacatgtgggcccagagctgggagaacatctatgacatggtggtgcccttcccagacaagcccaacctggatgtgaccagcaccatgctgcagcagggctggaatgccacccacatgttccgggtggccgaggagttcttcaccagcctggagctgagccccatgcctcctgagttctgggagggctccatgctggagaagccagcagatggccgggaggtggtgtgccacgccagcgcctgggacttctacaacaggaaggacttccgcatcaagcagtgcaccagggtgaccatggaccagctgagcacagtgcaccacgagatgggccacatccagtactacctgcagtacaaggacctgcctgtgtccctgcggcggggggccaaccctggcttccacgaggccatcggagatgtgctggccctgtctgtgtccaccccagagcacctgcacaagattggcctgctggacagagtgaccaatgacacagagcccagcatccggggctctgtgctgctgctgcctgagaccaagcccaccctgatgctggagctgtccttcatgttccagatgtag

SEQ ID NO: 143585 - DNA, 1080 bp, Artificial Sequence
  Description of Artificial Sequence: Synthetic coding sequence
atgatcctgaacagcagcacagaagatggcatcaagaggatccaggatgactgccccaaggccggccgccacaactacatctttgtgatgatccccaccctgtacagcatcatctttgtggtgggcatcttcggcaacagcctggtggtgattgtcatctacttctacatgaagctgaagacagtggccagcgtcttcctgctgaacctggccctggccgacctgtgcttcctgctgaccctgcccctgtgggccgtgtacacagccatggagtaccgctggcccttcggcaactacctgtgcaagatcgccagcgcctctgtgtccttcaacctgtatgcctctgtgttcctgctgacctgcctgagcattgaccgctacctggccatcgtgcaccccatgaagagccggctgcggaggaccatgctggtggccaaggtgacctgcatcatcatctggctgctggccggcctggccagcctgcctgccatcatccacagaaatgtgttcttcatcgagaacaccaacatcaccgtgtgtgccttccactatgagagccagaacagcaccctgcccatcggcctgggcctgaccaagaacatcctgggcttcctgttccccttcctgatcatcctgaccagctacaccctcatctggaaggccctgaagaaggcctatgagatccagaagaacaagcccagaaatgatgacatcttcaagatcatcatggccatcgtgctcttcttcttcttctcctggatcccccaccagatcttcaccttcctggatgtgctgatccagctgggcatcatccgggactgcagaattgctgacatcgtggacacagccatgcccatcaccatctgcatcgcctacttcaacaactgcctgaaccccctcttctacggcttcctgggcaagaagttcaagcgctacttcctgcagctgctgaagtacatcccccccaaggccaagagccacagcaacctgagcaccaagatgagcaccctgagctaccggcccagcgacaacgtgagcagcagcaccaagaagccagccccctgctttgaggtggagtag

SEQ ID NO: 143586 - DNA, 1080 bp, Artificial Sequence; identical to SEQ ID NO: 143585
  Description of Artificial Sequence: Synthetic coding sequence

SEQ ID NO: 143587 - DNA, 1080 bp, Artificial Sequence; identical to SEQ ID NO: 143585
  Description of Artificial Sequence: Synthetic coding sequence

SEQ ID NO: 143588 - DNA, 1080 bp, Artificial Sequence; identical to SEQ ID NO: 143585
  Description of Artificial Sequence: Synthetic coding sequence

SEQ ID NO: 143589 - DNA, 1080 bp, Artificial Sequence; identical to SEQ ID NO: 143585
  Description of Artificial Sequence: Synthetic coding sequence

SEQ ID NO: 143590 - DNA, 1080 bp, Artificial Sequence; identical to SEQ ID NO: 143585
  Description of Artificial Sequence: Synthetic coding sequence

SEQ ID NO: 143591 - DNA, 1080 bp, Artificial Sequence; identical to SEQ ID NO: 143585
  Description of Artificial Sequence: Synthetic coding sequence

SEQ ID NO: 143592 - DNA, 1080 bp, Artificial Sequence; identical to SEQ ID NO: 143585
  Description of Artificial Sequence: Synthetic coding sequence

SEQ ID NO: 143593 - DNA, 1080 bp, Artificial Sequence; identical to SEQ ID NO: 143585
  Description of Artificial Sequence: Synthetic coding sequence

SEQ ID NO: 143594 - DNA, 1092 bp, Artificial Sequence
  Description of Artificial Sequence: Synthetic coding sequence
atgaagggcaacagcaccctggccaccaccagcaagaacatcaccagcggcctgcacttcggcctggtgaacatcagcggcaacaatgaaagcaccctgaactgcagccagaagcccagcgacaagcacctggatgccatccccatcctgtactacatcatctttgtgattggcttcctggtgaacatcgtggtggtgaccctcttctgctgccagaagggccccaagaaggtgagcagcatctacatcttcaacctggccgtggccgacctgctgctgctggccaccctgcccctgtgggccacctactacagctaccgctatgactggctgtttggacctgtgatgtgcaaggtgtttggcagcttcctgaccctgaacatgtttgccagcatcttcttcatcacctgcatgtctgtggaccgctaccagagcgtcatctaccccttcctgagccagaggaggaacccctggcaggccagctacatcgtgcccctggtgtggtgcatggcctgcctgagcagcctgcccaccttctacttcagagatgtgaggaccatcgagtacctgggcgtgaatgcctgcatcatggccttccccccagagaagtatgcccagtggagcgctggcatcgccctgatgaagaacatcctgggcttcatcatccccctcatcttcatcgccacctgctacttcggcatcaggaagcacctgctgaagaccaacagctatggcaagaaccgcatcacccgggaccaggtgctgaagatggctgctgctgtggtgctggccttcatcatctgctggctgcccttccacgtgctgaccttcctggatgccctggcctggatgggcgtcatcaacagctgtgaggtgattgctgtgattgacctggccctgccctttgccatcctgctgggcttcaccaacagctgtgtgaaccccttcctgtactgctttgtgggcaaccgcttccagcagaagctgcggtctgtgttccgggtgcccatcacctggctgcagggcaagcgggagagcatgagctgcaggaagagcagcagcctgcgggagatggagacctttgtgtcctag

SEQ ID NO: 143595 - DNA, 1458 bp, Artificial Sequence
  Description of Artificial Sequence: Synthetic coding sequence
atgaggaagagggccccccagagcgagatggccccagctggggtgtccctgcgggccaccatcctgtgcctgctggcctgggccggcctggccgccggggacagagtgtacatccaccccttccacctggtgatccacaatgaaagcacctgtgagcagctggccaaggccaatgccggcaagcccaaggaccccaccttcatcccagcccccatccaggccaagaccagccctgtggatgagaaggccctgcaggaccagctggtgctggtggccgccaagctggacacagaggacaagctgcgggccgccatggtgggcatgctggccaacttcctgggcttccgcatctacggcatgcacagcgagctgtggggcgtggtgcatggagccaccgtgctgagccccacagctgtgtttggcaccctggccagcctgtacctgggcgccctggaccacacagctgaccggctgcaggccatcctgggcgtgccctggaaggacaagaactgcaccagccggctggatgcccacaaggtgctgagcgccctgcaggccgtgcagggcctgctggtggcccagggccgggctgacagccaggcccagctgctgctgagcacagtggtgggcgtcttcaccgcccctggcctgcacctgaagcagccctttgtgcagggcctggccctgtacacccctgtggtgctgcccaggagcctggacttcacagagctggatgtggccgctgagaagattgaccgcttcatgcaggccgtgacaggctggaagacaggctgcagcctgatgggcgcctctgtggacagcaccctggccttcaacacctacgtgcacttccagggcaagatgaagggcttcagcctgctggccgagccccaggagttctgggtggacaacagcacctctgtgtctgtgcccatgctgagcggcatgggcaccttccagcactggagcgacatccaggacaacttctctgtgacccaggtgcccttcacagaaagtgcctgcctgctgctgatccagccccactacgccagtgacctggacaaggtggagggcctgaccttccagcagaacagcctgaactggatgaagaagctgagccccaggaccatccacctgaccatgccccagctggtgctgcagggcagctatgacctgcaggacctgctggcccaggccgagctgcctgccatcctgcacacagagctgaacctgcagaagctgagcaatgaccgcatccgggtgggggaggtgctgaacagcatcttctttgagctggaggctgatgagcgggagcccacagagagcacccagcagctgaacaagccagaggtgctggaggtgaccctgaaccggcccttcctgtttgctgtgtatgaccagagcgccacagccctgcacttcctgggccgggtggccaaccccctgagcacagcctag

SEQ ID NO: 143596 - DNA, 1212 bp, Artificial Sequence
  Description of Artificial Sequence: Synthetic coding sequence
atgaggaagagggccccccagagcgagatggccccagctggggtgtccctgcgggccaccatcctgtgcctgctggcctgggccggcctggccgccggggacagagtgtacatccaccccttccacctggtgatccacaatgaaagcacctgtgagcagctggccaaggccaatgccggcaagcccaaggaccccaccttcatcccagcccccatccaggccaagaccagccctgtggatgagaaggccctgcaggaccagctggtgctggtggccgccaagctggacacagaggacaagctgcgggccgccatggtgggcatgctggccaacttcctgggcttccgcatctacggcatgcacagcgagctgtggggcgtggtgcatggagccaccgtgctgagccccacagctgtgtttggcaccctggccagcctgtacctgggcgccctggaccacacagctgaccggctgcaggccatcctggatgtggccgctgagaagattgaccgcttcatgcaggccgtgacaggctggaagacaggctgcagcctgatgggcgcctctgtggacagcaccctggccttcaacacctacgtgcacttccagggcaagatgaagggcttcagcctgctggccgagccccaggagttctgggtggacaacagcacctctgtgtctgtgcccatgctgagcggcatgggcaccttccagcactggagcgacatccaggacaacttctctgtgacccaggtgcccttcacagaaagtgcctgcctgctgctgatccagccccactacgccagtgacctggacaaggtggagggcctgaccttccagcagaacagcctgaactggatgaagaagctgagccccaggaccatccacctgaccatgccccagctggtgctgcagggcagctatgacctgcaggacctgctggcccaggccgagctgcctgccatcctgcacacagagctgaacctgcagaagctgagcaatgaccgcatccgggtgggggaggtgctgaacagcatcttctttgagctggaggctgatgagcgggagcccacagagagcacccagcagctgaacaagccagaggtgctggaggtgaccctgaaccggcccttcctgtttgctgtgtatgaccagagcgccacagccctgcacttcctgggccgggtggccaaccccctgagcacagcctag

SEQ ID NO: 143597 - DNA, 1479 bp, Artificial Sequence
  Description of Artificial Sequence: Synthetic coding sequence
atggtgaagtttcctgccctgacccactactggcccctcatccgcttcctggtgcccctgggcatcaccaacatcgccatcgactttggagagcaggccctgaacagaggaattgctgctgtgaaggaggatgctgtggagatgctggccagctatggcctggcctacagcctgatgaagttcttcaccggccccatgtctgacttcaagaatgtgggcctggtgtttgtgaacagcaagagggacaggaccaaggctgtgctgtgcatggtggtggccggggccatcgctgctgtgttccacaccctcatcgcctacagcgacctgggctactacatcatcaacaagctgcaccacgtggatgaatctgtgggcagcaagacccggcgggccttcctgtacctggccgccttccccttcatggatgccatggcctggacccatgctggcatcctgctgaagcacaagtacagcttcctggtgggctgtgccagcatcagtgatgtgattgcccaggtggtgtttgtggccatcctgctgcacagccacctggagtgccgggagcccctgctgatccccatcctgagcctgtacatgggcgccctggtgcgctgcaccaccctgtgcctgggctactacaagaacatccatgacatcatcccagacaggagcggccctgagctgggcggagatgccaccatcaggaagatgctgtccttctggtggcccctggccctgatcctggccacccagaggatcagccggcccatcgtgaacctgtttgtgtcccgggacctgggcggcagcagcgctgccacagaagctgtggccatcctgacagccacctaccctgtgggccacatgccctacggctggctgacagagatccgggctgtgtacccagcctttgacaagaacaaccccagcaacaagctggtgtccaccagcaacacagtgacagctgcccacatcaagaagttcacctttgtgtgcatggccctgagcctgaccctgtgctttgtgatgttctggaccccaaatgtgtctgagaagatcctgattgacatcattggagtggactttgcctttgctgagctgtgtgtggtgcccctgcgcatcttctccttcttccctgtgcctgtgacagtgcgggcccacctgaccggctggctgatgaccctgaagaagacctttgtgctggcccccagctctgtgctgcgcatcatcgtgctgattgccagcctggtggtgctgccctacctgggcgtgcacggggccaccctgggcgtgggcagcctgctggccggctttgtgggggagagcaccatggtggccatcgccgcctgctacgtgtacaggaagcagaagaagaagatggagaatgaaagtgccacagaaggagaggacagcgccatgacagacatgccacccacagaggaggtgacagacatcgtggagatgagggaggagaatgaatag

SEQ ID NO: 143598 - DNA, 885 bp, Artificial Sequence
  Description of Artificial Sequence: Synthetic coding sequence
atgggcgccctggtgcgctgcaccaccctgtgcctgggctactacaagaacatccatgacatcatcccagacaggagcggccctgagctgggcggagatgccaccatcaggaagatgctgtccttctggtggcccctggccctgatcctggccacccagaggatcagccggcccatcgtgaacctgtttgtgtcccgggacctgggcggcagcagcgctgccacagaagctgtggccatcctgacagccacctaccctgtgggccacatgccctacggctggctgacagagatccgggctgtgtacccagcctttgacaagaacaaccccagcaacaagctggtgtccaccagcaacacagtgacagctgcccacatcaagaagttcacctttgtgtgcatggccctgagcctgaccctgtgctttgtgatgttctggaccccaaatgtgtctgagaagatcctgattgacatcattggagtggactttgcctttgctgagctgtgtgtggtgcccctgcgcatcttctccttcttccctgtgcctgtgacagtgcgggcccacctgaccggctggctgatgaccctgaagaagacctttgtgctggcccccagctctgtgctgcgcatcatcgtgctgattgccagcctggtggtgctgccctacctgggcgtgcacggggccaccctgggcgtgggcagcctgctggccggctttgtgggggagagcaccatggtggccatcgccgcctgctacgtgtacaggaagcagaagaagaagatggagaatgaaagtgccacagaaggagaggacagcgccatgacagacatgccacccacagaggaggtgacagacatcgtggagatgagggaggagaatgaatag

SEQ ID NO: 143599 - DNA, 471 bp, Artificial Sequence
  Description of Artificial Sequence: Synthetic coding sequence
atgtggacctttgtgacccagctgctggtgaccctggtgctgctgtccttcttcctggtgtcctgccagaatgtgatgcacatcgtgcggggcagcctgtgctttgtgctgaagcacatccaccaggagctggacaaggagctgggggagagcgagggcctgagtgatgatgaggagaccatcagcaccagggtggtgagaagaagagtcttcctgaagggaaatgagttccagaacatccctggagagcaggtgacagaggagcagttcacagatgagcagggcaacatcgtgaccaagaagatcatcaggaaggtggtgcggcagattgacctgagcagcgcagatgctgcccaggagcacgaggaggtgacagtggagggccccctggaggaccccagcgagctggaggtggacatcgactacttcatgaagcacagcaaggaccacaccagcacccccaacccctag

SEQ ID NO: 143600 - DNA, 5694 bp, Artificial Sequence
  Description of Artificial Sequence: Synthetic coding sequence
atggcccaggccgccaagcagctgaagaagatcaaggacatcgaggcccaggccctgcaggagcagaaggagaaggaggagagcaacaggaagagaagaaacagaagccgggacaggaagaagaaggcagatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactatggagccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggacatgtgcgcatcagcgagatcctgctggaccatggagcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagagagcggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgccagaattggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccatgctgagatggtggccctgctgctgagcaagcaggccaatggaaacctgggcaacaagagcggcctgacccccctgcacctggtggcccaggagggccacgtgcctgtggctgatgtgctgatcaagcatggagtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgagggcacagcccacatcaccatcatgggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgatcccccccaggacctgtgccgcccccacccgcatcacctgccgcctggtgaagccccagaagctgagcaccccaccacccctggccgaggaggagggcctggccagccgcatcatcgccctgggccccaccggggcccagttcctgagccctgtgattgtggagatcccccactttgccagccacggccgcggggaccgggagctggtggtgctgcggagtgaaaatggatctgtgtggaaggagcacaggagccgctatggagagagctacctggaccagatcctgaatggcatggatgaggagctgggcagcctggaggagctggagaagaagagggtgtgccgcatcatcaccacagacttccccctgtacttcgtcatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgcccccatcctggacagacaacccccgggacagcggggagggggacaccaccagcctgcggctgctgtgcagcgtcatcggcggcacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcatgaaaattttgtggaggtggcccggagccgggacatcgaggtgctggagggcatgagcctgtttgctgagctgagcggcaacctggtgcctgtgaagaaggccgcccagcagaggagcttccacttccagagcttcagagaaaatcggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaggacagaagaaggacccccacccccctggccctgcgctacagcatcctgtctgagagcaccccaggcagcctgtctggaacagagcaggccgagatgaagatggctgtgatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagagatcgtgaacatgctggagggcagcggccggcagagcaggaacctgaagccagaccggcggcacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggccgaggacagtgatgccactggacatgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccactggagctggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcagggcaatgagttccagaacatccctggagagcaggtgacagaggagcagttcacagatgagcagggcaacatcgtgaccaagaagatcatcaggaaggtggtgcggcagattgacctgagcagcgcagatgctgcccaggagcacgaggaggaccacaccagcacccccaacccctag

SEQ ID NO: 143601 - DNA, 5643 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggcagaagattctgatgccaccggccacgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccaccggggccggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcagggcaatgagttccagaacatccctggagagcaggtgacagaggagcagttcacagatgagcagggcaacatcgtgaccaagaagatcatcaggaaggtggtgcggcagattgacctgagcagcgcagatgctgcccaggagcacgaggaggtggagctgcggggcagcggcctgcagcctgacctgattgagggcaggaaaggagcccagatcgtgaagagggccagcctgaagaggggcaagcagtag

SEQ ID NO: 143602 - DNA, 468 bp, Artificial Sequence
  Description of Artificial Sequence: Synthetic coding sequence
atgtggacctttgtgacccagctgctggtgaccctggtgctgctgtccttcttcctggtgtcctgccagaatgtgatgcacatcgtgcggggcagcctgtgctttgtgctgaagcacatccaccaggagctggacaaggagctgggggagagcgagggcctgagtgatgatgaggagaccatcagcaccagggtggtgagaagaagagtcttcctgaagggaaatgagttccagaacatccctggagagcaggtgacagaggagcagttcacagatgagcagggcaacatcgtgaccaagaagatcatcaggaaggtggtgcggcagattgacctgagcagcgcagatgctgcccaggagcacgaggaggtggagctgcggggcagcggcctgcagcctgacctgattgagggcaggaagggggcccagatcgtgaagagggccagcctgaagaggggcaagcagtag

SEQ ID NO: 143603 - DNA, 5646 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggcagaagattctgatgccaccggccacgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccaccggggccggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcagggcaatgagttccagaacatccctggagagcaggtgacagaggagcagttcacagatgagcagggcaacatcgtgaccaagaagatcatcaggaaggtggtgcggcagattgacctgagcagcgcagatgctgcccaggagcacgaggaggtgacagtggagggccccctggaggaccccagcgagctggaggtggacatcgactacttcatgaagcacagcaaggaccacaccagcacccccaacccctag

SEQ ID NO: 143604 - DNA, 330 bp, Artificial Sequence
  Description of Artificial Sequence: Synthetic coding sequence
atgtggacctttgtgacccagctgctggtgaccctggtgctgctgtccttcttcctggtgtcctgccagaatgtgatgcacatcgtgcggggcagcctgtgctttgtgctgaagcacatccaccaggagctggacaaggagctgggggagagcgagggcctgagtgatgatgaggagaccatcagcaccagggtggtgagaagaagagtcttcctgaagggaaatgagttccagaacatccctggagagcaggtgacagaggagcagttcacagatgagcagggcaacatcgtgaccaagaaggaccacaccagcacccccaacccctag

SEQ ID NO: 143605 - DNA, 5577 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggcagaagattctgatgccaccggccacgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccaccggggccggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcagggcaatgagttccagaacatccctggagagcaggtgacagaggagcagttcacagatgagcagggcaacatcgtgaccaagaaggtggagctgcggggcagcggcctgcagcctgacctgattgagggcaggaaaggagcccagatcgtgaagagggccagcctgaagaggggcaagcagtag

SEQ ID NO: 143606 - DNA, 4560 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggcatcagcaccaacaacccctag

SEQ ID NO: 143607 - DNA, 5505 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggcagaagattctgatgccaccggccacgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccaccggggccggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcagggcaatgagttccagaacatccctggagagcaggtgacagaggagcagttcacagatgagcagggcaacatcgtgaccaagaaggaccacaccagcacccccaacccctag

SEQ ID NO: 143608 - DNA, 5718 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggcagaagattctgatgccaccggccacgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccaccggggccggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcagggcaatgagttccagaacatccctggagagcaggtgacagaggagcagttcacagatgagcagggcaacatcgtgaccaagaagatcatcaggaaggtggtgcggcagattgacctgagcagcgcagatgctgcccaggagcacgaggaggtgacagtggagggccccctggaggaccccagcgagctggaggtggacatcgactacttcatgaagcacagcaaggtggagctgcggggcagcggcctgcagcctgacctgattgagggcaggaagggggcccagatcgtgaagagggccagcctgaagaggggcaagcagtag

SEQ ID NO: 143609 - DNA, 5421 bp, Artificial Sequence
  Description of Artificial Sequence: Synthetic coding sequence
atgccctacagcgtgggcttccgggaggctgatgctgccaccagcttcctgcgggccgcccggagcggcaacctggacaaggccctggaccacctgagaaatggagtggacatcaacacctgcaaccagaatggcctgaatggcctgcacctggccagcaaggagggccacgtgaagatggtggtggagctgctgcacaaggagatcatcctggagaccaccaccaagaagggcaacacagccctgcacatcgccgccctggccggccaggatgaggtggtgcgggagctggtgaactacggggccaacgtgaatgcccagagccagaagggcttcacccccctgtacatggccgcccaggagaaccacctggaggtggtgaagttcctgctggagaatggagccaaccagaatgtggccacagaagatggcttcacccccctggccgtggccctgcagcagggccatgaaaatgtggtggcccacctgatcaactacggcaccaagggcaaggtgcggctgcctgccctgcacatcgccgccagaaatgatgacaccaggacagctgctgtgctgctgcagaatgaccccaacccagatgtgctgagcaagacaggcttcacccccctgcacatcgccgcccactatgagaacctgaatgtggcccagctgctgctgaacagaggagcctctgtgaacttcaccccccagaatggcatcacccccctgcacatcgccagcagaagaggaaatgtcatcatggtgcggctgctgctggacagaggagcccagatcgagaccaagaccaaggatgagctgacccccctgcactgtgccgccagaaatggccacgtgcgcatcagcgagatcctgctggaccacggggcccccatccaggccaagaccaagaatggcctgagccccatccacatggccgcccagggcgaccacctggactgtgtgcggctgctgctgcagtatgatgctgagattgatgacatcaccctggaccacctgacccccctgcacgtggccgcccactgcggccaccaccgggtggccaaggtgctgctggacaagggggccaagcccaacagccgggccctgaatggcttcacccccctgcacatcgcctgcaagaagaaccacgtgcgggtgatggagctgctgctgaagacaggagccagcattgatgctgtgacagaaagtggcctgacccccctgcacgtggccagcttcatgggccacctgcccatcgtgaagaacctgctgcagagaggagccagccccaacgtgtccaatgtgaaggtggagacccccctgcacatggccgcccgggccggccacacagaggtggccaagtacctgctgcagaacaaggccaaggtgaatgccaaggccaaggatgaccagacccccctgcactgtgccgcccgcatcggccacaccaacatggtgaagctgctgctggagaacaatgccaaccccaacctggccaccacagctggccacacccccctgcacatcgccgcccgggagggccacgtggagaccgtgctggccctgctggagaaggaggccagccaggcctgcatgaccaagaagggcttcacccccctgcacgtggccgccaagtatggcaaggtgcgggtggccgagctgctgctggagagagatgcccaccccaatgctgctgggaagaatggcctgacccccctgcacgtggccgtgcaccacaacaacctggacatcgtgaagctgctgctgccccggggcggcagcccccacagccctgcctggaatggctacacccccctgcacatcgccgccaagcagaaccaggtggaggtggcccggagcctgctgcagtatggaggcagcgccaatgctgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcctgtggctgatgtgctgatcaagcacggcgtgatggtggatgccaccaccaggatgggctacacccccctgcacgtggccagccactacggcaacatcaagctggtgaagttcctgctgcagcaccaggctgatgtgaatgccaagaccaagctgggctacagccccctgcaccaggccgcccagcagggccacacagacatcgtgaccctgctgctgaagaatggagccagccccaatgaggtgtccagtgatggcaccacccccctggccatcgccaagaggctgggctacatctctgtgacagatgtgctgaaggtggtgacagatgagaccagctttgtgctggtgtctgacaagcacaggatgtccttccctgagaccgtggatgagatcctggatgtgtctgaagatgaaggagaggagctgatctccttcaaggccgagcggcgggacagcagagatgtggatgaggagaaggagctgctggactttgtgcccaagctggaccaggtggtggagagccctgccatcccccgcatcccctgtgccatgcctgagaccgtggtgatccgctctgaggagcaggagcaggccagcaaggagtatgatgaggacagcctcatccccagcagccctgccacagagaccagtgacaacatcagccctgtggccagccctgtgcacacaggcttcctggtgtccttcatggtggatgcccggggcggctccatgaggggcagccgccacaacggcctgcgggtggtgattcctcccaggacctgtgccgcccccacccgcatcacctgccgcctggtgaagccccagaagctgagcaccccaccacccctggccgaggaggagggcctggccagccgcatcatcgccctgggccccactggagcccagttcctgagccctgtgattgtggagatcccccactttgccagccacggccgcggggaccgggagctggtggtgctgcggagtgaaaatggatctgtgtggaaggagcacaggagccgctacggggagagctacctggaccagatcctgaatggcatggatgaggagctgggcagcctggaggagctggagaagaagagggtgtgccgcatcatcaccacagacttccccctgtactttgtgatcatgagccggctgtgccaggactatgacaccatcggccctgagggcggcagcctgaagagcaagctggtgcccctggtgcaggccaccttcccagaaaatgctgtgaccaagagggtgaagctggccctgcaggcccagcctgtgcctgatgagctggtgaccaagctgctgggcaaccaggccaccttcagccccatcgtgacagtggagcccaggaggaggaagttccaccggcccatcggcctgcgcatccccctgccccccagctggacagacaacccccgggacagcggggagggggacaccaccagcctgcggctgctgtgcagcgtgattggaggaacagaccaggcccagtgggaggacatcaccggcaccaccaagctggtgtatgccaatgaatgtgccaacttcaccaccaacgtgtctgcccgcttctggctgagtgactgccccaggacagctgaggccgtgaactttgccaccctgctgtacaaggagctgacagctgtgccctacatggccaagtttgtgatctttgccaagatgaatgacccccgggagggccgcctgcgctgctactgcatgacagatgacaaggtggacaagaccctggagcagcacgagaactttgtggaggtggcccggagccgggacatcgaggtgctggagggcatgagcctgtttgctgagctgagcggcaacctggtgcctgtgaagaaggccgcccagcagaggagcttccacttccagagcttccgggagaaccggctggccatgcctgtgaaggtgcgggacagcagccgggagcccggcggcagcctgtccttcctgaggaaggccatgaagtatgaggacacccagcacatcctgtgccacctgaacatcaccatgccaccctgtgccaagggcagcggggctgaagatagaagaaggacccccacccccctggccctgcgctacagcatcctgtctgagagcaccccaggcagcctgagcggcacagagcaggccgagatgaagatggccgtcatcagcgagcacctgggcctgtcctgggccgagctggcccgggagctgcagttctctgtggaggacatcaaccgcatccgggtggagaaccccaacagcctgctggagcagagcgtggccctgctgaacctgtgggtgatccgggagggccagaatgccaacatggagaacctgtacacagccctgcagagcattgacagaggagaaattgtgaacatgctggagggcagcggccggcagagcaggaacctgaagccagacagaagacacacagaccgggactacagcctgagccccagccagatgaatggctacagcagcctgcaggatgagctgctgagccctgccagcctgggctgtgccctgagcagccccctgcgggctgaccagtactggaatgaggtggccgtgctggatgccatccccctggccgccacagaacatgacaccatgctggagatgtctgacatgcaggtgtggagcgctggcctgacccccagcctggtgacagctgaggacagcagcctggagtgcagcaaggcagaagattctgatgccaccggccacgagtggaagctggagggcgccctgtctgaggagccccggggccctgagctgggcagcctggagctggtggaggatgacacagtggacagtgatgccaccaacggcctgattgacctgctggagcaggaggagggccagaggtctgaggagaagctgcccggcagcaagaggcaggatgatgccaccggggccggccaggacagtgaaaatgaggtgtccctggtgtctggccaccagaggggccaggcccgcatcacccacagccccaccgtgtcccaggtgacagagaggagccaggaccggctgcaggactgggatgctgatggcagcatcgtgtcctacctgcaggatgctgcccagggctcctggcaggaggaggtgacccagggcccccacagcttccagggcaccagcaccatgacagagggcctggagcccggcggcagccaggagtatgagaaggtgctggtgtctgtgtctgagcacacctggacagagcagcctgaggccgagagcagccaggccgaccgggaccggcggcagcagggccaggaggagcaggtgcaggaggccaagaacaccttcacccaggtggtgcaggaccacaccagcacccccaacccctag

SEQ ID NO: 143610 - DNA, 330 bp, Artificial Sequence; identical to SEQ ID NO: 143604
  Description of Artificial Sequence: Synthetic coding sequence

SEQ ID NO: 143611 - DNA, 11775 bp, Artificial Sequence
  Description of Artificial Sequence: Synthetic coding sequence
atgatgaatgaagatgctgcccagaagagtgacagcggggagaagttcaacggcagcagccagaggaggaagaggcccaagaagagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagagagcggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggacagaggaggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtacggggccagcatccaggccatcacagagagcggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagagatcgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactatggagctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcatggagctgaccaggatgcccacaccaagctgggctacacccccctgattgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaatggaaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcgctccttcagcagtgacaggagccacaccctgagccacgccagctacctgcgggacagcgctgtgatggatgattctgtggtgatccccagccaccaggtgtccaccctggccaaggaggccgagaggaacagctaccgcctgtcctggggcacagagaacctggacaacgtggccctgagcagcagccccatccacagcggcttcctggtgtccttcatggtggatgcccggggcggggccatgaggggctgccgccacaacggcctgcgcatcatcatcccccccaggaaatgtacagcccccaccagggtgacctgccgcctggtgaagaggcaccggctggccaccatgccacccatggtggagggggagggcctggccagccggctgattgaggtgggccccagcggggcccagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcaccggcggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgctttggaaacctggtgcccctgaccaagagcggccagcaccacatcttctccttctttgccttcaaggaaaatcggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaaggagagcgagagtgaccaggagcaggaggaggagattgacatgaccagcgagaagaatgatgaaacagagagcacagagacctctgtgctgaagagccacctggtgaatgaggtgcctgtgctggccagcccagacctgctgtctgaggtgtctgagatgaagcaggacctgatcaagatgacagccatcctgaccacagatgtgtctgacaaggccggcagcatcaaggtgaaggagctggtgaaggctgctgaggaggagcccggggagccctttgagatcgtggagcgggtgaaggaggacctggagaaggtgaatgagatcctgcggagcggcacctgcaccagagatgagagctctgtgcagagcagccgctctgagcggggcctggtggaggaggagtgggtgattgtgtctgatgaggagattgaggaggcccggcagaaggcccccctggagatcacagagtacccctgtgtggaggtgagaattgacaaggagatcaagggcaaggtggagaaggacagcacaggcctggtgaactacctgacagatgacctgaacacctgtgtgcccctgcccaaggagcagctgcagacagtgcaggacaaggccggcaagaagtgtgaggccctggccgtgggccgcagcagcgagaaggagggcaaggacatccccccagatgagacccagagcacccagaagcagcacaagcccagcctgggcatcaagaagcctgtgcggaggaagctgaaggagaagcagaagcagaaggaggagggcctgcaggccagcgctgagaaggccgagctgaagaagggcagcagcgaggagagcctgggggaggaccccggcctggcccctgagcccctgcccaccgtgaaggccaccagccccctgattgaggagacccccatcggcagcatcaaggacaaggtgaaggccctgcagaagagggtggaggatgagcagaagggccgcagcaagctgcccatccgggtgaagggcaaggaggatgtgcccaagaagaccacccaccggccccaccctgctgccagccccagcctgaagtcagaaagacatgcccctggcagccccagccccaagacagagcggcacagcaccctgagcagcagcgccaagacagagcggcacccccctgtgagccccagcagcaagacagagaagcacagccctgtgagccccagcgccaagacagagcggcacagccctgccagcagcagcagcaagacagagaagcacagccctgtgagccccagcaccaagacagagcggcacagccctgtgagcagcaccaagacagagcggcacccccctgtgagccccagcggcaagacagacaagaggcctcctgtgagccccagcggccgcacagagaagcacccccctgtgtccccaggccgcacagagaagaggctgcctgtgagccccagcggccgcacagacaagcaccagcctgtgtccacagctgggaagacagagaagcacctgcctgtgagccccagcggcaagacagagaagcagccccctgtgagccccaccagcaagacagaaagaattgaggagaccatgtctgtgcgggagctgatgaaggccttccagagcggccaggaccccagcaagcacaagacaggcctgtttgagcacaagagcgccaagcagaagcagccccaggagaagggcaaggtgcgggtggagaaggagaagggccccatcctgacccagcgggaggcccagaagacagagaaccagaccatcaagaggggccagaggctgcctgtgactggaacagctgagagcaagaggggcgtgcgggtgagcagcattggagtgaagaaggaggatgctgctgggggcaaggagaaggtgctgagccacaagatccctgagcctgtgcagagcgtgcctgaggaggagagccaccgggagagcgaggtgcccaaggagaagatggctgatgagcagggcgacatggacctgcagatcagcccagacaggaagaccagcacagacttcagcgaggtgatcaagcaggagctggaggacaatgacaagtaccagcagttccggctgtctgaggagacagagaaggcccagctgcacctggaccaggtgctgaccagccccttcaacaccaccttccccctggactacatgaaggatgagttcctgcctgccctgagcctgcagagcggggccctggatggcagcagcgagagcctgaagaatgaaggagtggccggcagcccctgtggcagcctgatggagggcaccccccagatcagcagcgaggagagctacaagcatgagggcctggccgagaccccagagaccagccctgagagcctgtccttcagccccaagaagtctgaggagcagacaggagagaccaaggagagcaccaagacagagaccaccacagagatccgctctgagaaggagcaccccaccaccaaggacatcactggaggcagcgaggagcggggggccaccgtgacagaagattctgagaccagcacagagagcttccagaaggaggccaccctgggcagccccaaggacaccagccccaagaggcaggatgactgcaccggcagctgcagcgtggccctggccaaggagacccccaccggcctgacagaggaggccgcctgtgatgagggccagaggaccttcggcagcagcgcccacaagacccagacagacagcgaggtgcaggagagcacagccaccagtgatgagaccaaggccctgcccctgcctgaggcctctgtgaagacagacaccggcacagagagcaagccccagggcgtcatccgcagcccccagggcctggagctggccctgcccagccgggacagcgaggtgctgtctgctgtggctgatgacagcctggccgtgagccacaaggacagcctggaggccagccctgtgctggaggacaacagcagccacaagaccccagacagcctggagcccagccccctgaaggagagcccctgccgggacagcctggagagcagccctgtggagcccaagatgaaggccggcatcttccccagccacttccccctgcctgctgctgtggccaagacagagctgctgacagaggtggcctctgtgcgcagccggctgctgcgggaccctgatggcagcgcagaagatgacagcctggagcagaccagcctgatggagagcagcggcaagagccccctgagcccagacacccccagcagcgaggaggtgtcctatgaggtgacccccaagaccacagatgtgtccacccccaagccagctgtgattcatgaatgtgccgaggaggatgattctgaaaatggagagaagaagcgcttcaccccagaggaggagatgttcaagatggtgaccaagatcaagatgtttgatgagctggagcaggaggccaagcagaagagggactacaagaaggagcccaagcaggaggagagcagcagcagcagtgaccctgatgctgactgcagcgtggatgtggatgagcccaagcacactggaagtggagaagatgagagcggcgtgcctgtgctggtgaccagcgagagcaggaaggtgagcagcagcagcgagagcgagcctgagctggcccagctgaagaagggagctgacagcggcctgctgcctgagcccgtcatccgggtgcagccccccagccccctgcccagctccatggacagcaacagcagccctgaggaggtgcagttccagcctgtggtgtccaagcagtacaccttcaagatgaatgaagacacccaggaggagcccgggaagtctgaggaggagaaggacagcgagagccacctggccgaggacagacatgctgtgtccacagaagctgaggacaggagctatgacaagctgaacagagacacagaccagcccaagatctgtgatggccacggctgtgaggccatgagccccagcagcagcgctgcccctgtgagcagcggcctgcagagccccactggagatgatgtggatgagcagcccgtcatctacaaggagagcctggccctgcagggcacccatgagaaggacacagaaggagaggagctggatgtgtccagagctgagagcccccaggccgactgccccagcgagagcttcagcagcagcagcagcctgccccactgcctggtgtctgagggcaaggagctggatgaggacatcagcgccaccagcagcatccagaagacagaggtgaccaagacagatgagacctttgagaacctgcccaaggactgccccagccaggacagcagcatcaccacccagacagaccgcttctccatggatgtgcctgtgtctgacctggccgagaatgatgagatctatgacccccagatcaccagcccctatgaaaatgtgcccagccagagcttcttcagcagcgaggagagcaagacccagacagatgccaaccacaccaccagcttccacagcagcgaggtgtacagcgtgaccatcaccagccctgtggaggatgtggtggtggccagcagcagcagcggcaccgtgctgagcaaggagagcaactttgagggccaggacatcaagatggagagccagcaggagagcaccctgtgggagatgcagagcgacagcgtgagcagcagctttgagcccaccatgtctgccaccaccaccgtggtgggggagcagatcagcaaggtgatcatcaccaagacagatgtggacagcgacagctggagcgagatcagagaagatgatgaggcctttgaggcccgggtgaaggaggaggagcagaagatcttcggcctgatggtggaccggcagagccagggcaccaccccagacaccaccccagcccggacccccacagaggagggcacccccaccagcgagcagaaccccttcctgttccaggagggcaagctgtttgagatgaccaggtctggggccatcgacatgaccaagaggagctatgcagatgagagcttccacttcttccagatcggccaggagagccgggaggagaccctgtctgaagatgtgaaggagggcgccactggagctgaccccctgcccctggagaccagcgctgagagcctggccctgtctgagagcaaggagaccgtggatgatgaggccgacctgctgcctgatgatgtgtctgaggaggtggaggagatcccagccagtgatgcccagctgaacagccagatgggcatcagcgccagcacagagacccccaccaaggaggccgtgtctgtgggcaccaaggacctgcccaccgtgcagacaggagacatcccccccctgagcggcgtgaagcagatcagctgcccagacagcagcgagcctgctgtgcaggtgcagctggacttcagcaccctgaccaggtctgtgtacagcgacagaggagatgacagcccagacagcagccctgaggagcagaagagcgtcatcgagatccccacagcccccatggagaatgtgcccttcacagagagcaagagcaagatccctgtgaggaccatgcccaccagcaccccagcccctccttctgcagaatatgagagctctgtgtctgaggacttcctgagctctgtggatgaggagaacaaggcagatgaggccaagcccaagagcaagctgcctgtgaaggtgcccctgcagagggtggagcagcagctgagtgacctggacacctctgtgcagaagacagtggccccccagggccaggacatggccagcatcgccccagacaacagaagcaagtctgagagtgatgccagcagcctggacagcaagaccaagtgccctgtgaagaccaggagctacacagaaacagaaacagagagccgggagcgggcagaggagctggagctggagagcgaggagggcgccacccggcccaagatcctgaccagccggctgcctgtgaagagccgcagcaccaccagcagctgccggggcggcaccagccccaccaaggagagcaaggagcacttctttgacctgtacagaaattccattgagttctttgaggagatcagtgatgaggccagcaagctggtggaccggctgacccagagcgagcgggagcaggagatcgtgtctgatgatgagagcagcagcgccctggaggtgtctgtgattgagaacctgccccctgtggagacagagcacagcgtgcctgaggacatctttgacacccggcccatctgggatgagagcattgagaccctcatcgagcgcatcccagatgaaaatggacatgaccacgccgaggacccccaggatgagcaggagcgcatcgaggagcggctggcctacatcgctgaccacctgggcttctcctggacagagctggcccgggagctggacttcacagaggagcagatccaccagatcagaattgagaaccccaacagcctgcaggaccagagccacgccctgctgaagtactggctggagagagatggcaagcacgccacagacaccaacctggtggagtgcctgaccaagatcaacaggatggacatcgtgcacctgatggagaccaacacagagcccctgcaggagcgcatcagccacagctatgcagaaattgagcagaccatcaccctggaccacagcgagggcttctctgtgctgcaggaggagctgtgcacagcccagcacaagcagaaggaggagcaggccgtgtccaaggagagcgagacctgtgaccacccccccatcgtgtctgaggaggacatctctgtgggctacagcaccttccaggatggagtgcccaagacagaaggagacagcagcgccacagccctcttcccccagacccacaaggagcaggtgcagcaggacttcagcggcaagatgcaggacctgcctgaggagagcagcctggagtaccagcaggagtactttgtgaccaccccaggcacagagaccagcgagacccagaaggccatgattgtgcccagcagccccagcaagaccccagaggaggtgtccaccccagctgaggaggagaagctgtacctgcagacccccaccagcagcgagcggggcggcagccccatcatccaggagcctgaggagcccagcgagcaccgggaggagagcagccccaggaagaccagcctggtgattgtggagagcgctgacaaccagcctgagacctgtgagcggctggatgaagatgctgcctttgagaagggagatgacatgcctgagatccccccagagaccgtgacagaggaggagtacattgatgagcacggccacacagtggtgaagaaggtgaccaggaagatcatccgccgctacgtgtcctctgagggcacagagaaggaggagatcatggtgcagggcatgccccaggagcctgtgaacatcgaggagggagatggctacagcaaggtgatcaagagggtggtgctgaagagtgacacagagcagagcgaggacaacaatgaatag

SEQ ID NO: 143612 - DNA, 5592 bp, Artificial Sequence
  Description of Artificial Sequence: Synthetic coding sequence
atgagccaccacatccagaggagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagaaagtggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggaccggggcggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtatggagccagcatccaggccatcacagaaagtggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagaaattgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactacggggctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcacggggctgaccaggatgcccacaccaagctgggctacacccccctcatcgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaacggcaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcggagcttcagcagtgacaggagccacaccctgagccacgccagctacctgcgggacagcgctgtgatggatgacagcgtggtgatccccagccaccaggtgtccaccctggccaaggaggccgagagaaattcctaccgcctgtcctggggcacagagaacctggacaacgtggccctgagcagcagccccatccacagcggccgggccagcccctgcctggagcgggacaacagcagcttcctggtgtccttcatggtggatgcccggggcggggccatgaggggctgccgccacaacggcctgcgcatcatcatcccccccaggaagtgcacagcccccaccagggtgacctgccgcctggtgaagaggcaccggctggccaccatgccacccatggtggagggggagggcctggccagccgcctcatcgaggtgggccccagcggggcccagttcctgggcaagctgcacctgcccacagcccccccacccctgaatgaaggagagagcctggtgagccgcatcctgcagctgggccccccaggcaccaagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcaccggcggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgctttggaaacctggtgcccctgaccaagagcggccagcaccacatcttctccttctttgccttcaaggaaaatcggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaaggagagcgagagtgaccaggagcaggaggaggagatcggccaggagagccgccgctacccccaggatgagcaggagagaattgaggagcggctggcctacatcgctgaccacctgggcttctcctggacagagctggcccgggagctggacttcacagaggagcagatccaccagatcagaattgagaaccccaacagcctgcaggaccagagccacgccctgctgaagtactggctggagagagatggcaagcacgccacagacaccaacctggtggagtgcctgaccaagatcaacaggatggacatcgtgcacctgatggagaccaacacagagcccctgcaggagcgcatcagccacagctatgcagaaattgagcagaccatcaccctggaccacagcgagggcttctctgtgctgcaggaggagctgtgcacagcccagcacaagcagaaggaggagcaggccgtgtccaaggagagcgagacctgtgaccacccccccatcgtgtctgaggaggacatctctgtgggctacagcaccttccaggatggagtgcccaagacagaaggagacagcagcgccacagccctcttcccccagacccacaaggagcaggtgcagcaggacttcagcggcaagatgcaggacctgcctgaggagagcagcctggagtaccagcaggagtactttgtgaccaccccaggcacagagaccagcgagacccagaaggccatgattgtgcccagcagccccagcaagaccccagaggaggtgtccaccccagctgaggaggagaagctgtacctgcagacccccaccagcagcgagcggggcggcagccccatcatccaggagcctgaggagcccagcgagcaccgggaggagagcagccccaggaagaccagcctggtgattgtggagagcgctgacaaccagcctgagacctgtgagcggctggatgaagatgctgcctttgagaagggagatgacatgcctgagatccccccagagaccgtgacagaggaggagtacattgatgaacatggccacacagtggtgaagaaggtgaccaggaagatcatcagaagatatgtgagcagcgagggcacagagaaggaggagatcatggtgcagggcatgccccaggagcctgtgaacatcgaggagggagatggctacagcaaggtgatcaagagggtggtgctgaagagtgacacagagcagagtgaagattccatggagtag

SEQ ID NO: 143613 - DNA, 11874 bp, Artificial Sequence
  Description of Artificial Sequence: Synthetic coding sequence
atgatgaatgaagatgctgcccagaagagtgacagcggggagaagttcaacggcagcagccagaggaggaagaggcccaagaagagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagagagcggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggacagaggaggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtacggggccagcatccaggccatcacagagagcggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagagatcgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactatggagctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcatggagctgaccaggatgcccacaccaagctgggctacacccccctgattgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaatggaaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcgctccttcagcagtgacaggagccacaccctgagccacgccagctacctgcgggacagcgctgtgatggatgattctgtggtgatccccagccaccaggtgtccaccctggccaaggaggccgagaggaacagctaccgcctgtcctggggcacagagaacctggacaacgtggccctgagcagcagccccatccacagcggcttcctggtgtccttcatggtggatgcccggggcggggccatgaggggctgccgccacaacggcctgcgcatcatcatcccccccaggaaatgtacagcccccaccagggtgacctgccgcctggtgaagaggcaccggctggccaccatgccacccatggtggagggggagggcctggccagccggctgattgaggtgggccccagcggggcccagttcctgggcaagctgcacctgcccacagcccccccacccctgaatgaaggagagagcctggtgagccgcatcctgcagctgggccccccaggcaccaagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcactggaggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgcttcggcaacctggtgcccctgaccaagagcggccagcaccacatcttctccttctttgccttcaaggagaaccggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaaggagagcgagagtgaccaggagcaggaggaggagattgacatgaccagcgagaagaatgatgaaacagagagcacagagacctctgtgctgaagagccacctggtgaatgaggtgcctgtgctggccagcccagacctgctgtctgaggtgtctgagatgaagcaggacctgatcaagatgacagccatcctgaccacagatgtgtctgacaaggccggcagcatcaaggtgaaggagctggtgaaggctgctgaggaggagcctggagagccctttgaaattgtggagcgggtgaaggaggacctggagaaggtgaatgagatcctgcggagcggcacctgcaccagagatgagagctctgtgcagagcagccgctctgagcggggcctggtggaggaggagtgggtgattgtgtctgatgaggagattgaggaggcccggcagaaggcccccctggagatcacagagtacccctgtgtggaggtgagaattgacaaggagatcaagggcaaggtggagaaggacagcacaggcctggtgaactacctgacagatgacctgaacacctgtgtgcccctgcccaaggagcagctgcagacagtgcaggacaaggccggcaagaagtgtgaggccctggccgtgggccgcagcagcgagaaggagggcaaggacatccccccagatgagacccagagcacccagaagcagcacaagcccagcctgggcatcaagaagcctgtgcggaggaagctgaaggagaagcagaagcagaaggaggagggcctgcaggccagcgctgagaaggccgagctgaagaagggcagcagcgaggagagcctgggagaagatcctggcctggcccctgagcccctgcccaccgtgaaggccaccagccccctcatcgaggagacccccatcggcagcatcaaggacaaggtgaaggccctgcagaagagggtggaggatgagcagaagggccgcagcaagctgcccatccgggtgaagggcaaggaggatgtgcccaagaagaccacccaccggccccaccctgctgccagccccagcctgaagtcagaaagacatgcccctggcagccccagccccaagacagagcggcacagcaccctgagcagcagcgccaagacagagcggcacccccctgtgagccccagcagcaagacagagaagcacagccctgtgagccccagcgccaagacagagcggcacagccctgccagcagcagcagcaagacagagaagcacagccctgtgagccccagcaccaagacagagcggcacagccctgtgagcagcaccaagacagagcggcacccccctgtgagccccagcggcaagacagacaagaggcctcctgtgagccccagcggccgcacagagaagcacccccctgtgtccccaggccgcacagagaagaggctgcctgtgagccccagcggccgcacagacaagcaccagcctgtgtccacagctgggaagacagagaagcacctgcctgtgagccccagcggcaagacagagaagcagccccctgtgagccccaccagcaagacagagcgcatcgaggagaccatgtctgtgcgggagctgatgaaggccttccagagcggccaggaccccagcaagcacaagacaggcctgtttgagcacaagagcgccaagcagaagcagccccaggagaagggcaaggtgcgggtggagaaggagaagggccccatcctgacccagcgggaggcccagaagacagagaaccagaccatcaagaggggccagaggctgcctgtgactggaacagctgagagcaagaggggcgtgcgggtgagcagcattggagtgaagaaggaggatgctgctgggggcaaggagaaggtgctgagccacaagatccctgagcctgtgcagagcgtgcctgaggaggagagccaccgggagagcgaggtgcccaaggagaagatggctgatgagcagggcgacatggacctgcagatcagcccagacaggaagaccagcacagacttcagcgaggtgatcaagcaggagctggaggacaatgacaagtaccagcagttccggctgtctgaggagacagagaaggcccagctgcacctggaccaggtgctgaccagccccttcaacaccaccttccccctggactacatgaaggatgagttcctgcctgccctgagcctgcagagcggggccctggatggcagcagcgagagcctgaagaatgaaggagtggccggcagcccctgtggcagcctgatggagggcaccccccagatcagcagcgaggagagctacaagcatgagggcctggccgagaccccagagaccagccctgagagcctgtccttcagccccaagaagtctgaggagcagacaggagagaccaaggagagcaccaagacagagaccaccacagagatccgctctgagaaggagcaccccaccaccaaggacatcaccggcggcagcgaggagcggggggccaccgtgacagaggacagcgagaccagcacagagagcttccagaaggaggccaccctgggcagccccaaggacaccagccccaagaggcaggatgactgcaccggcagctgcagcgtggccctggccaaggagacccccaccggcctgacagaggaggccgcctgtgatgagggccagaggaccttcggcagcagcgcccacaagacccagacagattctgaggtgcaggagagcacagccaccagtgatgagaccaaggccctgcccctgcctgaggcctctgtgaagacagacacaggaacagagagcaagccccagggcgtcatccgcagcccccagggcctggagctggccctgcccagccgggacagcgaggtgctgtctgctgtggctgatgacagcctggccgtgagccacaaggacagcctggaggccagccctgtgctggaggacaacagcagccacaagaccccagacagcctggagcccagccccctgaaggagagcccctgccgggacagcctggagagcagccctgtggagcccaagatgaaggccggcatcttccccagccacttccccctgcctgctgctgtggccaagacagagctgctgacagaggtggcctctgtgcgcagccggctgctgcgggaccctgatggcagcgcagaagatgacagcctggagcagaccagcctgatggagagcagcggcaagagccccctgagcccagacacccccagcagcgaggaggtgtcctatgaggtgacccccaagaccacagatgtgtccacccccaagccagctgtgattcatgaatgtgccgaggaggatgacagtgaaaatggagagaagaagcgcttcaccccagaggaggagatgttcaagatggtgaccaagatcaagatgtttgatgagctggagcaggaggccaagcagaagagggactacaagaaggagcccaagcaggaggagagcagcagcagcagtgaccctgatgctgactgcagcgtggatgtggatgagcccaagcacacaggcagcggggaggatgaaagtggagtgcctgtgctggtgaccagcgagagcaggaaggtgagcagcagcagcgagagcgagcctgagctggcccagctgaagaagggagctgacagcggcctgctgcctgagcctgtgatccgggtgcagccccccagccccctgcccagctccatggacagcaacagcagccctgaggaggtgcagttccagcctgtggtgtccaagcagtacaccttcaagatgaatgaagacacccaggaggagcccgggaagtctgaggaggagaaggacagcgagagccacctggctgaagatagacatgctgtgtccacagaagcagaagatagaagctatgacaagctgaacagagacacagaccagcccaagatctgtgatggccacggctgtgaggccatgagccccagcagcagcgctgcccctgtgagcagcggcctgcagagccccactggagatgatgtggatgagcagcctgtgatctacaaggagagcctggccctgcagggcacccatgagaaggacacagaaggagaggagctggatgtgtccagagctgagagcccccaggccgactgccccagcgagagcttcagcagcagcagcagcctgccccactgcctggtgtctgagggcaaggagctggatgaggacatcagcgccaccagcagcatccagaagacagaggtgaccaagacagatgagacctttgagaacctgcccaaggactgccccagccaggacagcagcatcaccacccagacagaccgcttctccatggatgtgcctgtgtctgacctggctgaaaatgatgagatctatgacccccagatcaccagcccctatgaaaatgtgcccagccagagcttcttcagcagcgaggagagcaagacccagacagatgccaaccacaccaccagcttccacagcagcgaggtgtacagcgtgaccatcaccagccctgtggaggatgtggtggtggccagcagcagcagcggcaccgtgctgagcaaggagagcaactttgagggccaggacatcaagatggagagccagcaggagagcaccctgtgggagatgcagagcgacagcgtgagcagcagctttgagcccaccatgtctgccaccaccaccgtggtgggggagcagatcagcaaggtgatcatcaccaagacagatgtggacagcgacagctggagcgagatccgggaggatgatgaggcctttgaggcccgggtgaaggaggaggagcagaagatcttcggcctgatggtggaccggcagagccagggcaccaccccagacaccaccccagcccggacccccacagaggagggcacccccaccagcgagcagaaccccttcctgttccaggagggcaagctgtttgagatgaccaggtctggggccatcgacatgaccaagaggagctatgcagatgagagcttccacttcttccagatcggccaggagagccgggaggagaccctgtctgaagatgtgaaggagggcgccaccggggctgaccccctgcccctggagaccagcgctgagagcctggccctgtctgagagcaaggagaccgtggatgatgaagctgacctgctgcctgatgatgtgtctgaggaggtggaggagatcccagccagtgatgcccagctgaacagccagatgggcatcagcgccagcacagagacccccaccaaggaggccgtgtctgtgggcaccaaggacctgcccaccgtgcagacaggagacatcccccccctgtctggagtgaagcagatcagctgcccagacagcagcgagcctgctgtgcaggtgcagctggacttcagcaccctgaccaggtctgtgtacagcgacagaggagatgacagcccagacagcagccctgaggagcagaagtctgtgattgagatccccacagcccccatggagaatgtgcccttcacagagagcaagagcaagatccctgtgaggaccatgcccaccagcaccccagccccacccagcgcagaatatgagagctctgtgtctgaggacttcctgagctctgtggatgaggagaacaaggcagatgaggccaagcccaagagcaagctgcctgtgaaggtgcccctgcagagggtggagcagcagctgagtgacctggacacctctgtgcagaagacagtggccccccagggccaggacatggccagcatcgccccagacaacagaagcaagtctgagagtgatgccagcagcctggacagcaagaccaagtgccctgtgaagaccaggagctacacagaaacagaaacagagagccgggagagagctgaggagctggagctggagagcgaggagggcgccacccggcccaagatcctgaccagccggctgcctgtgaagagccgcagcaccaccagcagctgccggggcggcaccagccccaccaaggagagcaaggagcacttctttgacctgtacagaaacagcattgagttctttgaggagatcagtgatgaggccagcaagctggtggaccggctgacccagagcgagcgggagcaggagatcgtgtctgatgatgagagcagcagcgccctggaggtgtctgtgattgagaacctgccccctgtggagacagagcacagcgtgcctgaggacatctttgacacccggcccatctgggatgagagcattgagaccctgattgagcgcatcccagatgaaaatggacatgaccatgctgaggacccccaggatgagcaggagagaattgaggagcggctggcctacatcgctgaccacctgggcttctcctggacagagctggcccgggagctggacttcacagaggagcagatccaccagatcagaattgagaaccccaacagcctgcaggaccagagccacgccctgctgaagtactggctggagagagatggcaagcacgccacagacaccaacctggtggagtgcctgaccaagatcaacaggatggacatcgtgcacctgatggagaccaacacagagcccctgcaggagcgcatcagccacagctatgcagaaattgagcagaccatcaccctggaccacagcgagggcttctctgtgctgcaggaggagctgtgcacagcccagcacaagcagaaggaggagcaggccgtgtccaaggagagcgagacctgtgaccacccccccatcgtgtctgaggaggacatctctgtgggctacagcaccttccaggatggagtgcccaagacagaaggagacagcagcgccacagccctcttcccccagacccacaaggagcaggtgcagcaggacttcagcggcaagatgcaggacctgcctgaggagagcagcctggagtaccagcaggagtactttgtgaccaccccaggcacagagaccagcgagacccagaaggccatgattgtgcccagcagccccagcaagaccccagaggaggtgtccaccccagctgaggaggagaagctgtacctgcagacccccaccagcagcgagcggggcggcagccccatcatccaggagcctgaggagcccagcgagcaccgggaggagagcagccccaggaagaccagcctggtgattgtggagagcgctgacaaccagcctgagacctgtgagcggctggatgaagatgctgcctttgagaagggagatgacatgcctgagatccccccagagaccgtgacagaggaggagtacattgatgaacatggccacacagtggtgaagaaggtgaccaggaagatcatcagaagatatgtgagcagcgagggcacagagaaggaggagatcatggtgcagggcatgccccaggagcctgtgaacatcgaggagggagatggctacagcaaggtgatcaagagggtggtgctgaagagtgacacagagcagagcgaggacaacaatgaatag

SEQ ID NO: 143614 - DNA, 5619 bp, Artificial Sequence
  Description of Artificial Sequence: Synthetic coding sequence
atgatgaatgaagatgctgcccagaagagtgacagcggggagaagttcaacggcagcagccagaggaggaagaggcccaagaagagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagagagcggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggacagaggaggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtacggggccagcatccaggccatcacagagagcggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagagatcgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactatggagctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcatggagctgaccaggatgcccacaccaagctgggctacacccccctgattgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaatggaaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcgctccttcagcagtgacaggagccacaccctgagccacgccagctacctgcgggacagcgctgtgatggatgattctgtggtgatccccagccaccaggtgtccaccctggccaaggaggccgagaggaacagctaccgcctgtcctggggcacagagaacctggacaacgtggccctgagcagcagccccatccacagcggcttcctggtgtccttcatggtggatgcccggggcggggccatgaggggctgccgccacaacggcctgcgcatcatcatcccccccaggaaatgtacagcccccaccagggtgacctgccgcctggtgaagaggcaccggctggccaccatgccacccatggtggagggggagggcctggccagccggctgattgaggtgggccccagcggggcccagttcctgggcaagctgcacctgcccacagcccccccacccctgaatgaaggagagagcctggtgagccgcatcctgcagctgggccccccaggcaccaagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcactggaggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgcttcggcaacctggtgcccctgaccaagagcggccagcaccacatcttctccttctttgccttcaaggagaaccggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaaggagagcgagagtgaccaggagcaggaggaggagattgacatgaccagcgagaagaacccccaggatgagcaggagcgcatcgaggagcggctggcctacatcgctgaccacctgggcttctcctggacagagctggcccgggagctggacttcacagaggagcagatccaccagatcagaattgagaaccccaacagcctgcaggaccagagccacgccctgctgaagtactggctggagagagatggcaagcacgccacagacaccaacctggtggagtgcctgaccaagatcaacaggatggacatcgtgcacctgatggagaccaacacagagcccctgcaggagcgcatcagccacagctatgcagaaattgagcagaccatcaccctggaccacagcgagggcttctctgtgctgcaggaggagctgtgcacagcccagcacaagcagaaggaggagcaggccgtgtccaaggagagcgagacctgtgaccacccccccatcgtgtctgaggaggacatctctgtgggctacagcaccttccaggatggagtgcccaagacagaaggagacagcagcgccacagccctcttcccccagacccacaaggagcaggtgcagcaggacttcagcggcaagatgcaggacctgcctgaggagagcagcctggagtaccagcaggagtactttgtgaccaccccaggcacagagaccagcgagacccagaaggccatgattgtgcccagcagccccagcaagaccccagaggaggtgtccaccccagctgaggaggagaagctgtacctgcagacccccaccagcagcgagcggggcggcagccccatcatccaggagcctgaggagcccagcgagcaccgggaggagagcagccccaggaagaccagcctggtgattgtggagagcgctgacaaccagcctgagacctgtgagcggctggatgaagatgctgcctttgagaagggagatgacatgcctgagatccccccagagaccgtgacagaggaggagtacattgatgagcacggccacacagtggtgaagaaggtgaccaggaagatcatccgccgctacgtgtcctctgagggcacagagaaggaggagatcatggtgcagggcatgccccaggagcctgtgaacatcgaggagggagatggctacagcaaggtgatcaagagggtggtgctgaagagtgacacagagcagagcgaggacaacaatgaatag

SEQ ID NO: 143615 - DNA, 2988 bp, Artificial Sequence
  Description of Artificial Sequence: Synthetic coding sequence
atggatgacagcgtggtgatccccagccaccaggtgtccaccctggccaaggaggccgagagaaattcctaccgcctgtcctggggcacagagaacctggacaacgtggccctgagcagcagccccatccacagcggcttcctggtgtccttcatggtggatgcccggggcggggccatgaggggctgccgccacaacggcctgcgcatcatcatcccccccaggaagtgcacagcccccaccagggtgacctgccgcctggtgaagaggcaccggctggccaccatgccacccatggtggagggggagggcctggccagccgcctcatcgaggtgggccccagcggggcccagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcactggaggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgcttcggcaacctggtgcccctgaccaagagcggccagcaccacatcttctccttctttgccttcaaggagaaccggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaagacagagaccaccacagagatccacccccaggatgagcaggagagaattgaggagcggctggcctacatcgctgaccacctgggcttctcctggacagagctggcccgggagctggacttcacagaggagcagatccaccagatcagaattgagaaccccaacagcctgcaggaccagagccacgccctgctgaagtactggctggagagagatggcaagcacgccacagacaccaacctggtggagtgcctgaccaagatcaacaggatggacatcgtgcacctgatggagaccaacacagagcccctgcaggagcgcatcagccacagctatgcagaaattgagcagaccatcaccctggaccacagcgagggcttctctgtgctgcaggaggagctgtgcacagcccagcacaagcagaaggaggagcaggccgtgtccaaggagagcgagacctgtgaccacccccccatcgtgtctgaggaggacatctctgtgggctacagcaccttccaggatggagtgcccaagacagaaggagacagcagcgccacagccctcttcccccagacccacaaggagcaggtgcagcaggacttcagcggcaagatgcaggacctgcctgaggagagcagcctggagtaccagcaggagtactttgtgaccaccccaggcacagagaccagcgagacccagaaggccatgattgtgcccagcagccccagcaagaccccagaggaggtgtccaccccagctgaggaggagaagctgtacctgcagacccccaccagcagcgagcggggcggcagccccatcatccaggagcctgaggagcccagcgagcaccgggaggagagcagccccaggaagaccagcctggtgattgtggagagcgctgacaaccagcctgagacctgtgagcggctggatgaagatgctgcctttgagaaggagctgacagaggagctgggggagctggaggccagcagtgatgaggaggccatggtgaccaccagggtggtgagaagaagagtcatcatccagggagatgacatgcctgagatccccccagagaccgtgacagaggaggagtacattgatgagcacggccacacagtggtgaagaaggtgaccaggaagatcatccgccgctacgtgtcctctgagggcacagagaaggaggagatcatggtgcagggcatgccccaggagcctgtgaacatcgaggagggagatggctacagcaaggtgatcaagagggtggtgctgaagagtgacacagagcagagcgaggtgaccctgtgtgagcccagcatcctgagcagcaccagccagttccaggccgagcctgtggagggcagaagagtgtccaaggtggtgaagaccaccgtggtgctgggggagaggatggagaagcacctgggggacagcagcctggccacagacctgcccagcgccaaggatgactttgaggagtag

SEQ ID NO: 143616 - DNA, 3345 bp, Artificial Sequence
  Description of Artificial Sequence: Synthetic coding sequence
atgaccaccatgctgcagaagagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagaaagtggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggaccggggcggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtatggagccagcatccaggccatcacagaaagtggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagaaattgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactacggggctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcacggggctgaccaggatgcccacaccaagctgggctacacccccctcatcgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaacggcaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcggagcttcagcagtgacaggagccacaccctgagccacgccagctacctgcgggacagcgctgtgatggatgacagcgtggtgatccccagccaccaggtgtccaccctggccaaggaggccgagagaaattcctaccgcctgtcctggggcacagagaacctggacaacgtggccctgagcagcagccccatccacagcggcttcctggtgtccttcatggtggatgcccggggcggggccatgaggggctgccgccacaacggcctgcgcatcatcatcccccccaggaagtgcacagcccccaccagggtgacctgccgcctggtgaagaggcaccggctggccaccatgccacccatggtggagggggagggcctggccagccgcctcatcgaggtgggccccagcggggcccagttcctgggcaagctgcacctgcccacagcccccccacccctgaatgaaggagagagcctggtgagccgcatcctgcagctgggccccccaggcaccaagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagtag

SEQ ID NO: 143617 - DNA, 5193 bp, Artificial Sequence
  Description of Artificial Sequence: Synthetic coding sequence
atgatgaatgaagatgctgcccagaagagtgacagcggggagaagttcaacggcagcagccagaggaggaagaggcccaagaaggtgacctgcccccagatgaagccagaggccgccaacatcgagaagagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagaaagtggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggaccggggcggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtatggagccagcatccaggccatcacagaaagtggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagaaattgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactacggggctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcacggggctgaccaggatgcccacaccaagctgggctacacccccctcatcgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaacggcaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcggagcttcagcagtgacaggagccacaccctgagccacgccagctacctgcgggacagcgctgtgatggatgacagcgtggtgatccccagccaccaggtgtccaccctggccaaggaggccgagagaaattcctaccgcctgtcctggggcacagagaacctggacaacgtggccctgagcagcagccccatccacagcggcttcctggtgtccttcatggtggatgcccggggcggggccatgaggggctgccgccacaacggcctgcgcatcatcatcccccccaggaagtgcacagcccccaccagggtgacctgccgcctggtgaagaggcaccggctggccaccatgccacccatggtggagggggagggcctggccagccgcctcatcgaggtgggccccagcggggcccagttcctgggcaagctgcacctgcccacagcccccccacccctgaatgaaggagagagcctggtgagccgcatcctgcagctgggccccccaggcaccaagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcaccggcggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgctttggaaacctggtgcccctgaccaagagcggccagcaccacatcttctccttctttgccttcaaggaaaatcggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaaggagagcgagagtgaccaggagcaggaggaggagattgacatgaccagcgagaagaatgatgaaacagagagcacagagacctctgtgctgaagagccacctggtgaatgaggtgcctgtgctggccagcccagacctgctgtctgaggtgtctgagatgaagcaggacctgatcaagatgacagccatcctgaccacagatgtgtctgacaaggccggcagcatcaaggtgaaggagctggtgaaggctgctgaggaggagcccggggagccctttgagatcgtggagcgggtgaaggaggacctggagaaggtgaatgagatcctgcggagcggcacctgcaccagagatgagagctctgtgcagagcagccgctctgagcggggcctggtggaggaggagtgggtgattgtgtctgatgaggagattgaggaggcccggcagaaggcccccctggagatcacagagtacccctgtgtggaggtgagaattgacaaggagatcaagggcaaggtggagaaggacagcacaggcctggtgaactacctgacagatgacctgaacacctgtgtgcccctgcccaaggagcagctgcagacagtgcaggacaaggccggcaagaagtgtgaggccctggccgtgggccgcagcagcgagaaggagggcaaggacatccccccagatgagacccagagcacccagaagcagcacaagcccagcctgggcatcaagaagcctgtgcggaggaagctgaaggagaagcagaagcagaagtag

SEQ ID NO: 143618 - DNA, 5592 bp, Artificial Sequence
  Description of Artificial Sequence: Synthetic coding sequence
atgaccaccatgctgcagaagagtgacagcaatgccagcttcctgcgggccgcccgggccggcaacctggacaaggtggtggagtacctgaagggcggcatcgacatcaacacctgcaaccagaatggcctgaatgccctgcacctggccgccaaggagggccacgtgggcctggtgcaggagctgctgggccggggcagctctgtggacagcgccaccaagaagggcaacacagccctgcacatcgccagcctggccggccaggccgaggtggtgaaggtgctggtgaaggagggcgccaacatcaatgcccagagccagaatggcttcacccccctgtacatggccgcccaggagaaccacattgatgtggtgaagtacctgctggagaatggagccaaccagagcacagccacagaagatggcttcacccccctggccgtggccctgcagcagggccacaaccaggccgtggccatcctgctggagaatgacaccaagggcaaggtgcggctgcctgccctgcacatcgccgccaggaaggatgacaccaagtctgctgccctgctgctgcagaatgaccacaatgctgatgtgcagagcaagatgatggtgaacagaaccacagaaagtggcttcacccccctgcacatcgccgcccactatggaaatgtgaatgtggccaccctgctgctgaacagaggagctgctgtggacttcaccgccagaaatggcatcacccccctgcacgtggccagcaagaggggcaacaccaacatggtgaagctgctgctggaccggggcggccagattgatgccaagaccagagatggcctgacccccctgcactgtgccgcccggagcggccatgaccaggtggtggagctgctgctggagcggggggcccccctgctggcccggaccaagaatggcctgagccccctgcacatggccgcccagggcgaccacgtggagtgtgtgaagcacctgctgcagcacaaggcccctgtggatgatgtgaccctggactacctgacagccctgcacgtggccgcccactgcggccactacagagtgaccaagctgctgctggacaagagggccaaccccaatgcccgggccctgaatggcttcacccccctgcacatcgcctgcaagaagaaccgcatcaaggtgatggagctgctggtgaagtatggagccagcatccaggccatcacagaaagtggcctgacccccatccacgtggccgccttcatgggccacctgaacatcgtgctgctgctgctgcagaatggagccagcccagatgtgaccaacatccggggggagacagccctgcacatggccgcccgggccggccaggtggaggtggtgcgctgcctgctgagaaatggagccctggtggatgcccgggcccgggaggagcagacccccctgcacatcgccagccggctgggcaagacagaaattgtgcagctgctgctgcagcacatggcccacccagatgctgccaccaccaacggctacacccccctgcacatcagcgcccgggagggccaggtggatgtggcctctgtgctgctggaggccggggccgcccacagcctggccaccaagaagggcttcacccccctgcacgtggccgccaagtatggcagcctggatgtggccaagctgctgctgcagaggagagctgctgctgacagcgctgggaagaatggcctgacccccctgcacgtggccgcccactatgacaaccagaaggtggccctgctgctgctggagaagggggccagcccccacgccacagccaagaatggctacacccccctgcacatcgccgccaagaagaaccagatgcagatcgccagcaccctgctgaactacggggctgagaccaacatcgtgaccaagcagggcgtgacccccctgcacctggccagccaggagggccacacagacatggtgaccctgctgctggacaagggggccaacatccacatgagcaccaagagcggcctgaccagcctgcacctggccgcccaggaggacaaggtgaatgtggccgacatcctgaccaagcacggggctgaccaggatgcccacaccaagctgggctacacccccctcatcgtggcctgccactatggaaatgtgaagatggtgaacttcctgctgaagcagggcgccaacgtgaatgccaagaccaagaatggctacacccccctgcaccaggccgcccagcagggccacacccacatcatcaacgtgctgctgcagcacggggccaagcccaatgccaccacagccaacggcaacacagccctggccatcgccaagaggctgggctacatctctgtggtggacaccctgaaggtggtgacagaggaggtgaccaccaccaccaccaccatcacagagaagcacaagctgaatgtgcctgagaccatgacagaggtgctggatgtgtctgatgaggagggagatgacaccatgactggagatggaggagagtacctgcggcctgaggacctgaaggagctgggagatgacagcctgcccagcagccagttcctggatggcatgaactacctgcgctacagcctggagggcggccgcagtgacagcctgcggagcttcagcagtgacaggagccacaccctgagccacgccagctacctgcgggacagcgctgtgatggatgacagcgtggtgatccccagccaccaggtgtccaccctggccaaggaggccgagagaaattcctaccgcctgtcctggggcacagagaacctggacaacgtggccctgagcagcagccccatccacagcggccgggccagcccctgcctggagcgggacaacagcagcttcctggtgtccttcatggtggatgcccggggcggggccatgaggggctgccgccacaacggcctgcgcatcatcatcccccccaggaagtgcacagcccccaccagggtgacctgccgcctggtgaagaggcaccggctggccaccatgccacccatggtggagggggagggcctggccagccgcctcatcgaggtgggccccagcggggcccagttcctgggcaagctgcacctgcccacagcccccccacccctgaatgaaggagagagcctggtgagccgcatcctgcagctgggccccccaggcaccaagttcctgggccctgtgattgtggagatcccccactttgctgccctgcggggcaaggagcgggagctggtggtgctgcggagtgaaaatggagacagctggaaggagcacttctgtgactacacagaagatgagctgaatgagatcctgaatggcatggatgaggtgctggacagccctgaggacctggagaagaagaggatctgccgcatcatcacccgggacttcccccagtactttgctgtggtgagccgcatcaagcaggacagcaacctgattggccctgagggcggcgtgctgagcagcacagtggtgccccaggtgcaggccgtgtttcctgagggcgccctgaccaagaggatccgggtgggcctgcaggcccagcccatgcacagcgagctggtgaagaagatcctgggcaacaaggccaccttcagccccatcgtgaccctggagcccaggaggaggaagttccacaagcccatcaccatgaccatccctgtgcccaaggccagcagtgatgtgatgctgaatggatttggaggagatgcccccaccctgcggctgctgtgcagcatcaccggcggcaccaccccagcccagtgggaggacatcaccggcaccacccccctgacctttgtgaatgaatgtgtgtccttcaccaccaacgtgtctgcccgcttctggctgattgactgccggcagatccaggagagcgtgacctttgccagccaggtgtaccgggagatcatctgtgtgccctacatggccaagtttgtggtgtttgccaagagccatgaccccatcgaggcccggctgcgctgcttctgcatgacagatgacaaggtggacaagaccctggagcagcaggagaactttgctgaggtggcccggagcagagatgtggaggtgctggagggcaagcccatctacgtggactgctttggaaacctggtgcccctgaccaagagcggccagcaccacatcttctccttctttgccttcaaggaaaatcggctgcccctgtttgtgaaggtgcgggacaccacccaggagccctgtggccgcctgtccttcatgaaggagcccaagagcacccggggcctggtgcaccaggccatctgcaacctgaacatcaccctgcccatctacaccaaggagagcgagagtgaccaggagcaggaggaggagattgacatgaccagcgagaagaacccccaggatgagcaggagagaattgaggagcggctggcctacatcgctgaccacctgggcttctcctggacagagctggcccgggagctggacttcacagaggagcagatccaccagatcagaattgagaaccccaacagcctgcaggaccagagccacgccctgctgaagtactggctggagagagatggcaagcacgccacagacaccaacctggtggagtgcctgaccaagatcaacaggatggacatcgtgcacctgatggagaccaacacagagcccctgcaggagcgcatcagccacagctatgcagaaattgagcagaccatcaccctggaccacagcgagggcttctctgtgctgcaggaggagctgtgcacagcccagcacaagcagaaggaggagcaggccgtgtccaaggagagcgagacctgtgaccacccccccatcgtgtctgaggaggacatctctgtgggctacagcaccttccaggatggagtgcccaagacagaaggagacagcagcgccacagccctcttcccccagacccacaaggagcaggtgcagcaggacttcagcggcaagatgcaggacctgcctgaggagagcagcctggagtaccagcaggagtactttgtgaccaccccaggcacagagaccagcgagacccagaaggccatgattgtgcccagcagccccagcaagaccccagaggaggtgtccaccccagctgaggaggagaagctgtacctgcagacccccaccagcagcgagcggggcggcagccccatcatccaggagcctgaggagcccagcgagcaccgggaggagagcagccccaggaagaccagcctggtgattgtggagagcgctgacaaccagcctgagacctgtgagcggctggatgaagatgctgcctttgagaagggagatgacatgcctgagatccccccagagaccgtgacagaggaggagtacattgatgaacatggccacacagtggtgaagaaggtgaccaggaagatcatcagaagatatgtgagcagcgagggcacagagaaggaggagatcatggtgcagggcatgccccaggagcctgtgaacatcgaggagggagatggctacagcaaggtgatcaagagggtggtgctgaagagtgacacagagcagagcgaggacaacaatgaatag

SEQ ID NO: 143619 - DNA, 5586 bp, Artificial Sequence
  Description of Artificial Sequence: Synthetic coding sequence
atggccagcagcgccagcagcagccctgctggaacagaagattctgccccagcccagggcggcttcggcagtgactacagccgcagcagcaggaagagtgatgccaatgccagctacctgcgggccgcccgggccggccacctggagaaggccctggactacatcaagaatggagtggacatcaacatctgcaaccagaatggcctgaatgccctgcacctggccagcaaggagggccacgtggaggtggtgtctgagctgctgcagcgggaggccaacgtggatgctgccaccaagaagggcaacacagccctgcacatcgccagcctggccggccaggccgaggtggtgaaggtgctggtgaccaatggagccaacgtgaatgcccagagccagaatggcttcacccccctgtacatggccgcccaggagaaccacctggaggtggtgaagttcctgctggacaacggggccagccagagcctggccacagaagatggcttcacccccctggccgtggccctgcagcagggccatgaccaggtggtgtccctgctgctggagaatgacaccaagggcaaggtgcggctgcctgccctgcacatcgccgccaggaaggatgacaccaaggccgccgccctgctgctgcagaatgacaacaatgctgatgtggagagcaagagcggcttcacccccctgcacatcgccgcccactacggcaacatcaacgtggccaccctgctgctgaacagagctgctgctgtggacttcaccgccagaaatgacatcacccccctgcacgtggccagcaagagaggaaatgccaacatggtgaagctgctgctggacagaggagccaagattgatgccaagaccagagatggcctgacccccctgcactgtggggcccggagcggccacgagcaggtggtggagatgctgctggaccgggccgcccccatcctgagcaagaccaagaatggcctgagccccctgcacatggccacccagggcgaccacctgaactgtgtgcagctgctgctgcagcacaacgtgcctgtggatgatgtgaccaatgactacctgacagccctgcacgtggccgcccactgcggccactacaaggtggccaaggtgctgctggacaagaaggccaaccccaatgccaaggccctgaatggcttcacccccctgcacatcgcctgcaagaagaaccgcatcaaggtgatggagctgctgctgaagcacggggccagcatccaggccgtgacagagagcggcctgacccccatccacgtggccgccttcatgggccacgtgaacatcgtgtcccagctgatgcaccacggggccagccccaacaccaccaacgtgcggggggagacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccacggggccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccacgccgccgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaacgtgaacctgagcaacaagagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaggtgaggaaggccaatgcccctgagatgctgagtgatggagagtacatcagtgatgtggaggagggagaagatgccatgactggagacacagacaagtacctgggcccccaggacctgaaggagctgggagatgacagcctgcctgctgagggctacatgggcttcagcctgggcgcccggagcgccagcctgcggagcttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaaatgtacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgagatcgtgaagaagatcctgggcaacaaggccaccttcagccccatcgtgacagtggagcccaggaggaggaagttccacaagcccatcaccatgaccatccctgtgcccccacccagcggggagggcgtgtccaatggctacaagggggacaccacccccaacctgcggctgctgtgcagcatcactggaggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggagaaccggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgagcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgatattgtgaccctgctggagggccccatctttgattatggcaacatcagcggcaccaggagctttgctgatgagaacaacgtgttccatgaccctgtggatggctaccccagcctgcaggtggagctggagacccccaccggcctgcactacaccccacccacccccttccagcaggatgactacttcagtgacatcagcagcattgagagccccctgcggacccccagccggctgagtgatggcctggtgcccagccagggcaacatcgagcacagcgcagatggcccccctgtggtgacagcagaagatgccagcctggaggacagcaagctggaggacagcgtgcccctgacagagatgcctgaggccgtggatgtggatgagagccagctggagaatgtgtgcctgtcctggcagaatgagaccagcagcggcaacctggagagctgtgcccaggcccggcgggtgactggaggcctgctggaccggctggatgacagcccagaccagtgccgggacagcatcaccagctacctgaagggggaggccggcaagtttgaggccaacggcagccacacagagatcaccccagaggccaagaccaagagctacttccctgagagccagaatgatgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgtgtgcctgtgtccatgaagaagatgagcaggaccagccctgcagatggcaagccccggctgagcctgcacgaggaggagggcagcagcggcagcgagcagaagcagggcgagggcttcaaggtgaagaccaagaaggagatccgccacgtggagaagaagagccacagctag

SEQ ID NO: 143620 - DNA, 5607 bp, Artificial Sequence
  Description of Artificial Sequence: Synthetic coding sequence
atgtctgaggagcccaaggagaagaatgccaagccagcccacaggaagaggaagggcaagaagagtgatgccaatgccagctacctgcgggccgcccgggccggccacctggagaaggccctggactacatcaagaatggagtggacatcaacatctgcaaccagaatggcctgaatgccctgcacctggccagcaaggagggccacgtggaggtggtgtctgagctgctgcagcgggaggccaacgtggatgctgccaccaagaagggcaacacagccctgcacatcgccagcctggccggccaggccgaggtggtgaaggtgctggtgaccaacggggccaacgtgaatgcccagagccagaatggcttcacccccctgtacatggccgcccaggagaaccacctggaggtggtgaagttcctgctggacaatggagccagccagagcctggccacagaagatggcttcacccccctggccgtggccctgcagcagggccatgaccaggtggtgtccctgctgctggagaatgacaccaagggcaaggtgcggctgcctgccctgcacatcgccgccaggaaggatgacaccaaggctgctgccctgctgctgcagaatgacaacaatgctgatgtggagagcaagagcggcttcacccccctgcacatcgccgcccactacggcaacatcaacgtggccaccctgctgctgaacagagctgctgctgtggacttcaccgccagaaatgacatcacccccctgcacgtggccagcaagagaggaaatgccaacatggtgaagctgctgctggacagaggagccaagattgatgccaagaccagagatggcctgacccccctgcactgtggggcccggagcggccacgagcaggtggtggagatgctgctggacagagctgcccccatcctgagcaagaccaagaatggcctgagccccctgcacatggccacccagggcgaccacctgaactgtgtgcagctgctgctgcagcacaacgtgcctgtggatgatgtgaccaatgactacctgacagccctgcacgtggccgcccactgcggccactacaaggtggccaaggtgctgctggacaagaaggccaaccccaatgccaaggccctgaatggcttcacccccctgcacatcgcctgcaagaagaaccgcatcaaggtgatggagctgctgctgaagcatggagccagcatccaggccgtgacagaaagtggcctgacccccatccacgtggccgccttcatgggccacgtgaacatcgtgtcccagctgatgcaccacggggccagccccaacaccaccaacgtgcggggggagacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccatggagccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccatgctgctgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaacgtgaacctgagcaacaagagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaggtgaggaaggccaatgcccctgagatgctgagtgatggagagtacatcagtgatgtggaggagggcaaccgctgcacctggtacaagatccccaaggtgcaggagttcaccgtgaagtcagaagatgccatgaccggggacacagacaagtacctgggcccccaggacctgaaggagctgggagatgacagcctgcctgctgagggctacatgggcttcagcctgggcgcccggagcgccagcctgcgctccttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaagtgcacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgaaattgtgaagaagatcctgggcaacaaggccaccttcagccccatcgtgacagtggagcccaggaggaggaagttccacaagcccatcaccatgaccatccctgtgcccccaccttctggagagggcgtgtccaatggctacaagggggacaccacccccaacctgcggctgctgtgcagcatcaccggcggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggaaaatcggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgagcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgacatcgtgaccctgctggagggccccatctttgattatggcaacatcagcggcaccaggagctttgctgatgaaaataatgtgttccatgaccctgtggatggctaccccagcctgcaggtggagctggagacccccaccggcctgcactacaccccacccacccccttccagcaggatgactacttcagtgacatcagcagcattgagagccccctgcggacccccagccggctgagtgatggcctggtgcccagccagggcaacatcgagcacagcgcagatggcccccctgtggtgacagcagaagatgccagcctggaggacagcaagctggaggacagcgtgcccctgacagagatgcctgaggccgtggatgtggatgagagccagctggagaatgtgtgcctgtcctggcagaatgagaccagcagcggcaacctggagagctgtgcccaggcccggcgggtgactggaggcctgctggaccggctggatgacagcccagaccagtgccgggacagcatcaccagctacctgaagggggaggccggcaagtttgaggccaacggcagccacacagagatcaccccagaggccaagaccaagagctacttccctgagagccagaatgatgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgtgtgcctgtgtccatgaagaagatgagcaggaccagccctgcagatggcaagccccggctgagcctgcacgaggaggagggcagcagcggcagcgagcagaagcagggcgagggcttcaaggtgaagaccaagaaggagatcagacatgtggagaagaagagccacagctag

SEQ ID NO: 143621 - DNA, 13134 bp, Artificial Sequence
  Description of Artificial Sequence: Synthetic coding sequence
atggcccacgccgccagccagctgaagaagaacagagacctggagatcaatgctgaggaggagcctgagaagaagaggaagcacaggaagaggagccgggacaggaagaagaagagtgatgccaatgccagctacctgcgggccgcccgggccggccacctggagaaggccctggactacatcaagaatggagtggacatcaacatctgcaaccagaatggcctgaatgccctgcacctggccagcaaggagggccacgtggaggtggtgtctgagctgctgcagcgggaggccaacgtggatgctgccaccaagaagggcaacacagccctgcacatcgccagcctggccggccaggccgaggtggtgaaggtgctggtgaccaatggagccaacgtgaatgcccagagccagaatggcttcacccccctgtacatggccgcccaggagaaccacctggaggtggtgaagttcctgctggacaacggggccagccagagcctggccacagaagatggcttcacccccctggccgtggccctgcagcagggccatgaccaggtggtgtccctgctgctggagaatgacaccaagggcaaggtgcggctgcctgccctgcacatcgccgccaggaaggatgacaccaaggccgccgccctgctgctgcagaatgacaacaatgctgatgtggagagcaagagcggcttcacccccctgcacatcgccgcccactacggcaacatcaacgtggccaccctgctgctgaacagagctgctgctgtggacttcaccgccagaaatgacatcacccccctgcacgtggccagcaagagaggaaatgccaacatggtgaagctgctgctggacagaggagccaagattgatgccaagaccagagatggcctgacccccctgcactgtggggcccggagcggccacgagcaggtggtggagatgctgctggaccgggccgcccccatcctgagcaagaccaagaatggcctgagccccctgcacatggccacccagggcgaccacctgaactgtgtgcagctgctgctgcagcacaacgtgcctgtggatgatgtgaccaatgactacctgacagccctgcacgtggccgcccactgcggccactacaaggtggccaaggtgctgctggacaagaaggccaaccccaatgccaaggccctgaatggcttcacccccctgcacatcgcctgcaagaagaaccgcatcaaggtgatggagctgctgctgaagcacggggccagcatccaggccgtgacagagagcggcctgacccccatccacgtggccgccttcatgggccacgtgaacatcgtgtcccagctgatgcaccacggggccagccccaacaccaccaacgtgcggggggagacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccacggggccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccacgccgccgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaacgtgaacctgagcaacaagagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaggtgaggaaggccaatgcccctgagatgctgagtgatggagagtacatcagtgatgtggaggagggagaagatgccatgactggagacacagacaagtacctgggcccccaggacctgaaggagctgggagatgacagcctgcctgctgagggctacatgggcttcagcctgggcgcccggagcgccagcctgcggagcttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaaatgtacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgagatcgtgaagaagatcctgggcaacaaggccaccttcagccccatcgtgacagtggagcccaggaggaggaagttccacaagcccatcaccatgaccatccctgtgcccccacccagcggggagggcgtgtccaatggctacaagggggacaccacccccaacctgcggctgctgtgcagcatcactggaggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggagaaccggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaaggagacagaaagtgaccaggatgatgaaattgagaagacagaccggcggcagagctttgccagcctggccctgaggaagcgctacagctacctgacagagcccggcatgattgaaagaagcactggagccaccaggagcctgcccaccacctacagctacaagcccttcttcagcacccggccctaccagagctggaccacagcccccatcaccgtgcccggccctgccaagagcggcttcaccagcctgagcagcagcagcagcaacaccccatctgccagccccctgaagagcatctggagcgtgtccacccccagccccatcaagagcaccctgggcgccagcaccaccagctctgtgaagagcatcagtgatgtggccagccccatccgctccttccgcaccatgagcagccccatcaagacagtggtgtcccagagcccctacaacatccaggtgagcagcggcaccctggcccgggccccagctgtgacagaggccacccccctgaagggcctggccagcaacagcaccttcagcagcaggaccagccctgtgaccacagctggcagcctgctggagaggagcagcatcaccatgaccccaccagccagccccaagagcaacatcaacatgtacagcagcagcctgcccttcaagagcatcatcaccagcgctgcccccctcatcagcagccccctgaagtctgtggtgtcccctgtgaagtctgctgtggatgtgatcagcagcgccaagatcaccatggccagcagcctgagcagccctgtgaagcagatgcctggccatgctgaggtggccctggtgaatggcagcatcagccccctgaagtaccccagcagcagcaccctcatcaatggctgcaaggccacagccaccctgcaggagaagatcagcagcgccaccaacagcgtgtcctctgtggtgtctgctgccacagacacagtggagaaggtgttcagcaccaccacagccatgcccttcagccccctgcggagctatgtgtctgctgcccccagcgccttccagagcctgcggacccccagcgccagcgccctgtacaccagcctgggcagcagcatcagcgccaccaccagctctgtgaccagcagcatcatcaccgtgcctgtgtacagcgtggtgaatgtgctgcctgagcccgccctgaagaagctgcctgacagcaacagcttcaccaagtctgctgctgccctgctgagccccatcaagaccctgaccacagagacccacccccagccccacttcagcaggaccagcagccctgtgaagagcagcctcttcctggcccccagcgccctgaagctgagcacccccagcagcctgagcagcagccaggagatcctgaaggatgtggccgagatgaaggaggacctgatgaggatgacagccatcctgcagacagatgtgcctgaggagaagcccttccagcctgagctgcccaaggagggcagaattgatgatgaggagcccttcaagatcgtggagaaggtgaaggaggacctggtgaaggtgtctgagatcctgaagaaggatgtgtgtgtggacaacaagggcagccccaagagccccaagagtgacaagggccacagcccagaagatgactggattgagttcagcagcgaggagatccgggaggcccggcagcaggccgccgccagccagagccccagcctgcctgagcgggtgcaggtgaaggccaaggccgccagcgagaaggactacaacctgaccaaggtgattgactacctgaccaatgacatcggcagcagcagcctgaccaacctgaagtacaagtttgaagatgccaagaaggatggagaggagcggcagaagagggtgctgaagccagccatcgccctgcaggagcacaagctgaagatgcccccagcctccatgaggaccagcaccagcgagaaggagctgtgcaagatggctgacagcttctttggaacagacaccatcctggagagcccagatgacttcagccagcacgaccaggacaagagccccctgagtgacagcggctttgagaccaggtctgagaagaccccatctgccccccagagcgctgagagcacaggccccaagcccctcttccacgaggtgcccatcccccctgtgatcacagagaccaggacagaggtggtgcacgtgatccgctcctatgaccccagcgctggagatgtgccccagacccagcctgaggagcctgtgagccccaagcccagccccaccttcatggagctggagcccaagcccaccaccagcagcatcaaggagaaggtgaaggccttccagatgaaggccagcagtgaagaagatgaccacaacagagtgctgagcaagggcatgagggtgaaggaggagacccacatcaccaccaccaccaggatggtgtaccacagccccccaggaggagagggcgccagcgagagaattgaggagaccatgtctgtgcatgacatcatgaaggccttccagagcggccgggaccccagcaaggagctggccggcctgtttgagcacaagtctgctgtgtccccagatgtgcacaagtctgctgctgagaccagcgcccagcacgccgagaaggacaaccagatgaagcccaagctggagcgcatcatcgaggtgcacatcgagaagggcaaccaggccgagcccacagaggtgatcatccgggagaccaagaagcaccctgagaaggagatgtatgtgtaccagaaggacctgagcagaggagacatcaacctgaaggacttcctgcctgagaagcatgatgccttcccctgcagcgaggagcagggccagcaggaggaggaggagctgacagctgaggagagcctgcccagctacctggagagcagccgggtgaacacccctgtgtcccaggaggaggacagccggcccagcagcgcccagctgatcagtgatgacagctacaagaccctgaagctgctgagccagcacagcattgagtaccatgatgatgagctgtctgagctgcggggggagagctacagatttgctgagaagatgctgctgtctgagaagctggatgtgagccacagcgacacagaggagagcgtgacagaccacgccggcccccccagcagcgagctgcagggcagtgacaagaggagccgggagaagatcgccacagcccccaagaaggagatcctgagcaagatctacaaggatgtgtctgaaaatggagtgggcaaggtgtccaaggatgagcactttgacaaggtgacagtgctgcactacagcggaaatgtgagcagccccaagcacgccatgtggatgaggttcacagaagatcggctggaccggggccgggagaagctgatctatgaggacagagtggacagaacagtgaaggaggccgaggagaagctgacagaggtgtcccagttcttccgggacaagacagagaagctgaatgatgagctgcagagccctgagaagaaggcccggcccaagaatggcaaggagtacagcagccagagccccaccagcagcagccctgagaaggtgctgctgacagagctgctggccagcaatgatgagtgggtgaaggcccggcagcacggcccagatggccagggcttccccaaggccgaggagaaggcccccagcctgcccagcagccctgagaagatggtgctgagccagcagacagaggacagcaagagcacagtggaggccaagggcagcatcagccagagcaaggccccagatggcccccagagcggcttccagctgaagcagagcaagctgagcagcatccggctgaagtttgagcagggcacccacgccaagagcaaggacatgagccaggaggacaggaagagtgatggccagagccgcatccctgtgaagaagatccaggagagcaagctgcctgtgtaccaggtgtttgcccgggagaagcagcagaaggccatcgacctgcctgatgaatctgtgtctgtgcagaaggacttcatggtgctgaagaccaaggatgaacatgcccagagcaatgaaattgtggtgaatgacagcggcagtgacaacgtgaagaagcagaggacagagatgagcagcaaggccatgccagacagcttcagcgagcagcaggccaaggacctggcctgccacatcaccagtgacctggccacccggggcccctgggacaagaaggtgttccgcacctgggagagcagcggggccaccaacaacaagagccagaaggagaagctgagccacgtgctggtgcatgatgtgcgggagaaccacatcggccaccctgagagcaagtctgtggaccagaagaatgagttcatgtctgtgacagagcgggagaggaagctgctgaccaacggcagcctgtctgagatcaaggagatgacagtgaagagccccagcaagaaggtgctgtaccgggagtatgtggtgaaggagggggaccaccctgggggcctgctggaccagcccagccgccgctctgagagcagcgctgtgagccacatccctgtgcgggtggctgatgagaggaggatgctgagcagcaacatcccagatggcttctgtgagcagagcgccttccccaagcatgagctgagccagaagctgagccagagctccatgagcaaggagaccgtggagacccagcacttcaacagcattgaagatgagaaggtgacctacagcgagatcagcaaggtgtccaagcaccagagctatgtgggcctgtgcccccccctggaggagacagagaccagccccaccaagagcccagacagcctggagttcagccctgggaaggagagccccagcagtgatgtgtttgaccacagccccattgatggcctggagaagctggcccccctggcccagacagaaggaggcaaggagatcaagaccctgcctgtgtatgtgtcctttgtgcaggtgggcaagcagtatgagaaggagatccagcagggcggcgtgaagaagatcatcagccaggagtgcaagacagtgcaggagacccggggcaccttctacaccacccggcagcagaagcagccccccagcccccagggcagcccagaagatgacaccctggagcaggtgtccttcctggacagcagcggcaagagccccctgaccccagagacccccagcagcgaggaggtgtcctatgagttcaccagcaagaccccagacagcctcatcgcctacatccctgggaagcccagccccatccctgaggtgtctgaggagagcgaggaggaggagcaggccaagagcaccagcctgaagcagaccaccgtggaggagacagctgtggagcgggagatgcccaatgatgtgtccaaggacagcaaccagaggcccaagaacaacagagtggcctacatcgagttccccccacctccacccctggatgctgaccagattgaaagtgacaagaagcaccactacctgcctgagaaggaggtggacatgattgaggtgaacctgcaggatgaacatgacaagtaccagctggccgagcccgtcatccgggtgcagccccccagccctgtgcccccaggagcagatgtgtctgacagcagtgatgatgagagcatctaccagcctgtgcctgtgaagaagtacaccttcaagctgaaggaggtggatgatgagcagaaggagaagcccaaggccagcgctgagaaggccagcaaccagaaggagctggagagcaatggaagtggcaaggacaatgaatttggcctgggcctggacagcccccagaatgagatcgcccagaatggaaataatgaccagagcatcacagagtgcagcatcgccaccacagctgagttcagccatgacacagatgccacagaaattgacagcctggatggctatgacctgcaggatgaagatgatggcctgacagaaagtgacagcaagctgcccatccaggccatggagatcaagaaggacatctggaacacagagggcatcctgaagccagctgacaggagcttcagccagagcaagctggaggtgattgaggaggagggcaaggtgggcccagatgaggacaagccacccagcaagagcagcagcagcgagaagaccccagacaagacagaccagaagagcggggcccagttcttcaccctggagggccgccacccagacagatctgtgtttcctgacacctacttctcctacaaggtggatgaggagtttgccacccccttcaagacagtggccaccaagggcctggactttgacccctggagcaacaacagaggagatgatgaggtgtttgacagcaagagcagagaagatgagaccaagcccttcggcctggccgtggaggacaggagccctgccaccaccccagacaccaccccagcccggacccccacagatgagagcacccccaccagcgagcccaaccccttccccttccacgagggcaagatgtttgagatgaccaggtctggggccatcgacatgagcaagagggactttgtggaggagcggctgcagttcttccagatcggggagcacaccagcgagggcaagagcggggaccagggcgagggggacaagtccatggtgacagccaccccccagccccagagcggggacaccaccgtggagaccaacctggagagaaatgtggagacccccaccgtggagcccaaccccagcatccccaccagcggggagtgccaggagggcaccagcagcagcggcagcctggagaagtctgctgctgccaccaacaccagcaaggtggaccccaagctgcggacccccatcaagatgggcatcagcgccagcaccatgaccatgaagaaggagggccctggagagatcacagacaagattgaagctgtgatgaccagctgccagggcctggagaatgagaccatcaccatgatcagcaacacagccaacagccagatgggcgtgcggccccatgagaagcatgacttccagaaggacaacttcaacaacaacaacaacctggacagcagcaccatccagacagacaacatcatgagcaacatcgtgctgacagagcacagcgcccccacctgcaccacagagaaggacaaccctgtgaaggtgagcagcggcaagaagacaggagtgctgcagggccactgtgtgcgggacaagcagaaggtgctgggggagcagcagaagaccaaggagctgattggcatccggcagaagagcaagctgcccatcaaggccaccagccccaaggacaccttcccccccaaccacatgagcaacaccaaggccagcaagatgaagcaggtgtcccagagcgagaagaccaaggccctgaccaccagcagctgtgtggatgtgaagagccgcatccctgtgaagaacacccaccgggacaacatcatcgctgtgaggaaggcctgtgccacccagaagcagggccagcctgagaagggcaaggccaagcagctgcccagcaagctgcctgtgaaggtgcgcagcacctgtgtgaccaccaccaccaccacagccaccaccaccaccaccaccaccaccaccaccaccaccagctgcaccgtgaaggtgaggaagagccagctgaaggaggtgtgcaagcacagcattgagtacttcaagggcatcagcggggagaccctgaagctggtggaccggctgtctgaggaggagaagaagatgcagagcgagctgagtgatgaggaggagagcaccagcaggaacaccagcctgtctgagaccagccggggcggccagcccagcgtgaccaccaagagcgcccgggacaagaagacagaagctgcccccctgaagagcaagtctgagaaggccggcagcgagaagaggagcagcagaagaacaggcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgacatcgtgaccctgctggagggccccatctttgattatggcaacatcagcggcaccaggagctttgctgatgaaaataatgtgttccatgaccctgtggatggctggcagaatgagaccagcagcggcaacctggagagctgtgcccaggcccggcgggtgactggaggcctgctggaccggctggatgacagcccagaccagtgccgggacagcatcaccagctacctgaagggggaggccggcaagtttgaggccaacggcagccacacagagatcaccccagaggccaagaccaagagctacttccctgagagccagaatgatgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgtgtgcctgtgtccatgaagaagatgagcaggaccagccctgcagatggcaagccccggctgagcctgcacgaggaggagggcagcagcggcagcgagcagaagcagggcgagggcttcaaggtgaagaccaagaaggagatccgccacgtggagaagaagagccacagctag

SEQ ID NO: 143622 - DNA, 3006 bp, Artificial Sequence
  Description of Artificial Sequence: Synthetic coding sequence
atggccctgccccagagtgaagatgccatgactggagacacagacaagtacctgggcccccaggacctgaaggagctgggagatgacagcctgcctgctgagggctacatgggcttcagcctgggcgcccggagcgccagcctgcggagcttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaaatgtacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgagatcgtgaagaagatcctgggcaacaaggccaccttcagccccatcgtgacagtggagcccaggaggaggaagttccacaagcccatcaccatgaccatccctgtgcccccacccagcggggagggcgtgtccaatggctacaagggggacaccacccccaacctgcggctgctgtgcagcatcactggaggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggagaaccggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgagcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgatattgtgaccctgctggagggccccatctttgattatggcaacatcagcggcaccaggagctttgctgatgagaacaacgtgttccatgaccctgtggatggctaccccagcctgcaggtggagctggagacccccaccggcctgcactacaccccacccacccccttccagcaggatgactacttcagtgacatcagcagcattgagagccccctgcggacccccagccggctgagtgatggcctggtgcccagccagggcaacatcgagcacagcgcagatggcccccctgtggtgacagcagaagatgccagcctggaggacagcaagctggaggacagcgtgcccctgacagagatgcctgaggccgtggatgtggatgagagccagctggagaatgtgtgcctgtcctggcagaatgagaccagcagcggcaacctggagagctgtgcccaggcccggcgggtgactggaggcctgctggaccggctggatgacagcccagaccagtgccgggacagcatcaccagctacctgaagggggaggccggcaagtttgaggccaacggcagccacacagagatcaccccagaggccaagaccaagagctacttccctgagagccagaatgatgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgtgtgcctgtgtccatgaagaagatgagcaggaccagccctgcagatggcaagccccggctgagcctgcacgaggaggagggcagcagcggcagcgagcagaagcagggcgagggcttcaaggtgaagaccaagaaggagatccgccacgtggagaagaagagccacagctag

SEQ ID NO: 143623 - DNA, 3306 bp, Artificial Sequence
  Description of Artificial Sequence: Synthetic coding sequence
atgtctgaggagcccaaggagaagaatgccaagccagcccacaggaagaggaagggcaagaagagtgatgccaatgccagctacctgcgggccgcccgggccggccacctggagaaggccctggactacatctctgtggtggacaccctgaagatcgtgacagaggagaccatgaccaccaccaccgtgacagagaagcacaagatgaatgtgcctgagaccatgaatgaggtgctggacatgtctgatgatgaggtgaggaaggccaatgcccctgagatgctgagtgatggagagtacatcagtgatgtggaggagggggaggatgccatgaccggggacacagacaagtacctgggcccccaggacctgaaggagctgggagatgacagcctgcctgctgagggctacatgggcttcagcctgggcgcccggagcgccagcctgcgctccttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaagtgcacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgaaattgtgaagaagatcctgggcaacaaggccaccttcagccccatcgtgacagtggagcccaggaggaggaagttccacaagcccatcaccatgaccatccctgtgcccccaccttctggagagggcgtgtccaatggctacaagggggacaccacccccaacctgcggctgctgtgcagcatcaccggcggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggaaaatcggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgagcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgacatcgtgaccctgctggagggccccatctttgattatggcaacatcagcggcaccaggagctttgctgatgaaaataatgtgttccatgaccctgtggatggctaccccagcctgcaggtggagctggagacccccaccggcctgcactacaccccacccacccccttccagcaggatgactacttcagtgacatcagcagcattgagagccccctgcggacccccagccggctgagtgatggcctggtgcccagccagggcaacatcgagcacagcgcagatggcccccctgtggtgacagcagaagatgccagcctggaggacagcaagctggaggacagcgtgcccctgacagagatgcctgaggccgtggatgtggatgagagccagctggagaatgtgtgcctgtcctggcagaatgagaccagcagcggcaacctggagagctgtgcccaggcccggcgggtgactggaggcctgctggaccggctggatgacagcccagaccagtgccgggacagcatcaccagctacctgaagggggaggccggcaagtttgaggccaacggcagccacacagagatcaccccagaggccaagaccaagagctacttccctgagagccagaatgatgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgtgtgcctgtgtccatgaagaagatgagcaggaccagccctgcagatggcaagccccggctgagcctgcacgaggaggagggcagcagcggcagcgagcagaagggggagggcttcaaggtgaagaccaagaaggagatccgccacgtggagaagaagagccacagctag

SEQ ID NO: 143624 - DNA, 3387 bp, Artificial Sequence
  Description of Artificial Sequence: Synthetic coding sequence
atggccacccagggcgaccacctgaactgtgtgcagctgctgctgcagcacaacgtgcctgtggatgatgtgaccaatgactacctgacagccctgcacgtggccgcccactgcggccactacaaggtggccaaggtgctgctggacaagaaggccaaccccaatgccaaggccctgaatggcttcacccccctgcacatcgcctgcaagaagaaccgcatcaaggtgatggagctgctgctgaagcatggagccagcatccaggccgtgacagaaagtggcctgacccccatccacgtggccgccttcatgggccacgtgaacatcgtgtcccagctgatgcaccacggggccagccccaacaccaccaacgtgcggggggagacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccatggagccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccatgctgctgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaacgtgaacctgagcaacaagagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaaggagaagatgccatgactggagacacagacaagtacctgggcccccaggacctgaaggagctgggagatgacagcctgcctgctgagggctacatgggcttcagcctgggcgcccggagcgccagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaagtgcacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgaaattgtgaagaagatcctgggcaacaaggccaccttcagccccatcgtgacagtggagcccaggaggaggaagttccacaagcccatcaccatgaccatccctgtgcccccaccttctggagagggcgtgtccaatggctacaagggggacaccacccccaacctgcggctgctgtgcagcatcaccggcggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggaaaatcggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgtctgagttccccaacaccttcaccaacacctggatcttcatccggcgggacatcttcagcatccagaccaagttctag

SEQ ID NO: 143625 - DNA, 5544 bp, Artificial Sequence
  Description of Artificial Sequence: Synthetic coding sequence
agtgatgccaatgccagctacctgcgggccgcccgggccggccacctggagaaggccctggactacatcaagaatggagtggacatcaacatctgcaaccagaatggcctgaatgccctgcacctggccagcaaggagggccacgtggaggtggtgtctgagctgctgcagcgggaggccaacgtggatgctgccaccaagaagggcaacacagccctgcacatcgccagcctggccggccaggccgaggtggtgaaggtgctggtgaccaatggagccaacgtgaatgcccagagccagaatggcttcacccccctgtacatggccgcccaggagaaccacctggaggtggtgaagttcctgctggacaacggggccagccagagcctggccacagaagatggcttcacccccctggccgtggccctgcagcagggccatgaccaggtggtgtccctgctgctggagaatgacaccaagggcaaggtgcggctgcctgccctgcacatcgccgccaggaaggatgacaccaaggccgccgccctgctgctgcagaatgacaacaatgctgatgtggagagcaagagcggcttcacccccctgcacatcgccgcccactacggcaacatcaacgtggccaccctgctgctgaacagagctgctgctgtggacttcaccgccagaaatgacatcacccccctgcacgtggccagcaagagaggaaatgccaacatggtgaagctgctgctggacagaggagccaagattgatgccaagaccagagatggcctgacccccctgcactgtggggcccggagcggccacgagcaggtggtggagatgctgctggaccgggccgcccccatcctgagcaagaccaagaatggcctgagccccctgcacatggccacccagggcgaccacctgaactgtgtgcagctgctgctgcagcacaacgtgcctgtggatgatgtgaccaatgactacctgacagccctgcacgtggccgcccactgcggccactacaaggtggccaaggtgctgctggacaagaaggccaaccccaatgccaaggccctgaatggcttcacccccctgcacatcgcctgcaagaagaaccgcatcaaggtgatggagctgctgctgaagcacggggccagcatccaggccgtgacagagagcggcctgacccccatccacgtggccgccttcatgggccacgtgaacatcgtgtcccagctgatgcaccacggggccagccccaacaccaccaacgtgcggggggagacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccacggggccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccacgccgccgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaacgtgaacctgagcaacaagagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaggtgaggaaggccaatgcccctgagatgctgagtgatggagagtacatcagtgatgtggaggagggcaaccgctgcacctggtacaagatccccaaggtgcaggagttcaccgtgaagtcagaagatgccatgactggagacacagacaagtacctgggcccccaggacctgaaggagctgggagatgacagcctgcctgctgagggctacatgggcttcagcctgggcgcccggagcgccagcctgcggagcttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaaatgtacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgagatcgtgaagaagatcctgggcaacaaggccaccttcagccccatcgtgacagtggagcccaggaggaggaagttccacaagcccatcaccatgaccatccctgtgcccccacccagcggggagggcgtgtccaatggctacaagggggacaccacccccaacctgcggctgctgtgcagcatcactggaggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggagaaccggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgagcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgatattgtgaccctgctggagggccccatctttgattatggcaacatcagcggcaccaggagctttgctgatgagaacaacgtgttccatgaccctgtggatggctaccccagcctgcaggtggagctggagacccccaccggcctgcactacaccccacccacccccttccagcaggatgactacttcagtgacatcagcagcattgagagccccctgcggacccccagccggctgagtgatggcctggtgcccagccagggcaacatcgagcacagcgcagatggcccccctgtggtgacagcagaagatgccagcctggaggacagcaagctggaggacagcgtgcccctgacagagatgcctgaggccgtggatgtggatgagagccagctggagaatgtgtgcctgtcctggcagaatgagaccagcagcggcaacctggagagctgtgcccaggcccggcgggtgactggaggcctgctggaccggctggatgacagcccagaccagtgccgggacagcatcaccagctacctgaagggggaggccggcaagtttgaggccaacggcagccacacagagatcaccccagaggccaagaccaagagctacttccctgagagccagaatgatgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgtgtgcctgtgtccatgaagaagatgagcaggaccagccctgcagatggcaagccccggctgagcctgcacgaggaggagggcagcagcggcagcgagcagaagcagggcgagggcttcaaggtgaagaccaagaaggagatccgccacgtggagaagaagagccacagctag

SEQ ID NO: 143626 - DNA, 3354 bp, Artificial Sequence
  Description of Artificial Sequence: Synthetic coding sequence
atggccacccagggcgaccacctgaactgtgtgcagctgctgctgcagcacaacgtgcctgtggatgatgtgaccaatgactacctgacagccctgcacgtggccgcccactgcggccactacaaggtggccaaggtgctgctggacaagaaggccaaccccaatgccaaggccctgaatggcttcacccccctgcacatcgcctgcaagaagaaccgcatcaaggtgatggagctgctgctgaagcatggagccagcatccaggccgtgacagaaagtggcctgacccccatccacgtggccgccttcatgggccacgtgaacatcgtgtcccagctgatgcaccacggggccagccccaacaccaccaacgtgcggggggagacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccatggagccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccatgctgctgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaatgacagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaaggagaagatgccatgaccggggacacagacaagtacctgggcccccaggacctgaaggagctgggagatgacagcctgcctgctgagggctacatgggcttcagcctgggcgcccggagcgccagcctgcgctccttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaagtgcacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgaaattgtgaagaagatcctgggcaacaaggccaccttcagccccatcgtgacagtggagcccaggaggaggaagttccacaagcccatcaccatgaccatccctgtgcccccaccttctggagagggcgtgtccaatggctacaagggggacaccacccccaacctgcggctgctgtgcagcatcaccggcggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggaaaatcggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgtctgagttccccaacaccttcaccaacctgcggggcttctcctag

SEQ ID NO: 143627 - DNA, 2436 bp, Artificial Sequence
  Description of Artificial Sequence: Synthetic coding sequence
atggccctgccccagagtgaagatgccatgactggagacacagacaagtacctgggcccccaggacctgaaggagctgggagatgacagcctgcctgctgagggctacatgggcttcagcctgggcgcccggagcgccagcctgcggagcttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaaatgtacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgagatcgtgaagaagatcctgggcaacaaggccaccttcagccccatcgtgacagtggagcccaggaggaggaagttccacaagcccatcaccatgaccatccctgtgcccccacccagcggggagggcgtgtccaatggctacaagggggacaccacccccaacctgcggctgctgtgcagcatcactggaggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggagaaccggctgcccttcagcatcaagatccgggacaccagccaggagccctgtggccgcctgtccttcctgaaggagcccaagaccaccaagggcctgccccagacagctgtgtgcaacctgaacatcaccctgcctgcccacaagaagattgagaagacagaccggcggcagagctttgccagcctggccctgaggaagcgctacagctacctgacagagcccggcatgagcccccagagcccctgtgagaggacagacatccgcatggccatcgtggccgaccacctgggcctgtcctggacagagctggcccgggagctgaacttctctgtggatgagatcaaccagatccgggtggagaaccccaacagcctcatcagccagagcttcatgctgctgaagaagtgggtgaccagagatggcaagaatgccaccacagatgccctgacctctgtgctgaccaagatcaacagaattgatattgtgaccctgctggagggccccatctttgattatggcaacatcagcggcaccaggagctttgctgatgagaacaacgtgttccatgaccctgtggatggctaccccagcctgcaggtggagctggagacccccaccggcctgcactacaccccacccacccccttccagcaggatgactacttcagtgacatcagcagcattgagagccccctgcggacccccagccggctgagtgatggcctggtgcccagccagggcaacatcgagcacagcgcagatggcccccctgtggtgacagcagaagatgccagcctggaggacagcaagctggaggacagcgtgcccctgacagagatgcctgaggccgtgatgtag

SEQ ID NO: 143628 - DNA, 2796 bp, Artificial Sequence
  Description of Artificial Sequence: Synthetic coding sequence
ttcaccctggcccacgtgccccagagaggagaaacagccctgcacatggccgcccggagcggccaggccgaggtggtgcgctacctggtgcaggatggagcccaggtggaggccaaggccaaggatgaccagacccccctgcacatcagcgcccggctgggcaaggctgacatcgtgcagcagctgctgcagcagggcgccagccccaatgctgccaccaccagcggctacacccccctgcacctgagcgcccgggagggccatgaagatgtggccgccttcctgctggaccacggggccagcctgagcatcaccaccaagaagggcttcacccccctgcacgtggccgccaagtatggcaagctggaggtggccaacctgctgctgcagaagagcgccagcccagatgctgctgggaagagcggcctgacccccctgcacgtggccgcccactatgacaaccagaaggtggccctgctgctgctggaccagggcgccagcccccacgccgccgccaagaatggctacacccccctgcacatcgccgccaagaagaaccagatggacatcgccaccaccctgctggagtatggagcagatgccaatgctgtgacccggcagggcatcgcctctgtgcacctggccgcccaggagggccacgtggacatggtgtccctgctgctgggcagaaatgccaacgtgaacctgagcaacaagagcggcctgacccccctgcacctggccgcccaggaggacagagtgaatgtggccgaggtgctggtgaaccagggcgcccacgtggatgcccagaccaagatgggctacacccccctgcacgtgggctgccactacggcaacatcaagatcgtgaacttcctgctgcagcacagcgccaaggtgaatgccaagaccaagaatggctacacccccctgcaccaggccgcccagcagggccacacccacatcatcaacgtgctgctgcagaacaatgccagccccaatgagctgactgtgaatggaaacacagccctgggcatcgcccggcggctgggctacatctctgtggtggacaccctgaagatcgtgacagaggagaccatgaccaccaccaccgtgacagagaagcacaagatgaatgtgcctgagaccatgaatgaggtgctggacatgtctgatgatgaaggagaagatgccatgaccggggacacagacaagtacctgggcccccaggacctgaaggagctgggagatgacagcctgcctgctgagggctacatgggcttcagcctgggcgcccggagcgccagccgctccttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggctacagcagccccctgccccagtatgacagccgcttcctggtgtccttcatggtggatgcccggggcggctccatgaggggcagccgccaccacggcatgaggatcatcatcccccccaggaagtgcacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgaaattgtgaagaagatcctgggcaacaaggccaccttcagccccatcgtgacagtggagcccaggaggaggaagttccacaagcccatcaccatgaccatccctgtgcccccaccttctggagagggcgtgtccaatggctacaagggggacaccacccccaacctgcggctgctgtgcagcatcaccggcggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgccctgcagccagaagcaggtgcacttcatcacctacagccgctatgaggtgctcttctgtggcctgaacagcacccactacaagatccccagcgccctgctgatcctgctgctgctgtag

SEQ ID NO: 143629 - DNA, 1647 bp, Artificial Sequence
  Description of Artificial Sequence: Synthetic coding sequence
agcctgcctgagagtgaagatgccatgaccggggacacagacaagtacctgggcccccaggacctgaaggagctgggagatgacagcctgcctgctgagggctacatgggcttcagcctgggcgcccggagcgccagcctgcgctccttcagcagtgacaggagctacaccctgaacagaagcagctatgcccgggacagcatgatgattgaggagctgctggtgcccagcaaggagcagcacctgaccttcacccgggagtttgacagcgacagcctgcggcactacagctgggccgctgacaccctggacaacgtgaacctggtgagcagccccatccacagcggcttcctggtgtccttcatggtggatgcccggggcggctccatgaggggcagccgccaccacggcatgaggatcatcatcccccccaggaagtgcacagcccccacccgcatcacctgccgcctggtgaagaggcacaagctggccaaccccccacccatggtggagggggagggcctggccagccggctggtggagatgggccctgctggggcccagttcctgggccctgtgattgtggagatcccccacttcggctccatgaggggcaaggagcgggagctgattgtgctgcggagtgaaaatggagagacctggaaggagcaccagtttgacagcaagaatgaagacctgacagagctgctgaatggcatggatgaggagctggacagccctgaggagctgggcaagaagaggatctgccgcatcatcaccaaggacttcccccagtactttgctgtggtgagccgcatcaagcaggagagcaaccagatcggccctgagggcggcatcctgagcagcaccaccgtgcccctggtgcaggccagcttccctgagggcgccctgaccaagaggatccgggtgggcctgcaggcccagcctgtgcctgatgaaattgtgaagaagatcctgggcaacaaggccaccttcagccccatcgtgacagtggagcccaggaggaggaagttccacaagcccatcaccatgaccatccctgtgcccccaccttctggagagggcgtgtccaatggctacaagggggacaccacccccaacctgcggctgctgtgcagcatcaccggcggcaccagccctgcccagtgggaggacatcaccggcaccacccccctgaccttcatcaaggactgtgtgtccttcaccaccaacgtgtctgcccgcttctggctggccgactgccaccaggtgctggagaccgtgggcctggccacccagctgtaccgggagctgatctgtgtgccctacatggccaagtttgtggtgtttgccaagatgaatgaccctgtggagagcagcctgcgctgcttctgcatgacagatgacaaggtggacaagaccctggagcagcaggagaactttgaggaggtggcccggagcaaggacatcgaggtgctggagggcaagcccatctacgtggactgctacggcaacctggcccccctgaccaagggcggccagcagctggtgttcaacttctacagcttcaaggaaaatcggctgcccttcagcatcaagatccgggacaccagccagaacatcgtgcagctgagctgcctgctgtag

SEQ ID NO: 143630 - DNA, 1443 bp, Artificial Sequence
  Description of Artificial Sequence: Synthetic coding sequence
atggctgtggcccgggccgccctgggccccctggtgacaggcctgtatgatgtgcaggccttcaagtttggagactttgtgctgaagagcggcctgagcagccccatctacatcgacctgcggggcatcgtgtcccggccccggctgctgagccaggtggccgacatcctcttccagacagcccagaatgccggcatcagctttgacacagtgtgtggggtgccctacacagccctgcccctggccaccgtcatctgcagcaccaaccagatccccatgctgatccggaggaaggagaccaaggactatggcaccaagaggctggtggagggcaccatcaaccctggagagacctgcctgatcattgaagatgtggtgaccagcggcagctctgtgctggagaccgtggaggtgctgcagaaggagggcctgaaggtgacagatgccatcgtgctgctggaccgggagcagggcggcaaggacaagctgcaggcccacggcatccggctgcacagcgtgtgcaccctgagcaagatgctggagatcctggagcagcagaagaaggtggatgctgagaccgtgggccgggtgaagcgcttcatccaggagaatgtgtttgtggccgccaaccacaacggcagccccctgagcatcaaggaggcccccaaggagctgagctttggagcccgggcagagctgccccgcatccaccctgtggccagcaagctgctgcggctgatgcagaagaaggagaccaacctgtgcctgtctgcagatgtgtccctggcccgggagctgctgcagctggctgatgccctgggccccagcatctgcatgctgaagacccacgtggacatcctgaatgacttcaccctggatgtgatgaaggagctgatcaccctggccaagtgccacgagttcctgatctttgaggacaggaagtttgctgacatcggcaacacagtgaagaagcagtatgagggcggcatcttcaagatcgcctcctgggccgacctggtgaatgcccacgtggtgcccggcagcggcgtggtgaagggcctgcaggaggtgggcctgcccctgcaccggggctgcctgctgattgctgagatgagcagcacaggcagcctggccactggagactacaccagggctgctgtgaggatggccgaggagcacagcgagtttgtggtgggcttcatcagcggcagccgggtgtccatgaagccagagttcctgcacctgaccccaggagtgcagctggaggccggcggggacaacctgggccagcagtacaacagcccccaggaggtgattggcaagaggggcagtgacatcatcatcgtgggccggggcatcatctctgctgctgaccggctggaggccgctgagatgtacaggaaggccgcctgggaggcctacctgagccggctgggcgtgtag

SEQ ID NO: 143631 - DNA, 1218 bp, Artificial Sequence
  Description of Artificial Sequence: Synthetic coding sequence
atggacaccagtgacctgtttgccagctgcaggaaaggagatgtgggccgggtgcgctacctgctggagcaggtgctgtacctgctggccaatggagcccgctgtgaggccaacacctttgatggagagcgctgcctgtatggagccctgagtgaccccatcagaagagccctgcgggactacaagcaccccctgctgtgggacctgctgagtgacctggaggccaagtgtgagaaggtgtctgaatttgtggccagcaagccaggcacctgtgtgaaggtgctgaccatcgagcccccacctgctgacccccggctgcgggaggacatggccctgctggccgactgtgccctgcccccagagctgcgggccttcttctgtggccgcagtgactacttccgggccctgctggatgaccacttccgggagagcgaggagcccgccaccagcggcggccccccagctgtgaccctgcacggcatcagcccagatgtgttcacccacgtgctgtactacatgtacagcgaccacacagagctgagccctgaggccgcctatgatgtgctgtctgtggccgacatgtacctgctgcccggcctgaagaggctgtgtggccgcagcctggcccagatgctggatgaggacacagtggtgggcgtgtggagggtggccaagctgttccggctggcccggctggaggaccagtgcacagagtacatggccaaggtgattgagaagctggtggagagagaagattttgtggaggccgtgaaggaggaggccgctgctgtggccgcccggcaggagacagacagcatccccctggtggatgacatccgcttccacgtggccagcacagtgcagacctacagcgccatcgaggaggcccagcagaggctgcgggccctggaggacacctccatgtgcatgaggctgtgtgccgccctgctgcctgccccctgcaccctgcgggcctcctggggcgtgcggggggcccagtggggcttcagcagcctgcacgagcccggggacccccggggcggcagcatctgggatgagcccccacctccaaatgcccaggccagcccccaggaccccggcggcggccaccacagcggcaagccaggagtgggcgtgggcttcggcctgagcaccttcctgctgcagatcccccccacccaccccagccccaagagcagccccctggccctggcctag

SEQ ID NO: 143632 - DNA, 1011 bp, Artificial Sequence
  Description of Artificial Sequence: Synthetic coding sequence
atgctggacaccaagtggaagggcaagtctgtggtggtgctgcggcaccccctcatcaaccctgtggccttcggggccctgctgcagtacctgtacacaggccgcctggacatcggcgtggagcacgtgtctgactgtgagcggctggccaagcagtgccagctgtgggacctgctgagtgacctggaggccaagtgtgagaaggtgtctgaatttgtggccagcaagccaggcacctgtgtgaaggtgctgaccatcgagcccccacctgctgacccccggctgcgggaggacatggccctgctggccgactgtgccctgcccccagagctgcggggggacctgtgggagctgcccttcccctgcccagatggcttcaacagctgcccagacatctgcttccgggtggccggctgcagcttcctgtgccacaaggccttcttctgtggccgcagtgactacttccgggccctgctggatgaccacttccgggagagcgaggagcccgccaccagcggcggccccccagctgtgaccctgcacggcatcagcccagatgtgttcacccacgtgctgtactacatgtacagcgaccacacagagctgagccctgaggccgcctatgatgtgctgtctgtggccgacatgtacctgctgcccggcctgaagaggctgtgtggccgcagcctggcccagatgctggatgaggacacagtggtgggcgtgtggagggtggccaagctgttccggctggcccggctggaggaccagtgcacagagtacatggccaaggtgattgagaagctggtggagagagaagattttgtggaggccgtgaaggaggaggccgctgctgtggccgcccggcaggagacagacagcatccccctggtggatgacatccgcttccacgtggccagcacagtgcagacctacagcgccatcgaggaggcccagcagaggctgcgggccctggaggacctgctggtgtccatcggcctggactgctag

SEQ ID NO: 143633 - DNA, 1011 bp, Artificial Sequence; identical to SEQ ID NO: 143632
  Description of Artificial Sequence: Synthetic coding sequence

SEQ ID NO: 143634 - DNA, 1011 bp, Artificial Sequence; identical to SEQ ID NO: 143632
  Description of Artificial Sequence: Synthetic coding sequence

SEQ ID NO: 143635 - DNA, 2061 bp, Artificial Sequence
  Description of Artificial Sequence: Synthetic coding sequence
atggaggccagccaggagggccacctggagctggtgaagtacctgctggccagcggggccaacgtgcacgccaccacagccaccggggacacagccctgacctacgcctgtgaaaatggccacacagatgtggctgatgtgctgctgcaggccggggctgacctggacaagcaggaggacatgaagaccatcctggagggcatcgaccctgccaagcaccaggagcacgagagcgagggcggccgcacccccctgatgaaggccgcccgggccggccacctgtgcaccgtgcagttcctgatcagcaaaggagccaacgtgaacagagccacagccaacaatgaccacacagtggtgtccctggcctgtgccggcggccacctggccgtggtggagctgctgctggcccatggagctgaccccacccaccggctgaaggatggcagcaccatgctgattgaagctgccaagggcggccacaccaacgtggtgtcctacctgctggactaccccaacaacgtgctgtctgtgcccaccacagatgtgtcccagctgcccccacccagccaggaccagagccaggagccagacaggaccagccaggagaacagccctgccctgctgggcgtgcagaaggctgtgtccaccagggtgcccaccggcagcaacagcagcagccagaccacagagtgcctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggacatgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctatgcagaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcagaaaaggacatgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagcgggagaagaggaaggagaagaggaagaagaagaaggaggagcagaagaggaagcaggaggaggatgaatag

SEQ ID NO: 143636 - DNA, 7623 bp, Artificial Sequence
  Description of Artificial Sequence: Synthetic coding sequence
atgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccaccggcaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccacggggccggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccactggagacacagccctgacctacgcctgtgaaaatggccacacagatgtggctgatgtgctgctgcaggccggggctgacctggagcacgagagcgagggcggccgcacccccctgatgaaggccgcccgggccggccacctgtgcaccgtgcagttcctgatcagcaaaggagccaacgtgaacagagccacagccaacaatgaccacacagtggtgtccctggcctgtgccggcggccacctggccgtggtggagctgctgctggcccatggagctgaccccacccaccggctgaaggatggcagcaccatgctgattgaagctgccaagggcggccacaccaacgtggtgtcctacctgctggactaccccaacaacgtgctgtctgtgcccaccacagatgtgtcccagctgcccccacccagccaggaccagagccaggtgccccgggtgcccacccacaccctggccatggtggtgcccccccaggagccagacaggaccagccaggagaacagccctgccctgctgggcgtgcagaagggcaccagcaagcagaagagcagcagcctgcaggtggccgaccaggacctgctgcccagcttccacccctaccagcccctggagtgcatcgtggaggagacagagggcaagctgaatgagctgggccagaggatcagcgccatcgagaaggcccagctgaagagcctggagctgatccagggcgagcccctgaacaaggacaagattgaggagctgaagaagaaccgggaggagcaggtgcagaagaagaagaagatcctgaaggagctgcagaaggtggagcggcagctgcagatgaagacccagcagcagttcaccaaggagtacctggagaccaagggccagaaggacacagtgtccctgcaccagcagtgcagccacagaggagtcttccctgagggggagggagatggcagcctgcctgaggaccacttcagcgagctgccccaggtggacaccatcctcttcaaggacaatgatgtggatgatgagcagcagagcccccccagcgctgagcagattgactttgtgcctgtgcagcccctgagcagcccccagtgcaacttcagcagtgacctgggcagcaatggcaccaacagcctggagctgcagaaggtgtctggcaaccagcagatcgtgggccagccccagatcgccatcactggacatgaccagggcctgctggtgcaggagccagatggcctgatggtggccaccccagcccagaccctgacagacaccctggatgacctgattgctgctgtgtccaccagggtgcccaccggcagcaacagcagcagccagaccacagaatgtctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcaggaagggccacgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagcgggagaagaggaaggagaagaggaagaagaagaaggaggagcagaagaggaagcaggaggaggatgaggagaacaagcccaaggaaaattctgagctgcctgaagatgaagatgaggaggagaatgatgaagatgtggagcaggaggtgcccatcgagccccccagcgccaccaccaccaccaccatcggcatcagcgccaccagcgccaccttcaccaacgtgtttgggaagaagagggccaacgtggtgaccacccccagcaccaacaggaagaacaagaagaacaagaccaaggagaccccacccacagcccacctgatcctgcctgagcagcacatgagcctggcccagcagaaggctgacaagaacaagatcaatggagagccccggggcggcggggccggcggcaacagcgacagcgacaacctggacagcacagactgcaacagcgagagcagcagcggcggcaagagccaggagctgaactttgtgatggatgtgaacagcagcaagtaccccagcctgctgctgcacagccaggaggagaagaccagcacagccaccagcaagacccagacccggctggagggggaggtgacccccaacagcctgagcaccagctacaagacagtgtccctgcccctgagcagccccaacatcaagctgaacctgaccagccccaagaggggccagaagcgggaggagggctggaaggaggtggtgagaagaagcaagaagctgtctgtgcctgcctctgtggtgagccgcatcatgggccggggcggctgcaacatcacagccatccaggatgtgactggagcccacattgatgtggacaagcagaaggacaagaatggagagaggatgatcaccatccggggcggcacagagagcaccaggtatgctgtgcagctgatcaatgccctgatccaggaccctgccaaggagctggaggacctgatccccaagaaccacatccgcaccccagccagcaccaagagcatccacgccaacttcagcagcggcgtgggcaccacagctgccagcagcaagaatgccttccccctgggcgcccccaccctggtgaccagccaggccaccaccctgagcaccttccagcctgccaacaagctgaacaagaatgtgcccaccaacgtgcgcagcagcttccctgtgtccctgcccctggcctacccccacccccactttgccctgctggccgcccagaccatgcagcagatccgccacccccggctgcccatggcccagtttggaggcaccttcagccccagccccaacacctggggccccttccctgtgcggcctgtgaaccctggcaacaccaacagcagccccaagcacaacaacaccagccggctgcccaaccagaatggaacagtgctgcccagcgagagcgctggcctggccacagccagctgccccatcaccgtgtcctctgtggtggccgccagccagcagctgtgtgtgaccaacaccaggacccccagctctgtgaggaagcagctgtttgcctgtgtgcccaagaccagccccccagccaccgtcatcagctctgtgaccagcacctgcagcagcctgcccagcgtgtcctctgcccccatcaccagcggccaggcccccaccaccttcctgcctgccagcaccagccaggcccagctgagcagccagaagatggagagcttctctgctgtgccccccaccaaggagaaggtgtccacccaggaccagcccatggccaacctgtgcacccccagcagcacagccaacagctgcagcagcagcgccagcaacacccctggggcccctgagacccaccccagcagcagccccacccccaccagcagcaacacccaggaggaggcccagcccagctctgtgtctgacctgagccccatgtccatgccctttgccagcaacagcgagcccgcccccctgaccctgaccagccccaggatggtggccgctgacaaccaggacaccagcaacctgccccagctggccgtgcctgccccccgggtgagccacaggatgcagccccggggcagcttctacagcatggtgcccaatgccaccatccaccaggacccccagagcatctttgtgaccaaccctgtgaccctgaccccaccccagggccccccagctgctgtgcagctgagcagcgctgtgaacatcatgaatggcagccagatgcacatcaacccagccaacaagagcctgccccccaccttcggccctgccaccctcttcaaccacttcagcagcctgtttgacagcagccaggtgcctgccaaccagggctggggagatggccccctgagcagccgggtggccacagatgccagcttcaccgtgcagagcgccttcctgggcaacagcgtgctgggccacctggagaacatgcacccagacaacagcaaggcccctggcttccggccccccagccagagggtgtccaccagccctgtgggcctgcccagcattgaccccagcggcagcagccccagcagcagcagcgcccccctggccagcttcagcggcatccctggcaccagggtcttcctgcagggccctgcccctgtgggcacccccagcttcaaccggcagcacttcagcccccacccctggaccagcgccagcaacagctgtgacagccccatccccagcgtgagcagcggcagcagcagccccctgagcgccaccagcgccccacccaccctgggccagcccaagggcgtgtctgccagccaggacaggaagatccccccacccatcggcacagagcggctggcccgcatccggcagggcggctctgtggcccaggccccagctggcaccagctttgtggcccctgtgggccacagcggcatctggagctttggagtgaatgctgtgtctgagggcctgagcggctggagccagagcgtgatgggcaaccaccccatgcaccagcagctgagtgaccccagcaccttcagccagcaccagcccatggagagagatgattctggcatggtggcccccagcaacatcttccaccagcccatggccagcggctttgtggacttcagcaagggcctgcccatctccatgtatggaggcaccatcatccccagccacccccagctggctgatgtgcctgggggccccctcttcaacggcctgcacaacccagaccctgcctggaaccccatgatcaaggtgatccagaacagcacagagtgcacagatgcccagcagtag

SEQ ID NO: 143637 - DNA, 7854 bp, Artificial Sequence
  Description of Artificial Sequence: Synthetic coding sequence
atgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccaccggcaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccacggggccggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccactggagacacagccctgacctacgcctgtgaaaatggccacacagatgtggctgatgtgctgctgcaggccggggctgacctggagcacgagagcgagggcggccgcacccccctgatgaaggccgcccgggccggccacctgtgcaccgtgcagttcctgatcagcaaaggagccaacgtgaacagagccacagccaacaatgaccacacagtggtgtccctggcctgtgccggcggccacctggccgtggtggagctgctgctggcccatggagctgaccccacccaccggctgaaggatggcagcaccatgctgattgaagctgccaagggcggccacaccaacgtggtgtcctacctgctggactaccccaacaacgtgctgtctgtgcccaccacagatgtgtcccagctgcccccacccagccaggaccagagccaggtgccccgggtgcccacccacaccctggccatggtggtgcccccccaggagccagacaggaccagccaggagaacagccctgccctgctgggcgtgcagaagggcaccagcaagcagaagagcagcagcctgcaggtggccgaccaggacctgctgcccagcttccacccctaccagcccctggagtgcatcgtggaggagacagagggcaagctgaatgagctgggccagaggatcagcgccatcgagaaggcccagctgaagagcctggagctgatccagggcgagcccctgaacaaggacaagattgaggagctgaagaagaaccgggaggagcaggtgcagaagaagaagaagatcctgaaggagctgcagaaggtggagcggcagctgcagatgaagacccagcagcagttcaccaaggagtacctggagaccaagggccagaaggacacagtgtccctgcaccagcagtgcagccacagaggagtcttccctgagggggagggagatggcagcctgcctgaggaccacttcagcgagctgccccaggtggacaccatcctcttcaaggacaatgatgtggatgatgagcagcagagcccccccagcgctgagcagattgactttgtgcctgtgcagcccctgagcagcccccagtgcaacttcagcagtgacctgggcagcaatggcaccaacagcctggagctgcagaaggtgtctggcaaccagcagatcgtgggccagccccagatcgccatcactggacatgaccagggcctgctggtgcaggagccagatggcctgatggtggccaccccagcccagaccctgacagacaccctggatgacctgattgctgctgtgtccaccagggtgcccaccggcagcaacagcagcagccagaccacagaatgtctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcaggaagggccacgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagcgggagaagaggaaggagaagaggaagaagaagaaggaggagcagaagaggaagcaggaggaggatgaggagaacaagcccaaggaaaattctgagctgcctgaagatgaagatgaggaggagaatgatgaagatgtggagcaggaggtgcccatcgagccccccagcgccaccaccaccaccaccatcggcatcagcgccaccagcgccaccttcaccaacgtgtttgggaagaagagggccaacgtggtgaccacccccagcaccaacaggaagaacaagaagaacaagaccaaggagaccccacccacagcccacctgatcctgcctgagcagcacatgagcctggcccagcagaaggctgacaagaacaagatcaatggagagccccggggcggcggggccggcggcaacagcgacagcgacaacctggacagcacagactgcaacagcgagagcagcagcggcggcaagagccaggagctgaactttgtgatggatgtgaacagcagcaagtaccccagcctgctgctgcacagccaggaggagaagaccagcacagccaccagcaagacccagacccggctggagggggaggtgacccccaacagcctgagcaccagctacaagacagtgtccctgcccctgagcagccccaacatcaagctgaacctgaccagccccaagaggggccagaagcgggaggagggctggaaggaggtggtgagaagaagcaagaagctgtctgtgcctgcctctgtggtgagccgcatcatgggccggggcggctgcaacatcacagccatccaggatgtgactggagcccacattgatgtggacaagcagaaggacaagaatggagagaggatgatcaccatccggggcggcacagagagcaccaggtatgctgtgcagctgatcaatgccctgatccaggaccctgccaaggagctggaggacctgatccccaagaaccacatccgcaccccagccagcaccaagagcatccacgccaacttcagcagcggcgtgggcaccacagctgccagcagcaagaatgccttccccctgggcgcccccaccctggtgaccagccaggccaccaccctgagcaccttccagcctgccaacaagctgaacaagaatgtgcccaccaacgtgcgcagcagcttccctgtgtccctgcccctggcctacccccacccccactttgccctgctggccgcccagaccatgcagcagatccgccacccccggctgcccatggcccagtttggaggcaccttcagccccagccccaacacctggggccccttccctgtgcggcctgtgaaccctggcaacaccaacagcagccccaagcacaacaacaccagccggctgcccaaccagaatggaacagtgctgcccagcgagagcgctggcctggccacagccagctgccccatcaccgtgtcctctgtggtggccgccagccagcagctgtgtgtgaccaacaccaggacccccagctctgtgaggaagcagctgtttgcctgtgtgcccaagaccagccccccagccaccgtcatcagctctgtgaccagcacctgcagcagcctgcccagcgtgtcctctgcccccatcaccagcggccaggcccccaccaccttcctgcctgccagcaccagccaggcccagctgagcagccagaagatggagagcttctctgctgtgccccccaccaaggagaaggtgtccacccaggaccagcccatggccaacctgtgcacccccagcagcacagccaacagctgcagcagcagcgccagcaacacccctggggcccctgagacccaccccagcagcagccccacccccaccagcagcaacacccaggaggaggcccagcccagctctgtgtctgacctgagccccatgtccatgccctttgccagcaacagcgagcccgcccccctgaccctgaccagccccaggatggtggccgctgacaaccaggacaccagcaacctgccccagctggccgtgcctgccccccgggtgagccacaggatgcagccccggggcagcttctacagcatggtgcccaatgccaccatccaccaggacccccagagcatctttgtgaccaaccctgtgaccctgaccccaccccagggccccccagctgctgtgcagctgagcagcgctgtgaacatcatgaatggcagccagatgcacatcaacccagccaacaagagcctgccccccaccttcggccctgccaccctcttcaaccacttcagcagcctgtttgacagcagccaggtgcctgccaaccagggctggggagatggccccctgagcagccgggtggccacagatgccagcttcaccgtgcagagcgccttcctgggcaacagcgtgctgggccacctggagaacatgcacccagacaacagcaaggcccctggcttccggccccccagccagagggtgtccaccagccctgtgggcctgcccagcattgaccccagcggcagcagccccagcagcagcagcgcccccctggccagcttcagcggcatccctggcaccagggtcttcctgcagggccctgcccctgtgggcacccccagcttcaaccggcagcacttcagcccccacccctggaccagcgccagcaacagcagcaccagcgccccacccaccctgggccagcccaagggcgtgtctgccagccaggacaggaagatccccccacccatcggcacagagcggctggcccgcatccggcagggcggctctgtggcccaggccccagctggcaccagctttgtggcccctgtgggccacagcggcatctggagctttggagtgaatgctgtgtctgagggcctgagcggctggagccagagcgtgatgggcaaccaccccatgcaccagcagctgagtgaccccagcaccttcagccagcaccagcccatggagagagatgacagcggcatggtggcccccagcaacatcttccaccagcccatggccagcggctttgtggacttcagcaagggcctgcccatctccatgtatggaggcaccatcatccccagccacccccagctggctgatgtgcctgggggccccctcttcaacggcctgcacaacccagaccctgcctggaaccccatgatcaaggtgatccagaacagcacagaatgtacagatgcccagcaggccagcctgctgcccagcgtgcctgccctgaagggggagatccccagcccccagctgacccggcccaagaagagaattggccggcccatggtggccagccccaaccagaggcaccaggaccacctgcggcccaaggtgcctgctggggtgcaggagctgacccactgcccagacacccccctgctgccccccagcgacagccggggccacaacagcagcaacagccccagcctgcaggccggcggcgctgagggcgctggggaccggggccgggacaccaggtag

SEQ ID NO: 143638 - DNA, 3024 bp, Artificial Sequence
  Description of Artificial Sequence: Synthetic coding sequence
atggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccaccggggacacagccctgacctacgcctgtgaaaatggccacacagatgtggctgatgtgctgctgcaggccggggctgacctggacaagcaggaggacatgaagaccatcctggagggcatcgaccctgccaagcaccaggagcacgagagcgagggcggccgcacccccctgatgaaggccgcccgggccggccacctgtgcaccgtgcagttcctgatcagcaaaggagccaacgtgaacagagccacagccaacaatgaccacacagtggtgtccctggcctgtgccggcggccacctggccgtggtggagctgctgctggcccatggagctgaccccacccaccggctgaaggatggcagcaccatgctgattgaagctgccaagggcggccacaccaacgtggtgtcctacctgctggactaccccaacaacgtgctgtctgtgcccaccacagatgtgtcccagctgcccccacccagccaggaccagagccaggtgccccgggtgcccacccacaccctggccatggtggtgcccccccaggagccagacaggaccagccaggagaacagccctgccctgctgggcgtgcagaagggcaccagcaagcagaagagcagcagcctgcaggtggccgaccaggacctgctgcccagcttccacccctaccagcccctggagtgcatcgtggaggagacagagggcaagctgaatgagctgggccagaggatcagcgccatcgagaaggcccagctgaagagcctggagctgatccagggcgagcccctgaacaaggacaagattgaggagctgaagaagaaccgggaggagcaggtgcagaagaagaagaagatcctgaaggagctgcagaaggtggagcggcagctgcagatgaagacccagcagcagttcaccaaggagtacctggagaccaagggccagaaggacacagtgtccctgcaccagcagtgcagccacagaggagtcttccctgagggggagggagatggcagcctgcctgaggaccacttcagcgagctgccccaggtggacaccatcctcttcaaggacaatgatgtggatgatgagcagcagagcccccccagcgctgagcagattgactttgtgcctgtgcagcccctgagcagcccccagtgcaacttcagcagtgacctgggcagcaatggcaccaacagcctggagctgcagaaggtgtctggcaaccagcagatcgtgggccagccccagatcgccatcactggacatgaccagggcctgctggtgcaggagccagatggcctgatggtggccaccccagcccagaccctgacagacaccctggatgacctgattgctgctgtgtccaccagggtgcccaccggcagcaacagcagcagccagaccacagaatgtctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcaggaagggccacgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagcgggagaagaggaaggagaagaggaaggagaagaggggcacagagaaggagaccggcagaagatag

SEQ ID NO: 143639 - DNA, 7629 bp, Artificial Sequence
  Description of Artificial Sequence: Synthetic coding sequence
atgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccaccggcaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccacggggccggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccactggagacacagccctgacctacgcctgtgaaaatggccacacagatgtggctgatgtgctgctgcaggccggggctgacctggagcacgagagcgagggcggccgcacccccctgatgaaggccgcccgggccggccacctgtgcaccgtgcagttcctgatcagcaaaggagccaacgtgaacagagccacagccaacaatgaccacacagtggtgtccctggcctgtgccggcggccacctggccgtggtggagctgctgctggcccatggagctgaccccacccaccggctgaaggatggcagcaccatgctgattgaagctgccaagggcggccacaccaacgtggtgtcctacctgctggactaccccaacaacgtgctgtctgtgcccaccacagatgtgtcccagctgcccccacccagccaggaccagagccaggtgccccgggtgcccacccacaccctggccatggtggtgcccccccaggagccagacaggaccagccaggagaacagccctgccctgctgggcgtgcagaagggcaccagcaagcagaagagcagcagcctgcaggtggccgaccaggacctgctgcccagcttccacccctaccagcccctggagtgcatcgtggaggagacagagggcaagctgaatgagctgggccagaggatcagcgccatcgagaaggcccagctgaagagcctggagctgatccagggcgagcccctgaacaaggacaagattgaggagctgaagaagaaccgggaggagcaggtgcagaagaagaagaagatcctgaaggagctgcagaaggtggagcggcagctgcagatgaagacccagcagcagttcaccaaggagtacctggagaccaagggccagaaggacacagtgtccctgcaccagcagtgcagccacagaggagtcttccctgagggggagggagatggcagcctgcctgaggaccacttcagcgagctgccccaggtggacaccatcctcttcaaggacaatgatgtggatgatgagcagcagagcccccccagcgctgagcagattgactttgtgcctgtgcagcccctgagcagcccccagtgcaacttcagcagtgacctgggcagcaatggcaccaacagcctggagctgcagaaggtgtctggcaaccagcagatcgtgggccagccccagatcgccatcactggacatgaccagggcctgctggtgcaggagccagatggcctgatggtggccaccccagcccagaccctgacagacaccctggatgacctgattgctgctgtgtccaccagggtgcccaccggcagcaacagcagcagccagaccacagaatgtctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcaggaagggccacgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagcgggagaagaggaaggagaagaggaagaagaagaaggaggagcagaagaggaagcaggaggaggatgaggagaacaagcccaaggaaaattctgagctgcctgaagatgaagatgaggaggagaatgatgaagatgtggagcaggaggtgcccatcgagccccccagcgccaccaccaccaccaccatcggcatcagcgccaccagcgccaccttcaccaacgtgtttgggaagaagagggccaacgtggtgaccacccccagcaccaacaggaagaacaagaagaacaagaccaaggagaccccacccacagcccacctgatcctgcctgagcagcacatgagcctggcccagcagaaggctgacaagaacaagatcaatggagagccccggggcggcggggccggcggcaacagcgacagcgacaacctggacagcacagactgcaacagcgagagcagcagcggcggcaagagccaggagctgaactttgtgatggatgtgaacagcagcaagtaccccagcctgctgctgcacagccaggaggagaagaccagcacagccaccagcaagacccagacccggctggagggggaggtgacccccaacagcctgagcaccagctacaagacagtgtccctgcccctgagcagccccaacatcaagctgaacctgaccagccccaagaggggccagaagcgggaggagggctggaaggaggtggtgagaagaagcaagaagctgtctgtgcctgcctctgtggtgagccgcatcatgggccggggcggctgcaacatcacagccatccaggatgtgactggagcccacattgatgtggacaagcagaaggacaagaatggagagaggatgatcaccatccggggcggcacagagagcaccaggtatgctgtgcagctgatcaatgccctgatccaggaccctgccaaggagctggaggacctgatccccaagaaccacatccgcaccccagccagcaccaagagcatccacgccaacttcagcagcggcgtgggcaccacagctgccagcagcaagaatgccttccccctgggcgcccccaccctggtgaccagccaggccaccaccctgagcaccttccagcctgccaacaagctgaacaagaatgtgcccaccaacgtgcgcagcagcttccctgtgtccctgcccctggcctacccccacccccactttgccctgctggccgcccagaccatgcagcagatccgccacccccggctgcccatggcccagtttggaggcaccttcagccccagccccaacacctggggccccttccctgtgcggcctgtgaaccctggcaacaccaacagcagccccaagcacaacaacaccagccggctgcccaaccagaatggaacagtgctgcccagcgagagcgctggcctggccacagccagctgccccatcaccgtgtcctctgtggtggccgccagccagcagctgtgtgtgaccaacaccaggacccccagctctgtgaggaagcagctgtttgcctgtgtgcccaagaccagccccccagccaccgtcatcagctctgtgaccagcacctgcagcagcctgcccagcgtgtcctctgcccccatcaccagcggccaggcccccaccaccttcctgcctgccagcaccagccaggcccagctgagcagccagaagatggagagcttctctgctgtgccccccaccaaggagaaggtgtccacccaggaccagcccatggccaacctgtgcacccccagcagcacagccaacagctgcagcagcagcgccagcaacacccctggggcccctgagacccaccccagcagcagccccacccccaccagcagcaacacccaggaggaggcccagcccagctctgtgtctgacctgagccccatgtccatgccctttgccagcaacagcgagcccgcccccctgaccctgaccagccccaggatggtggccgctgacaaccaggacaccagcaacctgccccagctggccgtgcctgccccccgggtgagccacaggatgcagccccggggcagcttctacagcatggtgcccaatgccaccatccaccaggacccccagagcatctttgtgaccaaccctgtgaccctgaccccaccccagggccccccagctgctgtgcagctgagcagcgctgtgaacatcatgaatggcagccagatgcacatcaacccagccaacaagagcctgccccccaccttcggccctgccaccctcttcaaccacttcagcagcctgtttgacagcagccaggtgcctgccaaccagggctggggagatggccccctgagcagccgggtggccacagatgccagcttcaccgtgcagagcgccttcctgggcaacagcgtgctgggccacctggagaacatgcacccagacaacagcaaggcccctggcttccggccccccagccagagggtgtccaccagccctgtgggcctgcccagcattgaccccagcggcagcagccccagcagcagcagcgcccccctggccagcttcagcggcatccctggcaccagggtcttcctgcagggccctgcccctgtgggcacccccagcttcaaccggcagcacttcagcccccacccctggaccagcgccagcaacagcagcaccagcgccccacccaccctgggccagcccaagggcgtgtctgccagccaggacaggaagatccccccacccatcggcacagagcggctggcccgcatccggcagggcggctctgtggcccaggccccagctggcaccagctttgtggcccctgtgggccacagcggcatctggagctttggagtgaatgctgtgtctgagggcctgagcggctggagccagagcgtgatgggcaaccaccccatgcaccagcagctgagtgaccccagcaccttcagccagcaccagcccatggagagagatgacagcggcatggtggcccccagcaacatcttccaccagcccatggccagcggctttgtggacttcagcaagggcctgcccatctccatgtatggaggcaccatcatccccagccacccccagctggctgatgtgcctgggggccccctcttcaacggcctgcacaacccagaccctgcctggaaccccatgatcaaggtgatccagaacagcacagaatgtacagatgcccagcagatctggccaggcacctgggccccccacatcggcaacatgcacctgaagtatgtgaactag

SEQ ID NO: 143640 - DNA, 1851 bp, Artificial Sequence
  Description of Artificial Sequence: Synthetic coding sequence
atgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccgcctttgctgaccctgaggtgctgcggcggctgaccagctctgtgtcctgtgccctggatgaagctgctgctgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccactggaaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccatggagctggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgagcggggggccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccaccggggacacagccctgacctacgcctgtgaaaatggccacacagatgtggctgatgtgctgctgcaggccggggctgacctggacaagcaggaggacatgaagaccatcctggagggcatcgaccctgccaagcaccaggtgcgggtggcctttgatgcctgcaagctgctgaggaaggagtag

SEQ ID NO: 143641 - DNA, 1884 bp, Artificial Sequence
  Description of Artificial Sequence: Synthetic coding sequence
atgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccaccggcaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccacggggccggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccactggagacacagccctgacctacgcctgtgaaaatggccacacagatgtggctgatgtgctgctgcaggccggggctgacctggacaagcaggaggacatgaagaccatcctggagggcattgatcctgccaagcaccaggtgcgggtggcctttgatgcctgcaagctgctgaggaaggagtag

SEQ ID NO: 143642 - DNA, 4461 bp, Artificial Sequence
  Description of Artificial Sequence: Synthetic coding sequence
ccccgggtgggccgccaccggctgcggctgcgggtgaggaccatgctgacagattctgggggcggcggcaccagctttgaggaggacctggacagcgtggcccccaggtctgccccagctggggccagcgagcccccacctcctgggggcgtgggcctgggcatcagaacagtgcggctgtttggagaggccggccctgccagcggcgtgggcagcagcggcggcggcggcagcggcagcggcaccggcggcggagatgctgccctggacttcaagctggccgctgctgtgctgaggactggaggcggcggcggggccagcggcagtgatgaagatgaggtgtctgaggtggagagcttcatcctggaccaggaggacctggacaaccctgtgctgaagaccaccagcgagatcttcctgagcagcacagctgagggcgctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaggccgccgccgccctgaccaggatgaaggccgagaacagccacaatgccggccaggtggacaccaggagcctggccgaggcctgcagtgatggagatgtgaatgctgtgaggaagctgctggatgagggccgctctgtgaatgagcacacagaggagggggagagcctgctgtgcctggcctgcagcgctggctactatgagctggcccaggtgctgctggccatgcacgccaacgtggaggaccggggcaacaagggggacatcacccccctgatggccgccagcagcggcggctacctggacatcgtgaagctgctgctgctgcatgatgctgatgtgaacagccagagcgccaccggcaacacagccctgacctacgcctgtgccggcggctttgtggacatcgtgaaggtgctgctgaatgaaggagccaacatcgaggaccacaatgaaaatggccacacccccctgatggaggccgccagcgctggccacgtggaggtggcccgggtgctgctggaccacggggccggcatcaacacccacagcaatgagttcaaggagagcgccctgaccctggcctgctacaagggccacctggacatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgaaagaggagccaacctggaggaggtgaatgatgagggctacacccccctgatggaggccgcccgggagggccacgaggagatggtggccctgctgctggcccagggcgccaacatcaatgcccagacagaggagacccaggagacagccctgaccctggcctgctgcggcggcttcagcgaggtggccgacttcctgatcaaggccggggctgacatcgagctgggctgcagcacccccctgatggaggccagccaggagggccacctggagctggtgaagtacctgctggccagcggggccaacgtgcacgccaccacagccactggagacacagccctgacctacgcctgtgaaaatggccacacagatgtggctgatgtgctgctgcaggccggggctgacctggacaagcaggaggacatgaagaccatcctggagggcattgatcctgccaagcaccaggagcatgaaagtgaaggaggccgcacccccctgatgaaggccgcccgggccggccacctgtgcaccgtgcagttcctgatcagcaagggggccaacgtgaacagagccacagccaacaatgaccacacagtggtgtccctggcctgtgccggcggccacctggccgtggtggagctgctgctggcccacggggctgaccccacccaccggctgaaggatggcagcaccatgctgattgaggccgccaagggcggccacaccaacgtggtgtcctacctgctggactaccccaacaacgtgctgtctgtgcccaccacagatgtgtcccagctgcccccacccagccaggaccagagccaggtgccccgggtgcccacccacaccctggccatggtggtgcccccccaggagccagacaggaccagccaggagaacagccctgccctgctgggcgtgcagaagggcaccagcaagcagaagagcagcagcctgcaggtggccgaccaggacctgctgcccagcttccacccctaccagcccctggagtgcatcgtggaggagacagagggcaagctgaatgagctgggccagaggatcagcgccatcgagaaggcccagctgaagagcctggagctgatccagggcgagcccctgaacaaggacaagattgaggagctgaagaagaaccgggaggagcaggtgcagaagaagaagaagatcctgaaggagctgcagaaggtggagcggcagctgcagatgaagacccagcagcagttcaccaaggagtacctggagaccaagggccagaaggacacagtgtccctgcaccagcagtgcagccaccggggcgtcttccctgagggggagggagatggcagcctgcctgaggaccacttcagcgagctgccccaggtggacaccatcctcttcaaggacaatgatgtggatgatgagcagcagagccccccatctgctgagcagattgactttgtgcctgtgcagcccctgagcagcccccagtgcaacttcagcagtgacctgggcagcaatggcaccaacagcctggagctgcagaaggtgtctggcaaccagcagatcgtgggccagccccagatcgccatcaccggccatgaccagggcctgctggtgcaggagccagatggcctgatggtggccaccccagcccagaccctgacagacaccctggatgacctgattgctgctgtgtccaccagggtgcccaccggcagcaacagcagcagccagaccacagagtgcctgaccccagagagctgcagccagaccaccagcaatgtggccagccagagcatgcctcctgtgtaccccagcgtggacattgatgcccacacagagagcaaccacgacacagccctgaccctggcctgtgccggcggccacgaggagctggtgtctgtgctgattgccagagatgccaagattgagcaccgggacaagaagggcttcacccccctcatcctggccgccacagctggccacgtgggcgtggtggagatcctgctggacaagggcggggacatcgaggcccagagcgagaggaccaaggacacccccctgagcctggcctgcagcggcggccggcaggaggtggtggacctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggacatgtgcctgctgtgaagctgctgctggacatgggcagtgacatcaatgcccagatcgagaccaacagaaacacagccctgaccctggcctgcttccagggccgggcagaggtggtgtccctgctgctggacaggaaggccaacgtggagcaccgggccaagacaggcctgacccccctgatggaggccgccagcggcggctatgcagaggtgggccgggtgctgctggacaagggagcagatgtgaatgcccctcctgtgcccagcagccgggacacagccctgaccatcgctgctgacaagggccactacaagttctgtgagctgctgatccacagaggagcccacattgatgtgaggaacaagaagggcaacacccccctgtggctggccagcaatggaggccactttgatgtggtgcagctgctggtgcaggccggggctgatgtggatgctgctgacaacaggaagatcacccccctgatgtctgccttcagaaaaggacatgtgaaggtggtgcagtacctggtgaaggaggtgaaccagttccccagcgacatcgagtgcatgagatacatcgccaccatcacagacaaggagctgctgaagaagtgccaccagtgtgtggagaccatcgtgaaggccaaggaccagcaggccgctgaggccaacaagaatgccagcatcctgctgaaggagctggacctggagaagagccgggaggagagcaggaagcaggccctggccgccaagaggtag

SEQ ID NO: 143643 - DNA, 1863 bp, Artificial Sequence
  Description of Artificial Sequence: Synthetic coding sequence
atgagcctggcccagcagaaggctgacaagaacaagatcaacggggagccccggggcggcggggccggcggcaacagcgacagcgacaacctggacagcacagactgcaacagcgagagcagcagcggcggcaagagccaggagctgaactttgtgatggatgtgaacagcagcaagtaccccagcctgctgctgcacagccaggaggagaagaccagcacagccaccagcaagacccagacccggctggagggggaggtgacccccaacagcctgagcaccagctacaagacagtgtccctgcccctgagcagccccaacatcaagctgaacctgaccagccccaagaggggccagaagcgggaggagggctggaaggaggtggtgcggcgcagcaagaagctgtctgtgcctgcctctgtggtgagccgcatcatgggccggggcggctgcaacatcacagccatccaggatgtgactggagcccacattgatgtggacaagcagaaggacaagaatggagagaggatgatcaccatccggggcggcacagagagcaccaggtatgctgtgcagctgatcaatgccctgatccaggaccctgccaaggagctggaggacctgatccccaagaaccacatccgcaccccagccagcaccaagagcatccacgccaacttcagcagtggagtgggcaccacagctgccagcagcaagaatgccttccccctgggcgcccccaccctggtgaccagccaggccaccaccctgagcaccttccagcctgccaacaagctgaacaagaatgtgcccaccaacgtgcgcagcagcttccctgtgtccctgcccctggcctacccccacccccactttgccctgctggccgcccagaccatgcagcagatccgccacccccggctgcccatggcccagtttggaggcaccttcagccccagccccaacacctggggccccttccctgtgcggcctgtgaaccctggcaacaccaacagcagccccaagcacaacaacaccagccggctgcccaaccagaatggcaccgtgctgcccagcgagagcgctggcctggccacagccagctgccccatcaccgtgtcctctgtggtggccgccagccagcagctgtgtgtgaccaacaccaggacccccagctctgtgaggaagcagctgtttgcctgtgtgcccaagaccagccccccagccaccgtcatcagctctgtgaccagcacctgcagcagcctgcccagcgtgagcagcgcccccatcaccagcggccaggcccccaccaccttcctgcctgccagcaccagccaggcccagctgagcagccagaagatggagagcttctctgctgtgccccccaccaaggagaaggtgtccacccaggaccagcccatggccaacctgtgcacccccagcagcacagccaacagctgcagcagcagcgccagcaacacccctggggcccctgagacccaccccagcagcagccccacccccaccagcagcaacacccaggaggaggcccagcccagctctgtgtctgacctgagccccatgtccatgccctttgccagcaacagcgagcccgcccccctgaccctgaccagccccaggatggtggccgctgacaaccaggacaccagcaacctgccccagctggccgtgcctgccccccgggtgagccacaggatgcagccccggggcagcttctacagcatggtgcccaatgccaccatccaccaggacccccagagcatctttgtgaccaaccctgtgaccctgtgggaggccgaggccagcggcctgcacgaggtgcgcagcctgcggcaggcctggtag

SEQ ID NO: 143644 - DNA, 2601 bp, Artificial Sequence
  Description of Artificial Sequence: Synthetic coding sequence
atggatgtgaacagcagcaagtaccccagcctgctgctgcacagccaggaggagaagaccagcacagccaccagcaagacccagacccggctggagggggaggtgacccccaacagcctgagcaccagctacaagacagtgtccctgcccctgagcagccccaacatcaagctgaacctgaccagccccaagaggggccagaagcgggaggagggctggaaggaggtggtgcggcgcagcaagaagctgtctgtgcctgcctctgtggtgagccgcatcatgggccggggcggctgcaacatcacagccatccaggatgtgactggagcccacattgatgtggacaagcagaaggacaagaatggagagaggatgatcaccatccggggcggcacagagagcaccaggtatgctgtgcagctgatcaatgccctgatccaggaccctgccaaggagctggaggacctgatccccaagaaccacatccgcaccccagccagcaccaagagcatccacgccaacttcagcagtggagtgggcaccacagctgccagcagcaagaatgccttccccctgggcgcccccaccctggtgaccagccaggccaccaccctgagcaccttccagcctgccaacaagctgaacaagaatgtgcccaccaacgtgcgcagcagcttccctgtgtccctgcccctggcctacccccacccccactttgccctgctggccgcccagaccatgcagcagatccgccacccccggctgcccatggcccagtttggaggcaccttcagccccagccccaacacctggggccccttccctgtgcggcctgtgaaccctggcaacaccaacagcagccccaagcacaacaacaccagccggctgcccaaccagaatggcaccgtgctgcccagcgagagcgctggcctggccacagccagctgccccatcaccgtgtcctctgtggtggccgccagccagcagctgtgtgtgaccaacaccaggacccccagctctgtgaggaagcagctgtttgcctgtgtgcccaagaccagccccccagccaccgtcatcagctctgtgaccagcacctgcagcagcctgcccagcgtgagcagcgcccccatcaccagcggccaggcccccaccaccttcctgcctgccagcaccagccaggcccagctgagcagccagaagatggagagcttctctgctgtgccccccaccaaggagaaggtgtccacccaggaccagcccatggccaacctgtgcacccccagcagcacagccaacagctgcagcagcagcgccagcaacacccctggggcccctgagacccaccccagcagcagccccacccccaccagcagcaacacccaggaggaggcccagcccagctctgtgtctgacctgagccccatgtccatgccctttgccagcaacagcgagcccgcccccctgaccctgaccagccccaggatggtggccgctgacaaccaggacaccagcaacctgccccagctggccgtgcctgccccccgggtgagccacaggatgcagccccggggcagcttctacagcatggtgcccaatgccaccatccaccaggacccccagagcatctttgtgaccaaccctgtgaccctgaccccaccccagggccccccagctgctgtgcagctgagcagcgctgtgaacatcatgaatggcagccagatgcacatcaacccagccaacaagagcctgccccccacctttggacctgccaccctcttcaaccacttcagcagcctgtttgacagcagccaggtgcctgccaaccagggctggggagatggccccctgagcagccgggtggccacagatgccagcttcaccgtgcagagcgccttcctgggcaacagcgtgctgggccacctggagaacatgcacccagacaacagcaaggcccctggcttccggccccccagccagagggtgtccaccagccctgtggccaccagcgccccacccaccctgggccagcccaagggcgtgtctgccagccaggacaggaagatccccccacccatcggcacagagcggctggcccgcatccggcagggcggctctgtggcccaggccccagctggcaccagctttgtggcccctgtgggccacagcggcatctggagctttggagtgaatgctgtgtctgagggcctgagcggctggagccagagcgtgatgggcaaccaccccatgcaccagcagctgagtgaccccagcaccttcagccagcaccagcccatggagagagatgacagcggcatggtggcccccagcaacatcttccaccagcccatggccagcggctttgtggacttcagcaagggcctgcccatctccatgtatggaggcaccatcatccccagccacccccagctggctgatgtgcctgggggccccctcttcaacggcctgcacaacccagaccctgcctggaaccccatgatcaaggtgatccagaacagcacagaatgtacagatgcccagcagatctggccaggcacctgggccccccacatcggcaacatgcacctgaagtatgtgaactag

SEQ ID NO: 143645 - DNA, 2298 bp, Artificial Sequence
  Description of Artificial Sequence: Synthetic coding sequence
atggctgctgaccccacagagctgcggctgggcagcctgcccgtcttcaccagagatgactttgaaggagactggaggctggtggccagcggcggcttcagccaggtgttccaggcccggcaccggcgctggaggacagaatatgccatcaagtgtgccccctgcctgcccccagatgctgccagcagtgatgtgaactacctgattgaggaggccgccaagatgaagaagatcaagttccagcacatcgtgtccatctatggagtgtgcaagcagcccctgggcatcgtgatggagttcatggccaacggcagcctggagaaggtgctgagcacccacagcctgtgctggaagctgcgcttccgcatcatccacgagaccagcctggccatgaacttcctgcacagcatcaagccacccctgctgcacctggacctgaagccaggcaacatcctgctggacagcaacatgcacgtgaagatcagtgactttggcctgagcaagtggatggagcagagcaccaggatgcagtacatcgagaggtctgccctgcggggcatgctgagctacatccccccagagatgttcctggagagcaacaaggcccctggccccaagtatgatgtgtacagctttgccatcgtcatctgggagctgctgacccagaagaagccctacagcggcttcaacatgatgatgatcatcatccgggtggccgccggcatgaggcccagcctgcagcctgtgtctgaccagtggcccagcgaggcccagcagatggtggacctgatgaagcgctgctgggaccaggaccccaagaagaggccctgcttcctggacatcaccattgaaacagacatcctgctgagcctgctgcagagccgggtggccgtgcctgagagcaaggccctggccaggaaggtgtcctgcaagctgagcctgcggcagcctggagaggtgaatgaagacatcagccaggagctgatggacagcgacagcggcaactacctgaagagggccctgcagctgagtgacaggaagaacctggtgcccagagatgaggagctgtgcatctatgagaacaaggtgacccccctgcacttcctggtggcccagggctctgtggagcaggtgcggctgctgctggcccacgaggtggatgtggactgccagacagccagcggctacacccccctgctgattgctgcccaggaccagcagcctgacctgtgtgccctgctgctggcccatggagcagatgccaacagagtggatgaagatggctgggcccccctgcactttgctgcccagaatggagatgatggaacagcccggctgctgctggaccacggggcctgtgtggatgcccaggagcgggagggctggacccccctgcacctggccgcccagaacaactttgaaaatgtggcccggctgctggtgtcccggcaggccgaccccaacctgcacgaggccgagggcaagacccccctgcacgtggccgcctacttcggccacgtgtccctggtgaagctgctgaccagccagggcgctgagctggatgcccagcagaggaacctgcggacccccctgcacctggccgtggagcggggcaaggtgcgggccatccagcacctgctgaagtctggagctgtgcctgatgccctggaccagagcggctacggccccctgcacacagctgctgcccggggcaagtacctgatctgcaagatgctgctgcgctacggggccagcctggagctgcccacccaccagggctggacccccctgcacctggccgcctacaagggccacctggagatcatccacctgctggccgagagccacgccaacatgggcgccctgggcgctgtgaactggacccccctgcacctggccgcccggcacggggaggaggccgtggtgtctgccctgctgcagtgtggggctgaccccaatgctgctgagcagagcggctggacccccctgcacctggccgtgcagaggagcaccttcctgagcgtcatcaacctgctggagcaccacgccaacgtgcacgccaggaacaaggtgggctggaccccagcccacctggccgccctgaagggcaacacagccatcctgaaggtgctggtggaggccggggcccagctggatgtgcaggatggagtgtcctgcacccccctgcagctggccctgcggagcaggaagcagggcatcatgtccttcctggagggcaaggagcccagcgtggccaccctgggcggcagcaagccaggagctgagatggagatctag

SEQ ID NO: 143646 - DNA, 1008 bp, Artificial Sequence
  Description of Artificial Sequence: Synthetic coding sequence
atggccgagggcggcagcccagatggccgggccggccctggcagcgctggcaggaacctgaaggagtggctgcgggagcagttctgtgaccaccccctggagcactgtgaggacacccggctgcatgatgctgcctacgtgggggacctgcagaccctgcggagcctgctgcaggaggagagctaccgcagccgcatcaatgagaagtctgtgtggtgctgcggctggctgccctgcacccccctgagaattgctgccacagctggccacggcagctgtgtggacttcctgatcagaaaaggagctgaggtggacctggtggatgtgaagggccagacagccctgtatgtggccgtggtgaatggccacctggagagcacccagatcctgctggaggccggggctgaccccaacggcagccgccaccacaggagcacccctgtgtaccacgccagccgggtgggccgggctgacatcctgaaggccctgatccgctacggggctgatgtggatgtgaaccaccacctgaccccagatgtgcagccccgcttcagccggcggctgaccagcctggtggtgtgccccctgtacatctctgctgcctaccacaacctgcagtgcttccggctgctgctgctggccggggccaacccagacttcaactgcaatggacctgtgaacacccagggcttctaccggggcagccctggctgtgtgatggatgctgtgctgcggcacggctgtgaggccgcctttgtgtccctgctggtggagtttggagccaacctgaacctggtgaagtgggagagcctgggccctgagagccggggccgcaggaaggtggaccctgaggccctgcaggtgttcaaggaggcccggtctgtgcccaggaccctgctgtgcctgtgccgggtggccgtgcggcgggccctgggcaagcaccggctgcacctgatccccagcctgcccctgcctgaccccatcaagaagttcctgctgcacgagtag

SEQ ID NO: 143647 - DNA, 909 bp, Artificial Sequence
  Description of Artificial Sequence: Synthetic coding sequence
atgctgcagctgactggagaaaatgagaagaactgtgaggtgtctgagcgcatcagaagaagtggcccctggaaggagatcagctttggagactacatctgccacaccttccagggcgactgctgggccgacaggagccccctgcatgaagctgctgcccagggccgcctgctggccctgaagaccctcatcgcccagggcgtgaatgtgaacctggtgaccatcaacagagtgagcagcctgcacgaggcctgcctgggcggccacgtggcctgtgccaaggccctgctggagaatggagcccacgtgaatggagtgacagtgcatggagccacccccctcttcaatgcctgctgcagcggcagcgctgcctgtgtgaatgtgctgctggagtttggagccaaggcccagctggaggtgcacctggccagccccatccatgaagctgtgaagaggggccaccgggagtgcatggagatcctgctggccaacaacgtgaacatcgaccacgaggtgccccagctgggcacccccctgtatgtggcctgcacctaccagagggtggactgtgtgaagaagctgctggagctgggcgcctctgtggaccacggccagtggctggacacccccctgcatgctgctgcccggcagagcaatgtggaggtgatccacctgctgacagattatggagccaacctgaagagaagaaatgcccagggcaagagcgccctggacctggccgcccccaagagctctgtggagcaggccctgctgctgcgggagggccccccagccctgagccagctgtgccgcctgtgtgtgaggaagtgcctgggccgggcctgccaccaggccatccacaagctgcacctgcctgagcccctggagcgcttcctgctgtaccagtag

SEQ ID NO: 143648 - DNA, 972 bp, Artificial Sequence
  Description of Artificial Sequence: Synthetic coding sequence
atggaggatggccctgtgttctacggcttcaagaacatcttcatcaccatgtttgccaccttcttcttcttcaagctgctgatcaaggtgttcctggccctgctgacccacttctacatcgtgaagggcaacaggaaggaggccgccagaattgctgaggagatctacggcggcatcagtgactgctgggccgacaggagccccctgcacgaggccgccgcccagggccgcctgctggccctgaagaccctgattgcccagggcgtgaatgtgaacctggtgaccatcaacagagtgagcagcctgcacgaggcctgcctgggcggccacgtggcctgtgccaaggccctgctggagaatggagcccacgtgaatggagtgacagtgcacggggccacccccctcttcaatgcctgctgcagcggcagcgctgcctgtgtgaatgtgctgctggagtttggagccaaggcccagctggaggtgcacctggccagccccatccacgaggccgtgaagaggggccaccgggagtgcatggagatcctgctggccaacaacgtgaacatcgaccacgaggtgccccagctgggcacccccctgtatgtggcctgcacctaccagagggtggactgtgtgaagaagctgctggagctgggcgcctctgtggaccacggccagtggctggacacccccctgcacgccgccgcccggcagagcaatgtggaggtgatccacctgctgacagattatggagccaacctgaagagaagaaatgcccagggcaagagcgccctggacctggccgcccccaagagctctgtggagcaggccctgctgctgcgggagggccccccagccctgagccagctgtgccgcctgtgtgtgaggaagtgcctgggccgggcctgccaccaggccatccacaagctgcacctgcctgagcccctggagcgcttcctgctgtaccagtag

SEQ ID NO: 143649 - DNA, 909 bp, Artificial Sequence; identical to SEQ ID NO: 143647
  Description of Artificial Sequence: Synthetic coding sequence

SEQ ID NO: 143650 - DNA, 921 bp, Artificial Sequence
  Description of Artificial Sequence: Synthetic coding sequence
atggaggatggccctgtgttctacggcttcaagaacatcttcatcaccatgtttgccaccttcttcttcttcaagctgctgatcaaggtgttcctggccctgctgacccacttctacatcgtgaagggcaacaggaaggaggccgccagaattgctgaggagatctacggcggcatcagtgactgctgggccgacaggagccccctgcacgaggccgccgcccagggccgcctgctggccctgaagaccctgattgcccaggcctgcctgggcggccacgtggcctgtgccaaggccctgctggagaatggagcccacgtgaatggagtgacagtgcatggagccacccccctcttcaatgcctgctgcagcggcagcgctgcctgtgtgaatgtgctgctggagtttggagccaaggcccagctggaggtgcacctggccagccccatccatgaagctgtgaagaggggccaccgggagtgcatggagatcctgctggccaacaacgtgaacatcgaccacgaggtgccccagctgggcacccccctgtatgtggcctgcacctaccagagggtggactgtgtgaagaagctgctggagctgggcgcctctgtggaccacggccagtggctggacacccccctgcatgctgctgcccggcagagcaatgtggaggtgatccacctgctgacagattatggagccaacctgaagagaagaaatgcccagggcaagagcgccctggacctggccgcccccaagagctctgtggagcaggccctgctgctgcgggagggccccccagccctgagccagctgtgccgcctgtgtgtgaggaagtgcctgggccgggcctgccaccaggccatccacaagctgcacctgcctgagcccctggagcgcttcctgctgtaccagtag

SEQ ID NO: 143651 - DNA, 1764 bp, Artificial Sequence
  Description of Artificial Sequence: Synthetic coding sequence
atgacccgcttctcctatgcagagtacttcagcctcttccacagctgcagcgcccccagccgcagcacagcccctcctgagagcagccctgcccgggcccccatgggcctcttccagggcgtgatgcagaagtacagcagcagcctcttcaagaccagccagctggccccagctgaccccctcatcaaggccatcaaggatggagatgaggaggccctgaagaccatgatcaaggagggcaagaacctggccgagcccaacaaggagggctggctgcccctgcatgaagctgcctactacggccaggtgggctgcctgaaggtgctgcagagggcctacccaggcaccatcgaccagaggaccctgcaggaggagacagctgtgtacctggccacctgccggggccacctggactgcctgctgagcctgctgcaggccggggctgagccagacatcagcaacaagagccgggagacccccctgtacaaggcctgtgagaggaagaatgctgaggccgtgaagatcctggtgcagcacaatgctgacaccaaccaccgctgcaacagaggctggacagccctgcatgaatctgtgtccagaaatgacctggaggtgatgcagatcctggtgtctggaggagccaaggtggagagcaagaatgcctacggcatcacccccctgtttgtggccgcccagagcggccagctggaggccctgcgcttcctggccaagtatggagctgacatcaacacccaggccagtgacaatgccagcgccctgtatgaggcctgcaagaatgagcacgaggaggtggtggagttcctgctgagccagggcgcagatgccaacaagaccaacaaggatggcctgctgcccctgcacatcgccagcaagaagggcaactaccgcatcgtgcagatgctgctgcctgtgaccagcaggacccgcatccgccgcagcggcgtgagccccctgcacctggccgctgagagaaatcatgatgaggtgctggaggccctgctgagcgccaggtttgatgtgaacacccccctggcccctgagcgggcccggctgtatgaggaccggcgcagcagcgccctgtactttgctgtggtgaacaacaacgtgtatgccacagagctgctgctgcagcacggggctgaccccaacagagatgtgatcagccccctgctggtggccatcagacatggctgcctgcggaccatgcagctgctgctggaccatggagccaacattgatgcctacatcgccacccaccccacagccttccctgccaccatcatgtttgccatgaagtgcctgagcctgctgaagttcctgatggacctgggctgtgatggagagccctgcttcagctgcctgtatggaaatggcccccaccccccagccccccagcccagcagccgcttcaatgatgccccagctgctgacaaggagcccagcgtggtgcagttctgtgaatttgtgtctgcccctgaggtgagccgctgggccggccccatcattgatgtgctgctggactatgtgggcaatgtgcagctgtgcagccggctgaaggagcacatcgacagctttgaggactgggccgtcatcaaggagaaggccgagcccccccggcccctggcccacctgtgccgcctgcgggtgaggaaggccatcggcaagtaccgcatcaagctgctggacaccctgcccctgcccggccgcctcatccgctacctgaagtatgagaacacccagtag

SEQ ID NO: 143652 - DNA, 1812 bp, Artificial Sequence
  Description of Artificial Sequence: Synthetic coding sequence
atggccatcgagcagagcctggccgacaagacccggggccccaccacagctgaggccacagccagcgcctgcaccaaccggcagcctgcccacttctacccctggaccaggagcacagcccctcctgagagcagccctgcccgggcccccatgggcctcttccagggcgtgatgcagaagtacagcagcagcctcttcaagaccagccagctggccccagctgaccccctcatcaaggccatcaaggatggagatgaggaggccctgaagaccatgatcaaggagggcaagaacctggccgagcccaacaaggagggctggctgcccctgcatgaagctgcctactacggccaggtgggctgcctgaaggtgctgcagagggcctacccaggcaccatcgaccagaggaccctgcaggaggagacagctgtgtacctggccacctgccggggccacctggactgcctgctgagcctgctgcaggccggggctgagccagacatcagcaacaagagccgggagacccccctgtacaaggcctgtgagaggaagaatgctgaggccgtgaagatcctggtgcagcacaatgctgacaccaaccaccgctgcaacagaggctggacagccctgcatgaatctgtgtccagaaatgacctggaggtgatgcagatcctggtgtctggaggagccaaggtggagagcaagaatgcctacggcatcacccccctgtttgtggccgcccagagcggccagctggaggccctgcgcttcctggccaagtatggagctgacatcaacacccaggccagtgacaatgccagcgccctgtatgaggcctgcaagaatgagcacgaggaggtggtggagttcctgctgagccagggcgcagatgccaacaagaccaacaaggatggcctgctgcccctgcacatcgccagcaagaagggcaactaccgcatcgtgcagatgctgctgcctgtgaccagcaggacccgcatccgccgcagcggcgtgagccccctgcacctggccgctgagagaaatcatgatgaggtgctggaggccctgctgagcgccaggtttgatgtgaacacccccctggcccctgagcgggcccggctgtatgaggaccggcgcagcagcgccctgtactttgctgtggtgaacaacaacgtgtatgccacagagctgctgctgcagcacggggctgaccccaacagagatgtgatcagccccctgctggtggccatcagacatggctgcctgcggaccatgcagctgctgctggaccatggagccaacattgatgcctacatcgccacccaccccacagccttccctgccaccatcatgtttgccatgaagtgcctgagcctgctgaagttcctgatggacctgggctgtgatggagagccctgcttcagctgcctgtatggaaatggcccccaccccccagccccccagcccagcagccgcttcaatgatgccccagctgctgacaaggagcccagcgtggtgcagttctgtgaatttgtgtctgcccctgaggtgagccgctgggccggccccatcattgatgtgctgctggactatgtgggcaatgtgcagctgtgcagccggctgaaggagcacatcgacagctttgaggactgggccgtcatcaaggagaaggccgagcccccccggcccctggcccacctgtgccgcctgcgggtgaggaaggccatcggcaagtaccgcatcaagctgctggacaccctgcccctgcccggccgcctcatccgctacctgaagtatgagaacacccagtag

SEQ ID NO: 143653 - DNA, 1470 bp, Artificial Sequence
  Description of Artificial Sequence: Synthetic coding sequence
atgaggcctgctgaccccctcatcaaggccatcaaggatggagatgaggaggccctgaagaccatgatcaaggagggcaagaacctggccgagcccaacaaggagggctggctgcccctgcatgaagctgcctactacggccaggtgggctgcctgaaggtgctgcagagggcctacccaggcaccatcgaccagaggaccctgcaggaggagacagctgtgtacctggccacctgccggggccacctggactgcctgctgagcctgctgcaggccggggctgagccagacatcagcaacaagagccgggagacccccctgtacaaggcctgtgagaggaagaatgctgaggccgtgaagatcctggtgcagcacaatgctgacaccaaccaccgctgcaacagaggctggacagccctgcatgaatctgtgtccagaaatgacctggaggtgatgcagatcctggtgtctggaggagccaaggtggagagcaagaatgcctacggcatcacccccctgtttgtggccgcccagagcggccagctggaggccctgcgcttcctggccaagtatggagctgacatcaacacccaggccagtgacaatgccagcgccctgtatgaggcctgcaagaatgagcacgaggaggtggtggagttcctgctgagccagggcgcagatgccaacaagaccaacaaggatggcctgctgcccctgcacatcgccagcaagaagggcaactaccgcatcgtgcagatgctgctgcctgtgaccagcaggacccgcatccgccgcagcggcgtgagccccctgcacctggccgctgagagaaatcatgatgaggtgctggaggccctgctgagcgccaggtttgatgtgaacacccccctggcccctgagcgggcccggctgtatgaggaccggcgcagcagcgccctgtactttgctgtggtgaacaacaacgtgtatgccacagagctgctgctgcagcacggggctgaccccaacagagatgtgatcagccccctgctggtggccatcagacatggctgcctgcggaccatgcagctgctgctggaccatggagccaacattgatgcctacatcgccacccaccccacagccttccctgccaccatcatgtttgccatgaagtgcctgagcctgctgaagttcctgatggacctgggctgtgatggagagccctgcttcagctgcctgtatggaaatggcccccaccccccagccccccagcccagcagccgcttcaatgatgccccagctgctgacaaggagcccagcgtggtgcagttctgtgaatttgtgtctgcccctgaggtgagccgctgggccggccccatcattgatgtgctgctggactatgtgggcaatgtgcagctgtgcagccggctgaaggagcacatcgacagctttgaggactgggtgctggagggctttgtgaagtactag

SEQ ID NO: 143654 - DNA, 1908 bp, Artificial Sequence
  Description of Artificial Sequence: Synthetic coding sequence
atggccacccagatcagcacccggggcagccagtgcaccatcggccaggaggagtacagcctgtacagcagcctgtctgaagatgagctggtgcagatggccatcgagcagagcctggccgacaagacccggggccccaccacagctgaggccacagccagcgcctgcaccaaccggcagcctgcccacttctacccctggaccaggagcacagcccctcctgagagcagccctgcccgggcccccatgggcctcttccagggcgtgatgcagaagtacagcagcagcctcttcaagaccagccagctggccccagctgaccccctcatcaaggccatcaaggatggagatgaggaggccctgaagaccatgatcaaggagggcaagaacctggccgagcccaacaaggagggctggctgcccctgcatgaagctgcctactacggccaggtgggctgcctgaaggtgctgcagagggcctacccaggcaccatcgaccagaggaccctgcaggaggagacagctgtgtacctggccacctgccggggccacctggactgcctgctgagcctgctgcaggccggggctgagccagacatcagcaacaagagccgggagacccccctgtacaaggcctgtgagaggaagaatgctgaggccgtgaagatcctggtgcagcacaatgctgacaccaaccaccgctgcaacagaggctggacagccctgcatgaatctgtgtccagaaatgacctggaggtgatgcagatcctggtgtctggaggagccaaggtggagagcaagaatgcctacggcatcacccccctgtttgtggccgcccagagcggccagctggaggccctgcgcttcctggccaagtatggagctgacatcaacacccaggccagtgacaatgccagcgccctgtatgaggcctgcaagaatgagcacgaggaggtggtggagttcctgctgagccagggcgcagatgccaacaagaccaacaaggatggcctgctgcccctgcacatcgccagcaagaagggcaactaccgcatcgtgcagatgctgctgcctgtgaccagcaggacccgcatccgccgcagcggcgtgagccccctgcacctggccgctgagagaaatcatgatgaggtgctggaggccctgctgagcgccaggtttgatgtgaacacccccctggcccctgagcgggcccggctgtatgaggaccggcgcagcagcgccctgtactttgctgtggtgaacaacaacgtgtatgccacagagctgctgctgcagcacggggctgaccccaacagagatgtgatcagccccctgctggtggccatcagacatggctgcctgcggaccatgcagctgctgctggaccatggagccaacattgatgcctacatcgccacccaccccacagccttccctgccaccatcatgtttgccatgaagtgcctgagcctgctgaagttcctgatggacctgggctgtgatggagagccctgcttcagctgcctgtatggaaatggcccccaccccccagccccccagcccagcagccgcttcaatgatgccccagctgctgacaaggagcccagcgtggtgcagttctgtgaatttgtgtctgcccctgaggtgagccgctgggccggccccatcattgatgtgctgctggactatgtgggcaatgtgcagctgtgcagccggctgaaggagcacatcgacagctttgaggactgggccgtcatcaaggagaaggccgagcccccccggcccctggcccacctgtgccgcctgcgggtgaggaaggccatcggcaagtaccgcatcaagctgctggacaccctgcccctgcccggccgcctcatccgctacctgaagtatgagaacacccagtag

SEQ ID NO: 143655 - DNA, 1557 bp, Artificial Sequence
  Description of Artificial Sequence: Synthetic coding sequence
atggacttcacagaggcctatgctgacacctgcagcacagtgggcctggccgcccgggagggcaatgtgaaggtgctgaggaagctgctgaagaagggccgctctgtggatgtggccgacaacagaggctggatgcccatccacgaggccgcctaccacaacagcgtggagtgcctgcagatgctgatcaatgctgacagcagcgagaactacatcaagatgaagacctttgagggcttctgtgccctgcacctggccgccagccagggccactggaagatcgtgcagatcctgctggaggccggggctgaccccaatgccaccaccctggaggagaccacccccctcttcctggccgtggagaatggccagattgatgtgctgcggctgctgctgcagcacggggccaacgtgaatggcagccacagcatgtgtggctggaacagcctgcaccaggccagcttccaggagaatgctgagatcatcaagctgctgctgaggaagggggccaacaaggagtgccaggatgactttggcatcacccccctgtttgtggccgcccagtatggcaagctggagagcctgagcatcctgatcagcagcggggccaacgtgaactgccaggccctggacaaggccacccccctcttcatcgccgcccaggagggccacaccaagtgtgtggagctgctgctgagcagcggggctgaccctgacctgtactgcaatgaagacagctggcagctgcccatccatgctgctgcccagatgggccacaccaagatcctggacctgctgatccccctgaccaacagagcctgtgacaccggcctgaacaaggtgtcccctgtgtacagcgctgtgtttggaggccacgaggactgcctggagatcctgctgagaaatggctacagcccagatgcccaggcctgcctggtgtttggcttcagcagccctgtgtgcatggccttccagaaggactgtgagttctttggaattgtgaacatcctgctgaagtacggggcccagatcaatgagctgcacctggcctactgcctgaagtatgagaagttcagcatcttccgctacttcctgaggaagggctgcagcctgggcccctggaaccacatctatgaatttgtgaaccacgccatcaaggcccaggccaagtacaaggagtggctgccccacctgctggtggccggctttgaccccctcatcctgctgtgcaacagctggattgacagcgtgtccattgacaccctcatcttcaccctggagttcaccaactggaagaccctggccccagctgtggagaggatgctgagcgcccgggccagcaatgcctggatcctgcagcagcacatcgccaccgtgcccagcctgacccacctgtgccgcctggagatccgcagcagcctgaagtctgagcggctgcggagtgacagctacatcagccagctgcccctgcccaggagcctgcacaactacctgctgtatgaagatgtgctgaggatgtatgaggtgcctgagctggccgccatccaggatggatag

SEQ ID NO: 143656 - DNA, 1671 bp, Artificial Sequence
  Description of Artificial Sequence: Synthetic coding sequence
atggccatgatgcccctggtgctgcaccaccctgagcggcaggccgagctgggcagcggcctgagagatggcggcggggccgccctgcggcccccaggccgcctggtgaagcagatggacttcacagaggcctatgctgacacctgcagcacagtgggcctggccgcccgggagggcaatgtgaaggtgctgaggaagctgctgaagaagggccgctctgtggatgtggccgacaacagaggctggatgcccatccacgaggccgcctaccacaacagcgtggagtgcctgcagatgctgatcaatgctgacagcagcgagaactacatcaagatgaagacctttgagggcttctgtgccctgcacctggccgccagccagggccactggaagatcgtgcagatcctgctggaggccggggctgaccccaatgccaccaccctggaggagaccacccccctcttcctggccgtggagaatggccagattgatgtgctgcggctgctgctgcagcacggggccaacgtgaatggcagccacagcatgtgtggctggaacagcctgcaccaggccagcttccaggagaatgctgagatcatcaagctgctgctgaggaagggggccaacaaggagtgccaggatgactttggcatcacccccctgtttgtggccgcccagtatggcaagctggagagcctgagcatcctgatcagcagcggggccaacgtgaactgccaggccctggacaaggccacccccctcttcatcgccgcccaggagggccacaccaagtgtgtggagctgctgctgagcagcggggctgaccctgacctgtactgcaatgaagacagctggcagctgcccatccatgctgctgcccagatgggccacaccaagatcctggacctgctgatccccctgaccaacagagcctgtgacaccggcctgaacaaggtgtcccctgtgtacagcgctgtgtttggaggccacgaggactgcctggagatcctgctgagaaatggctacagcccagatgcccaggcctgcctggtgtttggcttcagcagccctgtgtgcatggccttccagaaggactgtgagttctttggaattgtgaacatcctgctgaagtacggggcccagatcaatgagctgcacctggcctactgcctgaagtatgagaagttcagcatcttccgctacttcctgaggaagggctgcagcctgggcccctggaaccacatctatgaatttgtgaaccacgccatcaaggcccaggccaagtacaaggagtggctgccccacctgctggtggccggctttgaccccctcatcctgctgtgcaacagctggattgacagcgtgtccattgacaccctcatcttcaccctggagttcaccaactggaagaccctggccccagctgtggagaggatgctgagcgcccgggccagcaatgcctggatcctgcagcagcacatcgccaccgtgcccagcctgacccacctgtgccgcctggagatccgcagcagcctgaagtctgagcggctgcggagtgacagctacatcagccagctgcccctgcccaggagcctgcacaactacctgctgtatgaagatgtgctgaggatgtatgaggtgcctgagctggccgccatccaggatggatag

SEQ ID NO: 143657 - DNA, 1338 bp, Artificial Sequence
  Description of Artificial Sequence: Synthetic coding sequence
atgaagacctttgagggcttctgtgccctgcacctggccgccagccagggccactggaagatcgtgcagatcctgctggaggccggggctgaccccaatgccaccaccctggaggagaccacccccctcttcctggccgtggagaatggccagattgatgtgctgcggctgctgctgcagcacggggccaacgtgaatggcagccacagcatgtgtggctggaacagcctgcaccaggccagcttccaggagaatgctgagatcatcaagctgctgctgaggaaaggagccaacaaggagtgccaggatgactttggcatcacccccctgtttgtggccgcccagtatggcaagctggagagcctgagcatcctgatcagcagcggggccaacgtgaactgccaggccctggacaaggccacccccctcttcatcgccgcccaggagggccacaccaagtgtgtggagctgctgctgagcagtggagctgaccctgacctgtactgcaatgaagattcctggcagctgcccatccacgccgccgcccagatgggccacaccaagatcctggacctgctgatccccctgaccaacagagcctgtgacaccggcctgaacaaggtgtcccctgtgtacagcgctgtgtttggaggccacgaggactgcctggagatcctgctgagaaatggctacagcccagatgcccaggcctgcctggtgtttggcttcagcagccctgtgtgcatggccttccagaaggactgtgagttcttcggcatcgtgaacatcctgctgaagtatggagcccagatcaatgagctgcacctggcctactgcctgaagtatgagaagttcagcatcttccgctacttcctgaggaagggctgcagcctgggcccctggaaccacatctatgaatttgtgaaccacgccatcaaggcccaggccaagtacaaggagtggctgccccacctgctggtggccggctttgaccccctcatcctgctgtgcaacagctggattgattctgtgtccattgacaccctcatcttcaccctggagttcaccaactggaagaccctggccccagctgtggagaggatgctgagcgcccgggccagcaatgcctggatcctgcagcagcacatcgccaccgtgcccagcctgacccacctgtgccgcctggagatccgcagcagcctgaagtctgagcggctgcggagtgacagctacatcagccagctgcccctgcccaggagcctgcacaactacctgctgtatgaagatgtgctgaggatgtatgaggtgcctgagctggccgccatccaggacggctag

SEQ ID NO: 143658 - DNA, 1662 bp, Artificial Sequence
  Description of Artificial Sequence: Synthetic coding sequence
atgcccctggtgctgcaccaccctgagcggcaggccgagctgggcagcggcctgagagatggcggcggggccgccctgcggcccccaggccgcctggtgaagcagatggacttcacagaggcctatgctgacacctgcagcacagtgggcctggccgcccgggagggcaatgtgaaggtgctgaggaagctgctgaagaagggccgctctgtggatgtggccgacaacagaggctggatgcccatccatgaagctgcctaccacaacagcgtggagtgcctgcagatgctgatcaatgctgacagcagcgagaactacatcaagatgaagacctttgagggcttctgtgccctgcacctggccgccagccagggccactggaagatcgtgcagatcctgctggaggccggggctgaccccaatgccaccaccctggaggagaccacccccctcttcctggccgtggagaatggccagattgatgtgctgcggctgctgctgcagcacggggccaacgtgaatggcagccacagcatgtgtggctggaacagcctgcaccaggccagcttccaggagaatgctgagatcatcaagctgctgctgaggaaaggagccaacaaggagtgccaggatgactttggcatcacccccctgtttgtggccgcccagtatggcaagctggagagcctgagcatcctgatcagcagcggggccaacgtgaactgccaggccctggacaaggccacccccctcttcatcgccgcccaggagggccacaccaagtgtgtggagctgctgctgagcagtggagctgaccctgacctgtactgcaatgaagattcctggcagctgcccatccacgccgccgcccagatgggccacaccaagatcctggacctgctgatccccctgaccaacagagcctgtgacaccggcctgaacaaggtgtcccctgtgtacagcgctgtgtttggaggccacgaggactgcctggagatcctgctgagaaatggctacagcccagatgcccaggcctgcctggtgtttggcttcagcagccctgtgtgcatggccttccagaaggactgtgagttcttcggcatcgtgaacatcctgctgaagtatggagcccagatcaatgagctgcacctggcctactgcctgaagtatgagaagttcagcatcttccgctacttcctgaggaagggctgcagcctgggcccctggaaccacatctatgaatttgtgaaccacgccatcaaggcccaggccaagtacaaggagtggctgccccacctgctggtggccggctttgaccccctcatcctgctgtgcaacagctggattgattctgtgtccattgacaccctcatcttcaccctggagttcaccaactggaagaccctggccccagctgtggagaggatgctgagcgcccgggccagcaatgcctggatcctgcagcagcacatcgccaccgtgcccagcctgacccacctgtgccgcctggagatccgcagcagcctgaagtctgagcggctgcggagtgacagctacatcagccagctgcccctgcccaggagcctgcacaactacctgctgtatgaagatgtgctgaggatgtatgaggtgcctgagctggccgccatccaggacggctag

SEQ ID NO: 143659 - DNA, 1338 bp, Artificial Sequence; identical to SEQ ID NO: 143657
  Description of Artificial Sequence: Synthetic coding sequence

SEQ ID NO: 143660 - DNA, 1314 bp, Artificial Sequence
  Description of Artificial Sequence: Synthetic coding sequence
atggacttcacagaggcctatgctgacacctgcagcacagtgggcctggccgcccgggagggcaatgtgaaggtgctgaggaagctgctgaagaagggccgctctgtggatgtggccgacaacagaggctggatgcccatccacgaggccgcctaccacaacagcgtggagtgcctgcagatgctgatcaatgctgacagcagcgagaactacatcaagatgaagacctttgagggcttctgtgccctgcacctggccgccagccagggccactggaagatcgtgcagatcctgctggaggccggggctgaccccaatgccaccaccctggaggagaccacccccctcttcctgggcgccaacgtgaactgccaggccctggacaaggccacccccctcttcatcgccgcccaggagggccacaccaagtgtgtggagctgctgctgagcagtggagctgaccctgacctgtactgcaatgaagattcctggcagctgcccatccacgccgccgcccagatgggccacaccaagatcctggacctgctgatccccctgaccaacagagcctgtgacaccggcctgaacaaggtgtcccctgtgtacagcgctgtgtttggaggccacgaggactgcctggagatcctgctgagaaatggctacagcccagatgcccaggcctgcctggtgtttggcttcagcagccctgtgtgcatggccttccagaaggagtggagctgtgagttcttcggcatcgtgaacatcctgctgaagtatggagcccagatcaatgagctgcacctggcctactgcctgaagtatgagaagttcagcatcttccgctacttcctgaggaagggctgcagcctgggcccctggaaccacatctatgaatttgtgaaccacgccatcaaggcccaggccaagtacaaggagtggctgccccacctgctggtggccggctttgaccccctcatcctgctgtgcaacagctggattgattctgtgtccattgacaccctcatcttcaccctggagttcaccaactggaagaccctggccccagctgtggagaggatgctgagcgcccgggccagcaatgcctggatcctgcagcagcacatcgccaccgtgcccagcctgacccacctgtgccgcctggagatccgcagcagcctgaagtctgagcggctgcggagtgacagctacatcagccagctgcccctgcccaggagcctgcacaactacctgctgtatgaagatgtgctgaggatgtatgaggtgcctgagctggccgccatccaggacggctag

SEQ ID NO: 143661 - DNA, 1281 bp, Artificial Sequence
  Description of Artificial Sequence: Synthetic coding sequence
atggatggcaccacagcccctgtgaccaagtctggagctgccaagctggtgaagaggaacttcctggaggccctgaagagcaatgactttgggaagctgaaggccatcctgatccagaggcagattgatgtggacacagtgtttgaggtggaggatgagaacatggtgctggccagctacaagcagggctactggctgcccagctacaagctgaagagctcctgggccaccggcctgcacctgtctgtgctgtttggacatgtggagtgcctgctggtgctgctggaccacaatgccaccatcaactgccggcccaacgggaagacccccctgcacgtggcctgtgagatggccaacgtggactgtgtgaagatcctgtgtgacagaggagccaagctgaactgctacagcctgagcggccacacagccctgcacttctgcaccacccccagcagcatcctgtgtgccaagcagctggtgtggaggggggccaacgtgaacatgaagaccaacaaccaggatgaggagacccccctgcacacagctgcccacttcggcctgtctgagctggtggccttctacgtggagcacggggccatcgtggacagcgtgaatgcccacatggagacccccctggccatcgccgcctactgggccctgcgcttcaaggagcaggagtacagcacagagcaccacctggtgtgcaggatgctgctggactacaaggccgaggtgaatgccagagatgatgacttcaagagccccctgcacaaggccgcctggaactgtgaccacgtgctgatgcacatgatgctggaggccggggctgaggccaacctgatggacatcaatggctgtgccgccatccagtatgtgctgaaggtgacctctgtgcggcctgctgcccagcctgagatctgctaccagctgctgctgaaccacggggccgcccgcatctacccaccccagttccacaaggtgatccaggcctgccacagctgccccaaggccatcgaggtggtggtgaatgcctatgagcacatccgctggaacaccaagtggaggcgggccatcccagatgatgacctggagaagtactgggacttctaccacagcctcttcaccgtgtgctgcaacagccccaggaccctgatgcacctgagccgctgtgccatccggaggaccctgcacaaccgctgccaccgggccatccccctgctgagcctgcccctgagcctgaagaagtacctgctgctggagcctgagggcatcatctactag

SEQ ID NO: 143662 - DNA, 1050 bp, Artificial Sequence
  Description of Artificial Sequence: Synthetic coding sequence
atggatggcaccacagcccctgtgaccaagtctggagctgccaagctggtgaagaggaacttcctggaggccctgaagagcaatgactttgggaagctgaaggccatcctgatccagaggcagattgatgtggacacagtgtttgaggtggaggatgagaacatggtgctggccagctacaagcagggctactggctgcccagctacaagctgaagagctcctgggccaccggcctgcacctgtctgtgctgtttggacatgtggagtgcctgctggtgctgctggaccacaatgccaccatcaactgccggcccaacgggaagacccccctgcacgtggcctgtgagatggccaacgtggactgtgtgaagatcctgtgtgacagaggagccaagctgaactgctacagcctgagcggccacacagccctgcacttctgcaccacccccagcagcatcctgtgtgccaagcagctggtgtggaggggggccaacgtgaacatgaagaccaacaaccaggatgaggagacccccctgcacacagctgcccacttcggcctgtctgagctggtggccttctacgtggagcacggggccatcgtggacagcgtgaatgcccacatggagacccccctggccatcgccgcctactgggccctgcgcttcaaggagcaggagtacagcacagagcaccacctggtgtgcaggatgctgctggactacaaggccgaggtgaatgccagagatgatgacttcaagagccccctgcacaaggccgcctggaactgtgaccacgtgctgatgcacatgatgctggaggccggggctgaggccaacctgatggacatcaatggctgtgccgccatccagtatgtgctgaaggtgacctctgtgcggcctgctgcccagcctgagatctgctaccagctgctgctgaaccacggggccgcccgcatctacccaccccagttccacaaggtgcggctgtgccctgtggtgtcccggctgaggaagatccagatggccgccctgtctgagatcagcaagtag

SEQ ID NO: 143663 - DNA, 3747 bp, Artificial Sequence
  Description of Artificial Sequence: Synthetic coding sequence
atgggcaaggaccaggagctgctggaggccgccaggactggaaatgtggccctggtggagaagctgctgagcggcaggaaaggaggcatcctgggcggcggcagcggccccctgcccctgagcaacctgctgagcatctggaggggccccaacgtgaactgcacagacagcagcggctacacagccctgcaccacgccgccctgaatggccacaaggacatcgtgctgaagctgctgcagtatgaggccagcaccaacgtggccgacaacaagggctacttccccatccacctggccgcctggaagggagatgtggagatcgtgaagatcctgatccaccacggccccagccacagccgggtgaatgagcagaacaatgaaaatgaaacagccctgcactgtgccgcccagtatggccacagcgaggtggtggccgtgctgctggaggagctgacagaccccaccatccggaacagcaagctggagacccccctggacctggccgccctgtatggccgcctgcgggtggtgaagatgatcatcagcgcccaccccaacctgatgagctgcaacaccaggaagcacacccccctgcacctggccgccagaaatggccacaaggctgtggtgcaggtgctgctggaggccggcatggatgtgtcctgccagacagagaagggcagcgccctgcatgaagctgccctgtttgggaaggtggatgtggtgcgggtgctgctggagaccggcattgatgccaacatcaaggacagcctgggccgcacagtgctggacatcctgaaggagcaccccagccagaagagcctgcagatcgccaccctgctgcaggagtacctggagggcgtgggccgcagcacagtgctggaggagcctgtgcaggaggatgccacccaggagacccacatcagcagccctgtggagagccccagccagaagaccaagtcagaaacagtgactggagagctgagcaagctgctggatgagatcaagctgtgccaggagaaggactacagctttgaggacctgtgccacaccatcagtgaccactacctggacaacctgagcaagatcagcgaggaggagctgggcaagaatggcagccagagcgtgaggaccagcagcaccatcaacctgagccctggagaggtggaggaggaggatgatgatgagaacacctgtggccccagcggcctgtgggaggccctgaccccctgcaatggctgcaggaacctgggcttccccatgctggcccaggagagctaccccaagaagaggaactacaccatggagatcgtgcccagcgccagcctggacaccttccccagtgaaaatgaaaacttcctgtgtgacctgatggacacagctgtgaccaagaagccctgcagcctggagatcgcccgggcccccagccccaggacagacaatgccagcgaggtggccgtgaccaccccaggcaccagcaaccacaggaacagcagcacaggccccaccccagactgcagcccccccagcccagacacagccctgaagaacatcgtgaaggtgatccggccccagcccaagcagaggaccagcatcgtgagcagcctggacttccacaggatgaaccacaaccaggagtactttgagatcaacaccagcacaggctgcaccagcttcaccgccagccccccagccagcccccccaccagctctgtgggcaccacagaggtgaagaatgaaggcaccaaccacacagatgacctgagccggcaggatgacaatgacccccccaaggagtatgaccccggccagtttgctggcctgctgcacggcagcagccctgcctgtgagagccctgagaaccccttccacctgtatggcaagcgggagcagtgtgagaagggccaggatgaggtgtccctggccaacagccccctgcccttcaagcagagccccatcgagaacaacagcgagcccctggtgaagaagatcaagcccaaggtggtgtccaggaccatcttccacaagaagagcaaccagctggagaaccacaccatcgtgggcaccaggagcaccaggagcggcagcagaaatggagaccagtgggtgatgaatgctgggggctttgtggagcgggcctgcaccctgggccgcatccgcagcctgcccaaggccctgattgacatgcacctgagcaagtctgtgtccaagagtgacagcgacctgattgcctaccccagcaatgagaagaccagccgggtgaactggagcgagagcagcacagctgagcacagcagcaaaggaaacagcgagaggacccccagcttcaccagcgagtgggaggagattgacaagatcatgagcagcattgatgtgggcatcaacaatgagctgaaggagatgaatggagagaccacccggccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgcgggagcccagcggcaaccacaccccaccccagctgagccccagcctgagccagagcacctacaccaccggcggcagcctggatgtgccccacatcatcatgcagggagatgccaggagaagaagaaatgaaaactactttgatgacatccccaggagcaagctggagcggcagatggcccagacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggtgatgtgtgtgaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtggacctgctgcacgccagccacacaggccaggagcccagcgagcggcacacagaggaggccctgaggaagttctag

SEQ ID NO: 143664 - DNA, 1353 bp, Artificial Sequence
  Description of Artificial Sequence: Synthetic coding sequence
atgatgtggcagtgccacctgagcgcccaggactaccgctactaccctgtggatggctacagcctgctgaagcgcttccccctgcaccccctgaccggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgcggagctctgtgtgtgagatctggaccaaccagaatgccggcttccccttcagcgccatccaccaggtgcacaacacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaacatccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtgcagattgaccccagcgagcagaagaccctggccaacctgccctggatcgtggagcccggccaggaggccaagaggggcatcaacaccaagtatgagaccaccatcttctag

SEQ ID NO: 143665 - DNA, 765 bp, Artificial Sequence
  Description of Artificial Sequence: Synthetic coding sequence
atgcagggagatgccaggagaagaagaaatgaaaactactttgatgacatccccaggagcaagctggagcggcagatggcccagacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtggacctgctgcacgccagccacacaggccaggagcccagcgagcggcacacagaggaggccctgaggaagttctag

SEQ ID NO: 143666 - DNA, 1053 bp, Artificial Sequence
  Description of Artificial Sequence: Synthetic coding sequence
gtgctcttccagggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaaccagagctctgtgtgtgagatctggaccaaccagaatgccggcttccccttcagcgccatccaccaggtgcacaacacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaacatccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaaaggaggccacagcagcaccctgcctgagagctttgagaacaagcccagcaagcccatccccaagccccgggtgtccatcaggaagagcgtcatcgaccccagcgagcagaagaccctggccaacctgccctggatcgtggagcccggccaggaggccaagaggggcatcaacaccaagtatgagaccaccatcttctag

SEQ ID NO: 143667 - DNA, 2292 bp, Artificial Sequence
  Description of Artificial Sequence: Synthetic coding sequence
tccttccaggagagctaccccaagaagaggaactacaccatggagatcgtgcccagcgccagcctggacaccttccccagtgaaaatgaaaacttcctgtgtgacctgatggacacagctgtgaccaagaagccctgcagcctggagatcgcccgggcccccagccccaggacagacaatgccagcgaggtggccgtgaccaccccaggcaccagcaaccacaggaacagcagcacaggccccaccccagactgcagcccccccagcccagacacagccctgaagaacatcgtgaaggtgatccggccccagcccaagcagaggaccagcatcgtgagcagcctggacttccacaggatgaaccacaaccaggagtactttgagatcaacaccagcacaggctgcaccagcttcaccgccagccccccagccagcccccccaccagctctgtgggcaccacagaggtgaagaatgaaggcaccaaccacacagatgacctgagccggcaggatgacaatgacccccccaaggagtatgaccccggccagtttgctggcctgctgcacggcagcagccctgcctgtgagagccctgagaaccccttccacctgtatggcaagcgggagcagtgtgagaagggccaggatgaggtgtccctggccaacagccccctgcccttcaagcagagccccatcgagaacaacagcgagcccctggtgaagaagatcaagcccaaggtggtgtccaggaccatcttccacaagaagagcaaccagctggagaaccacaccatcgtgggcaccaggagcaccaggagcggcagcagaaatggagaccagtgggtgatgaatgccggcggctttgtggagcgggcctgcaccctgggccgcatccgcagcctgcccaaggccctgattgacatgcacctgagcaagtctgtgtccaagagtgacagcgacctgattgcctaccccagcaatgagaagaccagccgggtgaactggagcgagagcagcacagctgagcacagcagcaagggcaacagcgagaggacccccagcttcaccagcgagtgggaggagattgacaagatcatgagcagcattgatgtgggcatcaacaatgagctgaaggagatgaatggcccccgctgccctgtgcagacagtgggccagtggctggagagcatcggcctgccccagtatgagaaccacctgatggccaatggatttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgaccccccccagaagccacccaggagcatcaccctgaggactggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggtgatgtgtgtgaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaaaggaggccacagcagcaccctgcctgagagctttgagaacaagcccagcaagcccatccccaagccccgggtgtccatcaggaagtctgtggacctgctgcacgccagccacacaggccaggagcccagcgagcggcacacagaggaggccctgaggaagttctag

SEQ ID NO: 143668 - DNA, 1281 bp, Artificial Sequence
  Description of Artificial Sequence: Synthetic coding sequence
atgatgtggcagtgccacctgagcgcccaggactaccgctactaccctgtggatggctacagcctgctgaagcgcttccccctgcaccccctgaccggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgaggactggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtgcagattgaccccagcgagcagaagaccctggccaacctgccctggatcgtggagcccggccaggaggccaagaggggcatcaacaccaagtatgagaccaccatcttctag

SEQ ID NO: 143669 - DNA, 1383 bp, Artificial Sequence
  Description of Artificial Sequence: Synthetic coding sequence
atgatgtggcagtgccacctgagcgcccaggactaccgctactaccctgtggatggctacagcctgctgaagcgcttccccctgcaccccctgaccggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgcgggagcccagcggcaaccacaccccaccccagctgagccccagcctgagccagagcacctacaccaccggcggcagcctggatgtgccccacatcatcatgcagggagatgccaggagaagaagaaatgaaaactactttgatgacatccccaggagcaagctggagcggcagatggcccagacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtgcccttctgcttcaaggctgaccggcccatctag

SEQ ID NO: 143670 - DNA, 2295 bp, Artificial Sequence
  Description of Artificial Sequence: Synthetic coding sequence
atgctggcccaggagagctaccccaagaagaggaactacaccatggagatcgtgcccagcgccagcctggacaccttccccagtgaaaatgaaaacttcctgtgtgacctgatggacacagctgtgaccaagaagccctgcagcctggagatcgcccgggcccccagccccaggacagacaatgccagcgaggtggccgtgaccaccccaggcaccagcaaccacaggaacagcagcacaggccccaccccagactgcagcccccccagcccagacacagccctgaagaacatcgtgaaggtgatccggccccagcccaagcagaggaccagcatcgtgagcagcctggacttccacaggatgaaccacaaccaggagtactttgagatcaacaccagcacaggctgcaccagcttcaccgccagccccccagccagcccccccaccagctctgtgggcaccacagaggtgaagaatgaaggcaccaaccacacagatgacctgagccggcaggatgacaatgacccccccaaggagtatgaccccggccagtttgctggcctgctgcacggcagcagccctgcctgtgagagccctgagaaccccttccacctgtatggcaagcgggagcagtgtgagaagggccaggatgaggtgtccctggccaacagccccctgcccttcaagcagagccccatcgagaacaacagcgagcccctggtgaagaagatcaagcccaaggtggtgtccaggaccatcttccacaagaagagcaaccagctggagaaccacaccatcgtgggcaccaggagcaccaggagcggcagcagaaatggagaccagtgggtgatgaatgctgggggctttgtggagcgggcctgcaccctgggccgcatccgcagcctgcccaaggccctgattgacatgcacctgagcaagtctgtgtccaagagtgacagcgacctgattgcctaccccagcaatgagaagaccagccgggtgaactggagcgagagcagcacagctgagcacagcagcaaaggaaacagcgagaggacccccagcttcaccagcgagtgggaggagattgacaagatcatgagcagcattgatgtgggcatcaacaatgagctgaaggagatgaatggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgaggactggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtggacctgctgcacgccagccacacaggccaggagcccagcgagcggcacacagaggaggccctgaggaagttctag

SEQ ID NO: 143671 - DNA, 3747 bp, Artificial Sequence
  Description of Artificial Sequence: Synthetic coding sequence
atgggcaaggaccaggagctgctggaggccgccaggactggaaatgtggccctggtggagaagctgctgagcggcaggaaaggaggcatcctgggcggcggcagcggccccctgcccctgagcaacctgctgagcatctggaggggccccaacgtgaactgcacagacagcagcggctacacagccctgcaccacgccgccctgaatggccacaaggacatcgtgctgaagctgctgcagtatgaggccagcaccaacgtggccgacaacaagggctacttccccatccacctggccgcctggaagggagatgtggagatcgtgaagatcctgatccaccacggccccagccacagccgggtgaatgagcagaacaatgaaaatgaaacagccctgcactgtgccgcccagtatggccacagcgaggtggtggccgtgctgctggaggagctgacagaccccaccatccggaacagcaagctggagacccccctggacctggccgccctgtatggccgcctgcgggtggtgaagatgatcatcagcgcccaccccaacctgatgagctgcaacaccaggaagcacacccccctgcacctggccgccagaaatggccacaaggctgtggtgcaggtgctgctggaggccggcatggatgtgtcctgccagacagagaagggcagcgccctgcatgaagctgccctgtttgggaaggtggatgtggtgcgggtgctgctggagaccggcattgatgccaacatcaaggacagcctgggccgcacagtgctggacatcctgaaggagcaccccagccagaagagcctgcagatcgccaccctgctgcaggagtacctggagggcgtgggccgcagcacagtgctggaggagcctgtgcaggaggatgccacccaggagacccacatcagcagccctgtggagagccccagccagaagaccaagtcagaaacagtgactggagagctgagcaagctgctggatgagatcaagctgtgccaggagaaggactacagctttgaggacctgtgccacaccatcagtgaccactacctggacaacctgagcaagatcagcgaggaggagctgggcaagaatggcagccagagcgtgaggaccagcagcaccatcaacctgagccctggagaggtggaggaggaggatgatgatgagaacacctgtggccccagcggcctgtgggaggccctgaccccctgcaatggctgcaggaacctgggcttccccatgctggcccaggagagctaccccaagaagaggaactacaccatggagatcgtgcccagcgccagcctggacaccttccccagtgaaaatgaaaacttcctgtgtgacctgatggacacagctgtgaccaagaagccctgcagcctggagatcgcccgggcccccagccccaggacagacaatgccagcgaggtggccgtgaccaccccaggcaccagcaaccacaggaacagcagcacaggccccaccccagactgcagcccccccagcccagacacagccctgaagaacatcgtgaaggtgatccggccccagcccaagcagaggaccagcatcgtgagcagcctggacttccacaggatgaaccacaaccaggagtactttgagatcaacaccagcacaggctgcaccagcttcaccgccagccccccagccagcccccccaccagctctgtgggcaccacagaggtgaagaatgaaggcaccaaccacacagatgacctgagccggcaggatgacaatgacccccccaaggagtatgaccccggccagtttgctggcctgctgcacggcagcagccctgcctgtgagagccctgagaaccccttccacctgtatggcaagcgggagcagtgtgagaagggccaggatgaggtgtccctggccaacagccccctgcccttcaagcagagccccatcgagaacaacagcgagcccctggtgaagaagatcaagcccaaggtggtgtccaggaccatcttccacaagaagagcaaccagctggagaaccacaccatcgtgggcaccaggagcaccaggagcggcagcagaaatggagaccagtgggtgatgaatgctgggggctttgtggagcgggcctgcaccctgggccgcatccgcagcctgcccaaggccctgattgacatgcacctgagcaagtctgtgtccaagagtgacagcgacctgattgcctaccccagcaatgagaagaccagccgggtgaactggagcgagagcagcacagctgagcacagcagcaaaggaaacagcgagaggacccccagcttcaccagcgagtgggaggagattgacaagatcatgagcagcattgatgtgggcatcaacaatgagctgaaggagatgaatggagagaccacccggccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgcgggagcccagcggcaaccacaccccaccccagctgagccccagcctgagccagagcacctacaccaccggcggcagcctggatgtgccccacatcatcatgcagggagatgccaggagaagaagaaatgaaaactactttgatgacatccccaggagcaagctggagcggcagatggcccagacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtggacctgctgcacgccagccacacaggccaggagcccagcgagcggcacacagaggaggccctgaggaagttctag

SEQ ID NO: 143672 - DNA, 1074 bp, Artificial Sequence
  Description of Artificial Sequence: Synthetic coding sequence
atggccaatggatttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaaccagagctctgtgtgtgagatctggaccaaccagaatgccggcttccccttcagcgccatccaccaggtgcacaacacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtgattgaccccagcgagcagaagaccctggccaacctgccctggatcgtggagcccggccaggaggccaagaggggcatcaacaccaagtatgagaccaccatcttctag

SEQ ID NO: 143673 - DNA, 1533 bp, Artificial Sequence
  Description of Artificial Sequence: Synthetic coding sequence
atgatgtggcagtgccacctgagcgcccaggactaccgctactaccctgtggatggctacagcctgctgaagcgcttccccctgcaccccctgaccggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgcgggagcccagcggcaaccacaccccaccccagctgagccccagcctgagccagagcacctacaccaccggcggcagcctggatgtgccccacatcatcatgcagggagatgccaggagaagaagaaatgaaaactactttgatgacatccccaggagcaagctggagcggcagatggcccagagctctgtgtgtgagatctggaccaaccagaatgccggcttccccttcagcgccatccaccaggtgcacaacacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtgcagattgaccccagcgagcagaagaccctggccaacctgccctggatcgtggagcccggccaggaggccaagaggggcatcaacaccaagtatgagaccaccatcttctag

SEQ ID NO: 143674 - DNA, 1245 bp, Artificial Sequence
  Description of Artificial Sequence: Synthetic coding sequence
atgatgtggcagtgccacctgagcgcccaggactaccgctactaccctgtggatggctacagcctgctgaagcgcttccccctgcaccccctgaccggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgaggactggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtggacctgctgcacgccagccacacaggccaggagcccagcgagcggcacacagaggaggccctgaggaagttctag

SEQ ID NO: 143675 - DNA, 1353 bp, Artificial Sequence
  Description of Artificial Sequence: Synthetic coding sequence
atgatgtggcagtgccacctgagcgcccaggactaccgctactaccctgtggatggctacagcctgctgaagcgcttccccctgcaccccctgaccggcccccgctgccctgtgcagacagtgggccagtggctggagagcatcggcctgccccagtatgagaaccacctgatggccaacggctttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgatcctccccagaagcccccaagaagcatcaccctgcggagctctgtgtgtgagatctggaccaaccagaatgccggcttccccttcagcgccatccaccaggtgcacaacacaggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaagggcggccacagcagcaccctgcctgagagctttgagaacaagcccagcaagcccatccccaagccccgggtgtccatcaggaagtctgtgcagattgaccccagcgagcagaagaccctggccaacctgccctggatcgtggagcccggccaggaggccaagaggggcatcaacaccaagtatgagaccaccatcttctag

SEQ ID NO: 143676 - DNA, 1185 bp, Artificial Sequence
  Description of Artificial Sequence: Synthetic coding sequence
atgggcccccgctgccctgtgcagacagtgggccagtggctggagagcatcggcctgccccagtatgagaaccacctgatggccaatggatttgacaacgtgcagttcatgggcagcaatgtgatggaggaccaggacctgctggagatcggcatcctgaacagcggccaccggcagaggatcctgcaggccatccagctgctgcccaagatgaggcccatcggccatgatggctaccaccccacctctgtggccgagtggctggacagcattgagctgggggactacaccaaggccttcctgatcaatggctacacctccatggacctgctgaagaagatctgggaggtggagctgatcaacgtgctgaagatcaacctgattggccacaggaagaggatcctggccagcctgggggaccggctgcatgatgaccccccccagaagccacccaggagcatcaccctgaggactggagactggggcgagcccagcatcaccctgcggcccccaaatgaggccacagccagcacccctgtgcagtactggcagcaccaccctgagaagctgatcttccagagctgtgactacaaggccttctacctgggctccatgctgatcaaggagctgcggggcacagagagcacccaggatgcctgtgccaagatgagggccaactgccagaagagcacagagcagatgaagaaggtgcccaccatcatcctgtctgtgtcctacaagggcgtgaagttcattgatgccaccaacaagaacatcatcgccgagcacgagatccggaacatcagctgtgccgcccaggaccctgaggacctgagcacctttgcctacatcaccaaggacctgaagagcaaccaccactactgccacgtgttcaccgcctttgatgtgaacctggcctatgagatcatcctgaccctgggccaggcctttgaggtggcctaccagctggccctgcaggccaggaaaggaggccacagcagcaccctgcctgagagctttgagaacaagcccagcaagcccatccccaagccccgggtgtccatcaggaagagcgtcatcgaccccagcgagcagaagaccctggccaacctgccctggatcgtggagcccggccaggaggccaagaggggcatcaacaccaagtatgagaccaccatcttctag

SEQ ID NO: 143677 - DNA, 1254 bp, Artificial Sequence
  Description of Artificial Sequence: Synthetic coding sequence
atgagcacccgctaccaccaggccgccagtgacagctacctggagctgctgaaggaggccaccaagagggacctgaacctgagtgatgaagatggcatgacccccaccctgctggccgcctaccacggcaacctggaggccctggagatcatctgcagcagaggaggagaccctgacagatgtgacatctggggcaacacccccctgcactttgctgccagcaatggacatgcccactgtgtgtccttcctggtgaactttggagccaacatctttgccctggacaatgacctgcagacccccctggatgctgctgccagccgggagcagaatgaatgtgtggccctgctggacaaggccgccacagcccagaacatcatgaaccccaagaaggtgacccggctgaaggagcaggcccagaagaatgcccggcggcagatcaaggaatgtgagcggctgcaggagaagcaccagaacaagatggcccacacctacagcaaggaggagagcggcaccctgagcagcagcaagggcaccttcagccgcagcagccccagcaatgccagcgcccctggcaccttcggcagcctgagcaagggcatcaaggacaccttcaagatcaagttcaagaagaacaaggacacagctgagcaggtgggcaaggagggccgcagcggccagagaaatgtgatggaggtgttccgggaggaggaggaggacagcttcagcggggacttcaaggagaagctgcagctgtctgctgaggaggatggctctgtgcaccacgagagcatcctgaacagacctggcctgggcagcatcgtgttcagaagaaaccgcatcagcagccctgaggacatcagtgacagcaagcgggagtttggcttcaagctgcccagcgagctgctgcagaggcagggcgccagcgaggctgatgagggcgctgctgatgaggagggggaggagaatggcctgaaggatgacctgccctgggatgatgatgaggtggagtgggaggaggatgtggtggatgccacccccctggaggtgttcctgctgagccagcacctggaggagttcctgcccatcttcaagcgggagcagattgacctggaggccctgctgctgtgcagtgatgaggacctgcagagcatccagatgcagctgggccccaggaagaaggtgctgaatgccatcaacagaaggaagcaggtgctgcagcagcccggccagctggtggacaccagcctgtag

SEQ ID NO: 143678 - DNA, 7992 bp, Artificial Sequence
  Description of Artificial Sequence: Synthetic coding sequence
atgcccaagggcggctgccccaaggccccccagcaggaggagctgcccctgagcagtgacatggtggagaagcagacaggcaagaaggacaaggacaaggtgtccctgaccaagacccccaagctggagagaggagatggcggcaaggaggtgcgggagcgggccagcaagaggaagctgcccttcaccgctggggccaatggagagcagaaggacagcgacacagagaagcagggccctgagaggaagaggatcaagaaggagcctgtgaccaggaaggccggcctgctgtttggcatgggcctgagcggcatccgggccggctaccccctgtctgagcggcagcaggtggccctgctgatgcagatgacagctgaggagagcgccaacagccctgtggacaccacccccaagcaccccagccagagcacagtgtgccagaagggcacccccaacagcgccagcaagaccaaggacaaggtgaacaagagaaatgaaagaggagagacccggctgcacagagctgccatcagaggagatgcccggcgcatcaaggagctgatcagcgagggcgcagatgtgaatgtgaaggactttgctggctggacagccctgcacgaggcctgcaacagaggctactatgatgtggccaagcagctgctggccgccggggctgaggtgaacaccaagggcctggatgatgacacccccctgcatgatgctgccaacaacggccactacaaggtggtgaagctgctgctgcgctatggaggcaacccccagcagagcaacaggaagggggagacccccctgaaggtggccaacagccccaccatggtgaacctgctgctgggcaagggcacctacaccagcagcgaggagagcagcacagagagcagcgaggaggaggatgcccccagctttgcccccagcagctctgtggatggcaacaacacagattctgaatttgagaagggcctgaagcacaaggccaagaaccctgagccccagaaggccacagcccctgtgaaggatgaatatgaatttgatgaagatgatgagcaggacagagtgccccctgtggatgacaagcacctgctgaagaaggactacaggaaggagaccaagagcaacagcttcatcagcatccccaagatggaggtgaagagctacaccaagaacaacaccatcgcccccaagaaggccagccaccgcatcctgagtgacaccagtgatgaggaggatgcctctgtgacagtgggcaccggggagaagctgcggctgagcgcccacaccatcctgcccggcagcaagacccgggagcccagcaatgccaagcagcagaaggagaagaacaaggtgaagaagaagaggaagaaggagaccaagggccgggaggtgcgctttgggaagagaagtgacaagttctgcagcagcgagagcgagagcgagagcagcgagagcggggaggatgaccgggacagcctgggcagcagcggctgcctgaagggcagccccctggtgctgaaggaccccagcctcttcagcagcctgagcgccagcagcaccagcagccacggcagcagcgctgcccagaagcagaaccccagccacacagaccagcacaccaagcactggaggacagacaactggaagaccatcagcagccctgcctggagcgaggtgagcagcctgagtgacagcaccaggacccggctgaccagcgagagtgactacagcagcgagggcagctctgtggagagcctgaagcctgtgaggaagaggcaggagcacaggaagagggccagcctgtctgagaagaagagccccttcctgagcagcgctgagggcgctgtgcccaagctggacaaggagggcaaggtggtgaagaagcacaagaccaagcacaagcacaagaacaaggagaagggccagtgcagcatcagccaggagctgaagctgaagagcttcacctatgaatatgaggacagcaagcagaagagtgacaaggccatcctgctggagaatgacctgagcacagagaacaagctgaaggtgctgaagcatgaccgggaccacttcaagaaggaggagaagctgagcaagatgaagctggaggagaaggagtggctgttcaaggatgagaagagcctgaagaggatcaaggacaccaacaaggacatcagccgctccttccgggaggagaaggacaggagcaacaaggccgagaaggagaggagcctgaaggagaagagccccaaggaggagaagctgcggctgtacaaggaggagaggaagaagaagagcaaggaccggcccagcaagctggagaagaagaatgacctgaaggaggacaagatcagcaaggagaaggagaagatcttcaaggaggacaaggagaagctgaagaaggagaaggtgtaccgggaggacagcgcctttgatgagtactgcaacaagaaccagttcctggagaatgaagacaccaagttcagcctgagtgatgaccagagggaccgctggttcagtgacctgagtgacagcagctttgacttcaagggagaagattcctgggacagccctgtgacagactacagagacatgaagagtgacagcgtggccaagctgatcctggagaccgtgaaggaggacagcaaggagaggagaagagacagccgggcccgggagaagagggactaccgggagcccttcttcaggaagaaggaccgggactacctggacaagaacagcgagaagaggaaggagcagacagagaagcacaagtctgtgcccggctacctgtctgagaaggacaagaagagaagagagagcgctgaggccggccgggacaggaaggatgccctggagagctgcaaggagaggagagatggccgggccaagccagaggaggcccaccgggaggagctgaaggaatgtggctgtgagagcggcttcaaggacaagagtgatggagactttgggaagggcctggagccctgggagcggcaccacccagcccgggagaaggagaagaaggatggccctgacaaggagaggaaggagaagaccaagccagagcgctacaaggagaagagcagtgacaaggacaagtctgagaagagcatcctggagaagtgccagaaggacaaggagtttgacaagtgcttcaaggagaagaaggacaccaaggagaagcacaaggacacccacggcaaggacaaggagaggaaggccagcctggaccagggcaaggagaagaaggagaaggccttccctggcatcatcagcgaggacttcagcgagaagaaggatgacaagaagggcaaggagaagtcctggtacatcgctgacatcttcacagatgaaagtgaagatgaccgggacagctgcatgggcagcggcttcaagatgggagaggccagtgacctgcccaggacagatggcctgcaggagaaggaggagggccgggaggcctatgccagtgacagacacaggaagagcagtgacaagcagcaccctgagcggcagaaggacaaggagccccgggacaggaggaaggacagaggagctgctgatgctggccgggacaagaaggagaaggtgtttgagaagcacaaggagaagaaggacaaggagagcacagagaagtacaaggacaggaaggaccgggcctctgtggacagcacccaggacaagaagaacaagcagaagctgcctgagaaggccgagaagaagcatgctgctgaggacaaggccaagagcaagcacaaggagaagagtgacaaggagcacagcaaggagaggaagagcagccgctctgcagatgctgagaagagcctgctggagaagctggaggaggaggccctgcacgagtaccgggaggacagcaatgacaagatcagcgaggtgtccagtgacagcttcacagaccggggccaggagcccggcctgacagccttcctggaggtgtccttcacagagcccccaggagatgacaagccccgggagagcgcctgcctgcctgagaagctgaaggagaaggagcggcaccgccacagcagcagcagcagcaagaagagccatgaccgggagcgggccaagaaggagaaggccgagaagaaggagaagggggaggactacaaggagggcggcagcaggaaggacagcggccagtatgagaaggacttcctggaggctgatgcctacggcgtgtcctacaacatgaaggctgacattgaagatgagctggacaagaccatcgagctgttcagcacagagaagaaggacaagaatgattctgagcgggagcccagcaagaagattgagaaggagctgaagccctacggcagcagcgccatcaacatcctgaaggagaagaagaagcgggagaagcaccgggagaagtggagagatgagaaggagcggcaccgggacagacatgctgatggcctgctgcggcaccacagagatgagctgctgcggcaccacagagatgagcagaagccagccacccgggacaaggacagccccccccgggtgctgaaggacaagagcagagatgagggcccccggctgggagatgccaagctgaaggagaagttcaaggatggagctgagaaggagaagggggaccctgtgaagatgagcaatggaaatgacaaggtggcccccagcaaggaccccgggaagaaggatgcccggccccgggagaagctgctgggagatggagacctgatgatgaccagctttgagaggatgctgagccagaaggacctggagattgaggagcggcacaagaggcacaaggagaggatgaagcagatggagaagctgcggcacaggtctggggaccccaagctgaaggagaaggccaagccagcagatgatggcaggaagaagggcctggacatcccagccaagaagcccccaggcctggacccccccttcaaggacaagaagctgaaggagagcacccccatccccccagctgctgagaacaagctgcacccagccagcggggctgacagcaaggactggctggccggcccccacatgaaggaggtgctgcctgccagccccaggccagaccagagccggcccactggagtgcccacccccacctctgtgctgagctgccccagctatgaggaggtgatgcacacccccaggacccccagctgcagcgcagatgattatgctgacctggtgtttgactgtgccgacagccagcacagcacccctgtgcccacagcccccaccagcgcctgcagccccagcttctttgaccgcttctctgtggccagcagcggcctgtctgaaaatgccagccaggccccagcccggcccctgagcaccaacctgtacagatctgtgtctgtggacatccggaggaccccagaggaggagttctctgtgggggacaagctgttccggcagcagagcgtgcctgctgccagcagctatgacagccccatgccacccagcatggaggaccgggcccccctgccccctgtgcctgctgagaagtttgcctgcctgagccctggctactacagcccagactatggcctgcccagccccaaggtggatgccctgcactgccccccagctgctgtggtgacagtgacccccagccctgagggcgtcttcagcagcctgcaggccaagcccagccccagccccagggctgagctgctggtgcccagcctggagggcgccctgcccccagacctggacaccagcgaggaccagcaggccacagctgccatcatccccccagagcccagctacctggagcccctggatgagggccccttctctgctgtgatcacagaggagcctgtggagtgggcccaccccagcgagcaggccctggccagcagcctgattggaggcaccagcgagaaccctgtgtcctggcctgtgggcagtgacctgctgctgaagagcccccagcgcttccctgagagccccaagcgcttctgcccagctgaccccctgcacagcgctgcccctggccccttcagcgccagcgaggccccctacccagcccccccagccagccctgccccctatgccctgcctgtggccgagcccggcctggaggatgtgaaggatggagtggatgctgtgcctgctgccatcagcaccagcgaggccgccccctatgccccacccagcggcctggagagcttcttcagcaactgcaagagcctgcctgaggcccccctggatgtggcccctgagcccgcctgtgtggccgctgtggcccaggtggaggccctgggccccctggagaacagcttcctggatggcagccggggcctgagccacctgggccaggtggagcctgtgccctgggcagatgcctttgctggcccagaagatgacctggacctgggccccttcagcctgcctgagctgcccctgcagaccaaggatgctgctgatggagaggccgagcctgtggaggagagcctggcccctcctgaggagatgcctcctggggcccctggggtcatcaatggaggagatgtgtccacagtggtggccgaggagcccccagccctgcccccagaccaggccagcacccggctgcctgctgagctggagcctgagcccagcggggagcccaagctggatgtggccctggaggccgctgtggaggccgagaccgtgcctgaggagcgggcccggggggaccctgacagctctgtggagcccgcccctgtgcccccagagcagaggcccctgggcagcggggaccagggcgctgaggccgagggccccccagctgccagcctgtgtgccccagatggccctgcccccaacacagtggcccaggcccaggccgcagatggagctggcccagaagatgacacagaggccagcagagctgctgccccagctgagggccccccaggcggcatccagcctgaggccgctgagcccaagcccacagctgaggcccccaaggccccccgggtggaggagatcccccagaggatgaccaggaacagagcccagatgctggccaaccagagcaagcagggccccccaccttctgagaaggaatgtgcccccaccccagcccctgtgacccgggccaaggcccggggctctgaagatgatgatgcccaggcccagcaccccaggaagaggcgcttccagaggagcacccagcagctgcagcagcagctgaacaccagcacccagcagacccgggaggtgatccagcagaccctggccgccatcgtggatgccatcaagctggatgccatcgagccctaccacagcgaccgggccaacccctactttgagtacctgcagatcaggaagaagattgaggagaagaggaagatcctgtgctgcatcaccccccaggccccccagtgctacgcagaatatgtgacctacacaggcagctacctgctggatggcaagcccctgagcaagctgcacatccctgtgattgcccccccacccagcctggccgagcccctgaaggagctgttccggcagcaggaggccgtgcggggcaagctgcggctgcagcacagcattgagcgggagaagctgattgtgtcctgtgagcaggagatcctgcgggtgcactgcagagctgcccggaccatcgccaaccaggccgtgcccttcagcgcctgcaccatgctgctggacagcgaggtgtacaacatgcccctggagagccagggagatgagaacaagtctgtgcgggaccgcttcaatgcccggcagttcatctcctggctgcaggatgtggatgacaagtatgacaggatgaagacctgcctgctgatgaggcagcagcatgaagctgctgccctgaatgctgtgcagaggatggagtggcagctgaaggtgcaggagctggaccctgctggccacaagagcctgtgtgtgaatgaggtgcccagcttctacgtgcccatggtggatgtgaatgatgactttgtgctgctgcctgcctag

SEQ ID NO: 143679 - DNA, 1836 bp, Artificial Sequence
  Description of Artificial Sequence: Synthetic coding sequence
tccatccccaagatggaggtgaagagctacaccaagaacaacaccatcgcccccaagaaggccagccaccgcatcctgagtgacaccagtgatgaagaagatgcctctgtgacagtgggcactggagagaagctgcggctgagcgcccacaccatcctgcccggcagcaagacccgggagcccagcaatgccaagcagcagaaggagaagaacaaggtgaagaagaagaggaagaaggagaccaagggccgggaggtgcgctttgggaagagaagtgacaagttctgcagcagcgagagcgagagcgagagcagcgagagcggagaagatgaccgggacagcctgggcagcagcggctgcctgaagggcagccccctggtgctgaaggaccccagcctcttcagcagcctgagcgccagcagcaccagcagccacggcagcagcgctgcccagaagcagaaccccagccacacagaccagcacaccaagcactggaggacagacaactggaagaccatcagcagccctgcctggagcgaggtgagcagcctgagtgacagcaccaggacccggctgaccagcgagagtgactacagcagcgagggcagctctgtggagagcctgaagcctgtgaggaagaggcaggagcacaggaagagggccagcctgtctgagaagaagagccccttcctgagcagcgctgagggcgctgtgcccaagctggacaaggagggcaaggtggtgaagaagcacaagaccaagcacaagcacaagaacaaggagaagggccagtgcagcatcagccaggagctgaagctgaagagcttcacctatgaatatgaggacagcaagcagaagagtgacaaggccatcctgctggagaatgacctgagcacagagaacaagctgaaggtgctgaagcatgaccgggaccacttcaagaaggaggagaagctgagcaagatgaagctggaggagaaggagtggctgttcaaggatgagaagagcctgaagaggatcaaggacaccaacaaggacatcagccgctccttccgggaggagaaggacaggagcaacaaggccgagaaggagaggagcctgaaggagaagagccccaaggaggagaagctgcggctgtacaaggaggagaggaagaagaagagcaaggaccggcccagcaagctggagaagaagaatgacctgaaggaggacaagatcagcaaggagaaggagaagatcttcaaggaggacaaggagaagctgaagaaggagaaggtgtacagagaagattctgcctttgatgagtactgcaacaagaaccagttcctggagaatgaagacaccaagttcagcctgagtgatgaccagagggaccgctggttcagtgacctgagtgacagcagctttgacttcaagggggaggacagctgggacagccctgtgacagactacagagacatgaagagtgacagcgtggccaagctgatcctggagaccgtgaaggaggacagcaaggagcggcggcgggacagccgggcccgggagaagagggactaccgggagcccttcttcaggaagaaggaccgggactacctggacaagaacagcgagaagaggaaggagcagacagagaagcacaagtctgtgcccggctacctgtctgagaagcatgaaagaagaagaagaaggatggcccccatcagaaaaggaagaagacggcagaaccagaaggacaccaagagaaatcctgtgaccaggaccaaggtgaggaaccagagctggaagaatgtgcggaggaccaagaacctgatcaacgtgctgaagaggaagaagtag

SEQ ID NO: 143680 - DNA, 7992 bp, Artificial Sequence; identical to SEQ ID NO: 143678
  Description of Artificial Sequence: Synthetic coding sequence

SEQ ID NO: 143681 - DNA, 1317 bp, Artificial Sequence
  Description of Artificial Sequence: Synthetic coding sequence
tctgctggccgggtgaatgaagatagagtgcgcagcaggaccatgcccaagggcggctgccccaaggccccccagcaggaggagctgcccctgagcagtgacatggtggagaagcagacaggcaagaaggacaaggacaaggtgtccctgaccaagacccccaagctggagagaggagatggcggcaaggaggtgcgggagcgggccagcaagaggaagctgcccttcaccgctggggccaatggagagcagaaggacagcgacacagagaagcagggccctgagaggaagaggatcaagaaggagcctgtgaccaggaaggccggcctgctgtttggcatgggcctgagcggcatccgggccggctaccccctgtctgagcggcagcaggtggccctgctgatgcagatgacagctgaggagagcgccaacagccctgtggacaccacccccaagcaccccagccagagcacagtgtgccagaagggcacccccaacagcgccagcaagaccaaggacaaggtgaacaagagaaatgaaagaggagagacccggctgcacagagctgccatcagaggagatgcccggcgcatcaaggagctgatcagcgagggcgcagatgtgaatgtgaaggactttgctggctggacagccctgcacgaggcctgcaacagaggctactatgatgtggccaagcagctgctggccgccggggctgaggtgaacaccaagggcctggatgatgacacccccctgcatgatgctgccaacaacggccactacaaggtggtgaagctgctgctgcgctatggaggcaacccccagcagagcaacaggaagggggagacccccctgaaggtggccaacagccccaccatggtgaacctgctgctgggcaagggcacctacaccagcagcgaggagagcagcacagagagcagcgaggaggaggatgcccccagctttgcccccagcagctctgtggatggcaacaacacagattctgaatttgagaagggcctgaagcacaaggccaagaaccctgagccccagaaggccacagcccctgtgaaggatgaatatgaatttgatgaagatgatgagcaggacagagtgccccctgtggatgacaagcacctgctgaagaaggactacaggaaggagaccaagagcaacagcttcatcagcatccccaagatggagaaggtgaccctgaagatcacccggctgcaccagaggaagaggcccatcgtgtcctgccagaccaggaggaccaggaggaccagggtgagcccctggggccaggagaggagctag

SEQ ID NO: 143682 - DNA, 6189 bp, Artificial Sequence
  Description of Artificial Sequence: Synthetic coding sequence
atgcccaagagcggcttcaccaagcccatccagagtgaaaattctgacagcgacagcaacatggtggagaagccctacggcaggaagagcaaggacaagatcgccagctacagcaagacccccaagattgaaagaagtgatgtgtccaaggagatgaaggagaagagctccatgaagaggaagctgcccttcaccatcagccccagcagaaatgaggagcgggacagcgacacagacagcgaccccggccacaccagcgagaactggggcgagcggctcatcagcagctaccgcacctacagcgagaaggagggccctgagaagaagaagaccaagaaggaggccggcaacaagaagagcacccctgtgtccatcctgtttggctaccccctgtctgagaggaagcagatggccctgctgatgcagatgacagcccgggacaacagcccagacagcacccccaaccaccccagccagaccaccccagcccagaagaagacccccagcagcagcagccggcagaaggacaaggtgaacaagagaaatgaaagaggagagacccccctgcacatggccgccatcagaggagatgtgaagcaggtgaaggagctgatcagcctgggcgccaacgtgaatgtgaaggactttgctggctggacccccctgcacgaggcctgcaatgtgggctactatgatgtggccaagatcctgattgctgctggagcagatgtgaacacccagggcctggatgatgacacccccctgcatgacagcgccagcagcggccaccgggacatcgtgaagctgctgctgcggcatggaggcaaccccttccaggccaacaagcatggagagaggcctgtggatgtggccgagacagaggagctggagctgctgctgaagcgggaggtgcccctgagtgatgatgatgagagctacacagacagcgaggaggcccagagcgtgaaccccagctctgtggatgaaaatattgattctgaaacagagaaggacagcctcatctgtgagagcaagcagatcctgcccagcaagacccccctgcccagcgccctggatgaatatgagttcaaggatgatgatgatgaggagatcaacaagatgattgatgacagacacatcctgaggaaggagcagaggaaagaaaatgaacctgaggccgagaagacccacctgtttgccaagcaggagaaggccttctaccccaagagcttcaagagcaagaagcagaagcccagccgggtgctgtacagcagcacagagagcagtgatgaggaggccctgcagaacaagaagatcagcaccagctgcagcgtcatccctgagaccagcaacagcgacatgcagaccaagaaggagtatgtggtgtctggagagcacaagcagaagggcaaggtgaagaggaagctgaagaaccagaacaagaacaaggagaaccaggagctgaagcaggagaaggagggcaaggagaacacccgcatcaccaacctgactgtgaacacaggcctggactgcagcgagaagacccgggaggagggcaacttcaggaagagcttcagccccaaggatgacaccagcctgcacctgttccacatcagcacaggcaagagccccaagcacagctgtggcctgtctgagaagcagagcacccccctgaagcaggagcacaccaagacctgcctgagccctggcagcagcgagatgagcctgcagcctgacctggtgcgctatgacaacacagagagcgagttcctgcctgagagcagctctgtgaagagctgcaagcacaaggagaagagcaagcaccagaaggacttccacctggagtttggagagaagagcaatgccaagatcaaggatgaggaccacagccccacctttgagaacagcgactgcaccctgaagaagatggacaaggagggcaagaccctgaagaagcacaagctgaagcacaaggagcgggagaaggagaagcacaagaaggagattgaaggagagaaggagaagtacaagaccaaggacagcgccaaggagctgcagaggtctgtggagtttgaccgggagttctggaaggagaacttcttcaagagtgatgaaacagaagatctcttcctgaacatggagcacgagagcctgaccctggagaagaagagcaagctggagaagaacatcaaggatgacaagagcaccaaggagaagcacgtgtccaaggagaggaacttcaaggaggagcgggacaagatcaagaaggagagcgagaagagcttccgggaggagaagatcaaggacctgaaggaggagcgggagaacatccccacagacaaggacagcgagttcaccagcctgggcatgtctgccatcgaggagagcatcggcctgcacctggtggagaaggagattgacatcgagaagcaggagaagcacatcaaggagagcaaggagaagccagagaagaggagccagatcaaggagaaggacatcgagaagatggagaggaagacctttgagaaggagaagaagatcaagcatgagcacaagtctgagaaggacaagctggacctgtctgaatgtgtggacaagatcaaggagaaggacaagctgtacagccaccacacagagaagtgccacaaggagggggagaagagcaagaacacagctgccatcaagaagacagatgaccgggagaagagccgggagaagatggacaggaagcatgacaaggagaagccagagaaggagcggcacctggccgagagcaaggagaagcacctgatggagaagaagaacaagcagagcgacaacagcgagtacagcaagtctgagaagggcaagaacaaggagaaggaccgggagctggacaagaaggagaagagccgggacaaggagagcatcaacatcaccaacagcaagcacatccaggaggagaagaagagcagcatcgtggatggcaacaaggcccagcacgagaagcccctgagcctgaaggagaagaccaaggatgagcccctgaagaccccagatggcaaggagaaggacaagaaggacaaggacatcgaccgctacaaggagcgggacaagcacaaggacaagatccagatcaacagcctgctgaagctgaagtctgaggccgacaagcccaagcccaagagcagccctgccagcaaggacacccggcccaaggagaagaggctggtgaatgatgacctgatgcagaccagctttgagaggatgctgagcctgaaggacctggagattgagcagtggcacaagaagcacaaggagaagatcaagcagaaggagaaggagcggctgaggaacagaaactgcctggagctgaagatcaaggacaaggagaagaccaagcacacccccacagagagcaagaacaaggagctgaccaggagcaagagcagcgaggtgacagatgcctacaccaaggagaagcagcccaaggatgctgtgagcaacagaagccagagcgtggacaccaagaatgtgatgaccctgggcaagagcagctttgtgtctgacaacagcctgaacagaagccccaggagtgaaaatgagaagccaggcctgagcagccgctctgtgtccatgatctctgtggccagcagcgaggacagctgccacaccaccgtgaccacccccaggcctcctgtggagtatgacagcgacttcatgctggagagcagcgagagccagatgtccttcagccagagccccttcctgagcatcgccaagagccctgccctgcacgagcgggagctggacagcctggccgacctgcctgagcgcatcaagccaccctatgccaaccggctgagcaccagccacctgcggagcagctctgtggaggatgtgaagctgatcatcagcgagggccggcccaccatcgaggtgcggcgctgcagcatgcccagcgtcatctgtgagcacaccaagcagttccagaccatcagcgaggagagcaaccagggcagcctgctgactgtgcctggggacaccagccccagccccaagccagaggtgttcagcaatgtgcctgagcgggacctgagcaatgtgagcaacatccacagcagctttgccaccagccccaccggggccagcaacagcaaatatgtgtctgctgacaggaacctgatcaagaacacagcccctgtgaacacagtgatggacagccctgtgcacctggagcccagcagccaggtgggcgtcatccagaacaagtcctgggagatgcctgtggaccggctggagaccctgagcacccgggacttcatctgccccaacagcaacatcccagaccaggagagcagcctgcagagcttctgcaacagcgagaacaaggtgctgaaggaaaatgctgacttcctgagcctgcggcagacagagctgcccggcaacagctgtgcccaggaccctgccagcttcatgccaccccagcagccctgcagcttccccagccagagcctgagtgatgctgagagcatcagcaagcacatgagcctgtcctatgtggccaaccaggagcccggcatcctgcagcagaagaatgctgtgcagatcatcagcagcgccctggacacagacaatgaaagcaccaaggacacagagaacacctttgtgctgggagatgtgcagaagacagatgcctttgtgcctgtgtacagcgacagcaccatccaggaggccagccccaactttgagaaggcctacaccctgcctgtgctgcccagcgagaaggacttcaacggcagtgatgccagcacccagctgaacacccactacgccttcagcaagctgacctacaagagcagcagcggccacgaggtggagaacagcaccacagacacccaggtgatcagccatgagaaggagaacaagctggagagcctggtgctgacccacctgagccgctgtgacagcgacctgtgtgagatgaatgccggcatgcccaagggcaacctgaatgagcaggaccccaagcactgcccagagagcgagaagtgcctgctgagcattgaagatgaggagagccagcagagcatcctgagcagcctggagaaccacagccagcagagcacccagcctgagatgcacaagtatggccagctggtgaaggtggagctggaggagaatgcagaagatgacaagacagagaaccagatcccccagaggatgaccaggaacaaggccaacaccatggccaaccagagcaagcagatcctggccagctgcaccctgctgtctgagaaggacagcgagagcagcagcccccggggccgcatccggctgacagaagatgatgacccccagatccaccaccccaggaagaggaaggtgtcccgggtgccccagcctgtgcaggtgagccccagcctgctgcaggccaaggagaagacccagcagagcctggccgccatcgtggacagcctgaagctggatgagatccagccctacagcagcgagcgggccaacccctactttgagtacctgcacatcaggaagaagattgaggagaagaggaagctgctgtgcagcgtcatcccccaggccccccagtactatgatgaatatgtgaccttcaacggcagctacctgctggatggcaaccccctgagcaagatctgcatccccaccatcaccccaccacccagcctgagtgaccccctgaaggagctgttccggcagcaggaggtggtgaggatgaagctgcggctgcagcacagcattgagcgggagaagctgattgtgtccaatgagcaggaggtgctgcgggtgcactacagagctgcccggaccctggccaaccagaccctgcccttcagcgcctgcaccgtgctgctggatgctgaggtgtacaacgtgcccctggacagccagagtgatgacagcaagacctctgtgcgggaccgcttcaatgcccggcagttcatgtcctggctgcaggatgtggatgacaagtttgacaagctgaagacctgcctgctgatgaggcagcagcacgaggccgccgccctgaatgctgtgcagaggctggagtggcagctgaagctgcaggagctggaccctgccacctacaagagcatcagcatctatgagatccaggagttctacgtgcccctggtggatgtgaatgatgactttgagctgacccccatctag

SEQ ID NO: 143683 - DNA, 1317 bp, Artificial Sequence
  Description of Artificial Sequence: Synthetic coding sequence
atggtgaatgtgcctgagctgctgctgggccagagccccagcagaaatgacaccaagatcatcaacagcgaggaggcccagagcgtgaaccccagctctgtggatgagaacatcgacagcgagacagagaaggacagcctcatctgtgagagcaagcagatcctgcccagcaagacccccctgcccagcgccctggatgaatatgagttcaaggatgatgatgatgaggagatcaacaagatgattgatgacagacacatcctgaggaaggagcagaggaaagaaaatgaacctgaggccgagaagacccacctgtttgccaagcaggagaaggccttctaccccaagagcttcaagagcaagaagcagaagcccagccgggtgctgtacagcagcacagagagcagtgatgaggaggccctgcagaacaagaagatcagcaccagctgcagcgtcatccctgagaccagcaacagcgacatgcagaccaagaaggagtatgtggtgtctggagagcacaagcagaagggcaaggtgaagaggaagctgaagaaccagaacaagaacaaggagaaccaggagctgaagcaggagaaggagggcaaggagaacacccgcatcaccaacctgactgtgaacacaggcctggactgcagcgagaagacccgggaggagggcaacttcaggaagagcttcagccccaaggatgacaccagcctgcacctgttccacatcagcacaggcaagagccccaagcacagctgtggcctgtctgagaagcagagcacccccctgaagcaggagcacaccaagacctgcctgagccctggcagcagcgagatgagcctgcagcctgacctggtgcgctatgacaacacagaaagtgagttcctgcctgagagcagctctgtgaagagctgcaagcacaaggagaagagcaagcaccagaaggacttccacctggagtttggagagaagagcaatgccaagatcaaggatgaggaccacagccccacctttgaaaattctgactgcaccctgaagaagatggacaaggagggcaagaccctgaagaagcacaagctgaagcacaaggagcgggagaaggagaagcacaagaaggagattgaaggagagaaggagaagtacaagaccaaggacagcgccaaggagctgcagaggtctgtggagtttgaccgggagttctggaaggagaacttcttcaagagtgatgaaacagaggacctcttcctgaacatggagcacgagagcctgaccctggagaagatcaagattggcaagaagcaccagaggtag

SEQ ID NO: 143684 - DNA, 6120 bp, Artificial Sequence
  Description of Artificial Sequence: Synthetic coding sequence
atgcccaagagcggcttcaccaagcccatccagagtgaaaattctgacagcgacagcaacatggtggagaagccctacggcaggaagagcaaggacaagatcgccagctacagcaagacccccaagattgaaagaagtgatgtgtccaaggagatgaaggagaagagctccatgaagaggaagctgcccttcaccatcagccccagcagaaatgaggagcgggacagcgacacagagaaggagggccctgagaagaagaagaccaagaaggaggccggcaacaagaagagcacccctgtgtccatcctgtttggctaccccctgtctgagaggaagcagatggccctgctgatgcagatgacagcccgggacaacagcccagacagcacccccaaccaccccagccagaccaccccagcccagaagaagacccccagcagcagcagccggcagaaggacaaggtgaacaagagaaatgaaagaggagagacccccctgcacatggccgccatcagaggagatgtgaagcaggtgaaggagctgatcagcctgggcgccaacgtgaatgtgaaggactttgctggctggacccccctgcacgaggcctgcaatgtgggctactatgatgtggccaagatcctgattgctgctggagcagatgtgaacacccagggcctggatgatgacacccccctgcatgattctgccagcagcggccaccgggacatcgtgaagctgctgctgcggcacggcggcaaccccttccaggccaacaagcacggggagaggcctgtggatgtggccgagacagaggagctggagctgctgctgaagcgggaggtgcccctgagtgatgatgatgagagctacacagattctgaggaggcccagagcgtgaaccccagctctgtggatgagaacatcgacagcgagacagagaaggacagcctcatctgtgagagcaagcagatcctgcccagcaagacccccctgcccagcgccctggatgaatatgagttcaaggatgatgatgatgaggagatcaacaagatgattgatgacagacacatcctgaggaaggagcagaggaaagaaaatgaacctgaggccgagaagacccacctgtttgccaagcaggagaaggccttctaccccaagagcttcaagagcaagaagcagaagcccagccgggtgctgtacagcagcacagagagcagtgatgaggaggccctgcagaacaagaagatcagcaccagctgcagcgtcatccctgagaccagcaacagcgacatgcagaccaagaaggagtatgtggtgtctggagagcacaagcagaagggcaaggtgaagaggaagctgaagaaccagaacaagaacaaggagaaccaggagctgaagcaggagaaggagggcaaggagaacacccgcatcaccaacctgactgtgaacacaggcctggactgcagcgagaagacccgggaggagggcaacttcaggaagagcttcagccccaaggatgacaccagcctgcacctgttccacatcagcacaggcaagagccccaagcacagctgtggcctgtctgagaagcagagcacccccctgaagcaggagcacaccaagacctgcctgagccctggcagcagcgagatgagcctgcagcctgacctggtgcgctatgacaacacagaaagtgagttcctgcctgagagcagctctgtgaagagctgcaagcacaaggagaagagcaagcaccagaaggacttccacctggagtttggagagaagagcaatgccaagatcaaggatgaggaccacagccccacctttgaaaattctgactgcaccctgaagaagatggacaaggagggcaagaccctgaagaagcacaagctgaagcacaaggagcgggagaaggagaagcacaagaaggagattgaaggagagaaggagaagtacaagaccaaggacagcgccaaggagctgcagaggtctgtggagtttgaccgggagttctggaaggagaacttcttcaagagtgatgaaacagaggacctcttcctgaacatggagcacgagagcctgaccctggagaagaagagcaagctggagaagaacatcaaggatgacaagagcaccaaggagaagcacgtgtccaaggagaggaacttcaaggaggagcgggacaagatcaagaaggagagcgagaagagcttccgggaggagaagatcaaggacctgaaggaggagcgggagaacatccccacagacaaggacagcgagttcaccagcctgggcatgtctgccatcgaggagagcatcggcctgcacctggtggagaaggagattgatattgagaagcaggagaagcacatcaaggagagcaaggagaagccagagaagaggagccagatcaaggagaaggacatcgagaagatggagaggaagacctttgagaaggagaagaagatcaagcatgagcacaagtctgagaaggacaagctggacctgtctgaatgtgtggacaagatcaaggagaaggacaagctgtacagccaccacacagagaagtgccacaaggagggggagaagagcaagaacacagctgccatcaagaagacagatgaccgggagaagagccgggagaagatggacaggaagcatgacaaggagaagccagagaaggagcggcacctggccgagagcaaggagaagcacctgatggagaagaagaacaagcagagcgacaacagcgagtacagcaagtctgagaagggcaagaacaaggagaaggaccgggagctggacaagaaggagaagagccgggacaaggagagcatcaacatcaccaacagcaagcacatccaggaggagaagaagagcagcatcgtggatggcaacaaggcccagcacgagaagcccctgagcctgaaggagaagaccaaggatgagcccctgaagaccccagatggcaaggagaaggacaagaaggacaaggacatcgaccgctacaaggagcgggacaagcacaaggacaagatccagatcaacagcctgctgaagctgaagtctgaggccgacaagcccaagcccaagagcagccctgccagcaaggacacccggcccaaggagaagaggctggtgaatgatgacctgatgcagaccagctttgagaggatgctgagcctgaaggacctggagattgagcagtggcacaagaagcacaaggagaagatcaagcagaaggagaaggagcggctgaggaacagaaactgcctggagctgaagatcaaggacaaggagaagaccaagcacacccccacagagagcaagaacaaggagctgaccaggagcaagagcagcgaggtgacagatgcctacaccaaggagaagcagcccaaggatgctgtgagcaacagaagccagagcgtggacaccaagaatgtgatgaccctgggcaagagcagctttgtgtctgacaacagcctgaacagaagccccaggagtgaaaatgagaagccaggcctgagcagccgctctgtgtccatgatctctgtggccagcagcgaggacagctgccacaccaccgtgaccaccccccggccccctgtggagtatgacagcgacttcatgctggagagcagcgagagccagatgtccttcagccagagccccttcctgagcatcgccaagagccctgccctgcacgagcgggagctggacagcctggccgacctgcctgagcgcatcaagccaccctatgccaaccggctgagcaccagccacctgcggagcagctctgtggaggatgtgaagctgatcatcagcgagggccggcccaccatcgaggtgcggcgctgcagcatgcccagcgtcatctgtgagcacaccaagcagttccagaccatcagcgaggagagcaaccagggcagcctgctgactgtgcctggggacaccagccccagccccaagccagaggtgttcagcaatgtgcctgagcgggacctgagcaatgtgagcaacatccacagcagctttgccaccagccccactggagccagcaacagcaaatatgtgtctgctgacaggaacctgatcaagaacacagcccctgtgaacacagtgatggacagccctgtgcacctggagcccagcagccaggtgggcgtcatccagaacaagtcctgggagatgcctgtggaccggctggagaccctgagcacccgggacttcatctgccccaacagcaacatcccagaccaggagagcagcctgcagagcttctgcaacagcgagaacaaggtgctgaaggaaaatgctgacttcctgagcctgcggcagacagagctgcccggcaacagctgtgcccaggaccctgccagcttcatgccaccccagcagccctgcagcttccccagccagagcctgagtgatgctgagagcatcagcaagcacatgagcctgtcctatgtggccaaccaggagcccggcatcctgcagcagaagaatgctgtgcagatcatcagcagcgccctggacacagacaatgaaagcaccaaggacacagagaacacctttgtgctgggagatgtgcagaagacagatgcctttgtgcctgtgtacagcgacagcaccatccaggaggccagccccaactttgagaaggcctacaccctgcctgtgctgcccagcgagaaggacttcaatggaagtgatgccagcacccagctgaacacccactacgccttcagcaagctgacctacaagagcagcagcggccacgaggtggagaacagcaccacagacacccaggtgatcagccatgagaaggagaacaagctggagagcctggtgctgacccacctgagccgctgtgacagcgacctgtgtgagatgaatgccggcatgcccaagggcaacctgaatgagcaggaccccaagcactgcccagagagcgagaagtgcctgctgagcattgaagatgaggagagccagcagagcatcctgagcagcctggagaaccacagccagcagagcacccagcctgagatgcacaagtatggccagctggtgaaggtggagctggaggagaatgcagaagatgacaagacagagaaccagatcccccagaggatgaccaggaacaaggccaacaccatggccaaccagagcaagcagatcctggccagctgcaccctgctgtctgagaaggacagcgagagcagcagcccccggggccgcatccggctgacagaagatgatgacccccagatccaccaccccaggaagaggaaggtgtcccgggtgccccagcctgtgcaggtgagccccagcctgctgcaggccaaggagaagacccagcagagcctggccgccatcgtggacagcctgaagctggatgagatccagccctacagcagcgagcgggccaacccctactttgagtacctgcacatcaggaagaagattgaggagaagaggaagctgctgtgcagcgtcatcccccaggccccccagtactatgatgaatatgtgaccttcaacggcagctacctgctggatggcaaccccctgagcaagatctgcatccccaccatcaccccaccacccagcctgagtgaccccctgaaggagctgttccggcagcaggaggtggtgaggatgaagctgcggctgcagcacagcattgaaagagagaagctgattgtgtccaatgagcaggaggtgctgcgggtgcactaccgggccgcccggaccctggccaaccagaccctgcccttcagcgcctgcaccgtgctgctggatgctgaggtgtacaacgtgcccctggacagccagagtgatgacagcaagacctctgtgcgggaccgcttcaatgcccggcagttcatgtcctggctgcaggatgtggatgacaagtttgacaagctgaagacctgcctgctgatgaggcagcagcatgaagctgctgccctgaatgctgtgcagaggctggagtggcagctgaagctgcaggagctggaccctgccacctacaagagcatcagcatctatgagatccaggagttctacgtgcccctggtggatgtgaatgatgactttgagctgacccccatctag

SEQ ID NO: 143685 - DNA, 372 bp, Artificial Sequence
  Description of Artificial Sequence: Synthetic coding sequence
acagaggacctcttcctgaacatggagcacgagagcctgaccctggagaagaagagcaagctggagaagaacatcaaggatgacaagagcaccaaggagaagcacgtgtccaaggagaggaacttcaaggaggagcgggacaagatcaagaaggagagcgagaagagcttccgggagggcatgtctgccatcgaggagagcatcggcctgcacctggtggagaaggagattgatattgagaagcaggagaagcacatcaaggagagcaaggagaagccagagaagaggagccagatcaaggagaaggacatcgagaagatggagaggaagacctttgagaagggcaccagctacatccgcatcacccagtag

SEQ ID NO: 143686 - DNA, 993 bp, Artificial Sequence
  Description of Artificial Sequence: Synthetic coding sequence
atgcccaagagcggcttcaccaagcccatccagagtgaaaattctgacagcgacagcaacatggtggagaagccctacggcaggaagagcaaggacaagatcgccagctacagcaagacccccaagattgaaagaagtgatgtgtccaaggagatgaaggagaagagctccatgaagaggaagctgcccttcaccatcagccccagcagaaatgaggagcgggacagcgacacagacagcgaccccggccacaccagcgagaactggggcgagcggctcatcagcagctaccgcacctacagcgagaaggagggccctgagaagaagaagaccaagaaggaggccggcaacaagaagagcacccctgtgtccatcctgtttggctaccccctgtctgagaggaagcagatggccctgctgatgcagatgacagcccgggacaacagcccagacagcacccccaaccaccccagccagaccaccccagcccagaagaagacccccagcagcagcagccggcagaaggacaaggtgaacaagagaaatgaaagaggagagacccccctgcacatggccgccatcagaggagatgtgaagcaggtgaaggagctgatcagcctgggcgccaacgtgaatgtgaaggactttgctggctggacccccctgcacgaggcctgcaatgtgggctactatgatgtggccaagatcctgattgctgctggagcagatgtgaacacccagggcctggatgatgacacccccctgcatgacagcgccagcagcggccaccgggacatcgtgaagctgctgctgcggcatggaggcaaccccttccaggccaacaagcatggagagaggcctgtggatgtggccgagacagaggagctggagctgctgctgaagcgggaggtgcccctgagtgatgatgatgagagctacacaggcagcagctaccagtttgctggaaatgccaagctgagcggggccagctag

SEQ ID NO: 143687 - DNA, 1116 bp, Artificial Sequence
  Description of Artificial Sequence: Synthetic coding sequence
atgcccaagagcggcttcaccaagcccatccagagtgaaaattctgacagcgacagcaacatggtggagaagccctacggcaggaagagcaaggacaagatcgccagctacagcaagacccccaagattgaaagaagtgatgtgtccaaggagatgaaggagaagagctccatgaagaggaagctgcccttcaccatcagccccagcagaaatgaggagcgggacagcgacacagagaaggagggccctgagaagaagaagaccaagaaggaggccggcaacaagaagagcacccctgtgtccatcctgtttggctaccccctgtctgagaggaagcagatggccctgctgatgcagatgacagcccgggacaacagcccagacagcacccccaaccaccccagccagaccaccccagcccagaagaagacccccagcagcagcagccggcagaaggacaaggtgaacaagagaaatgaaagaggagagacccccctgcacatggccgccatcagaggagatgtgaagcaggtgaaggagctgatcagcctgggcgccaacgtgaatgtgaaggactttgctggctggacccccctgcacgaggcctgcaatgtgggctactatgatgtggccaagatcctgattgctgctggagcagatgtgaacacccagggcctggatgatgacacccccctgcatgattctgccagcagcggccaccgggacatcgtgaagctgctgctgcggcacggcggcaaccccttccaggccaacaagcacggggagaggcctgtggatgtggccgagacagaggagctggagctgctgctgaagcgggaggtgcccctgagtgatgatgatgagagctacacagattctgaggaggcccagagcgtgaaccccagctctgtggatgagaacatcgacagcgagacagagaaggacagcctcatctgtgagagcaagcagatcctgcccagcaagacccccctgcccagcgccctggatgaatatgagttcaaggatgatgatgatgaggagatcaacaagatgattgatgacagacacatcctgaggaaggagcagaggaagaagaagaggaaggagaagaagtag

SEQ ID NO: 143688 - DNA, 984 bp, Artificial Sequence
  Description of Artificial Sequence: Synthetic coding sequence
atggccaaggcccccagctgggccggcgtgggcgccctggcctacaaggcccctgaggccctgtggccagctgaggccgtgatggatggcaccatggaggacagcgaggccgtgcagagggccacagccctgattgagcagaggctggcccaggaggaggagaatgagaagctgcggggagatgcccggcagaagctgcccatggacctgctggtgctggaggatgagaagcaccacggggcccagagcgctgccctgcagaaggtgaagggccaggagcgggtgaggaagaccagcctggacctgcggcgggagatcattgatgtgggcggcatccagaacctgattgagctgaggaagaagaggaagcagaagaagagagatgccctggccgccagccatgagcccccacctgagcctgaggagatcaccggccctgtggatgaggagaccttcctgaaggctgctgtggagggcaagatgaaggtgattgagaagttcctggctgatggcggcagcgctgacacctgtgaccagttcagaagaacagccctgcaccgggccagcctggagggccacatggagatcctggagaagctgctggacaatggagccaccgtggacttccaggaccggctggactgcacagccatgcactgggcctgccggggcggccacctggaggtggtgaagctgctgcagagccacggggctgacaccaacgtgcgggacaaggagggggacacagccctgcatgatgctgtgcggctgaaccgctacaagatcatcaagctgctgctgctgcatggagctgacatgatgaccaagaacctggccggcaagacccccacagacctggtgcagctgtggcaggccgacaccaggcatgccctggagcaccctgagcctggagctgagcacaacggcctggagggccccaatgacagcggccgggagaccccccagcctgtgcctgcccagtag

SEQ ID NO: 143689 - DNA, 1083 bp, Artificial Sequence
  Description of Artificial Sequence: Synthetic coding sequence
atggccaaggcccccagctgggccggcgtgggcgccctggcctacaaggcccctgaggccctgtggccagctgaggccgtgatggatggcaccatggaggacagcgaggccgtgcagagggccacagccctgattgagcagaggctggcccaggaggaggagaatgagaagctgcggggagatgcccggcagaagctgcccatggacctgctggtgctggaggatgagaagcaccacggggcccagagcgctgccctgcagaaggtgaagggccaggagcgggtgaggaagaccagcctggacctgcggcgggagatcattgatgtgggcggcatccagaacctgattgagctgaggaagaagaggaagcagaagaagagagatgccctggccgccagccatgagcccccacctgagcctgaggagatcaccggccctgtggatgaggagaccttcctgaaggctgctgtggagggcaagatgaaggtgattgagaagttcctggctgatggcggcagcgctgacacctgtgaccagttcagaagaacagccctgcaccgggccagcctggagggccacatggagatcctggagaagctgctggacaatggagccaccgtggacttccaggaccggctggactgcacagccatgcactgggcctgccggggcggccacctggaggtggtgaagctgctgcagagccacggggctgacaccaacgtgcgggacaagctgctgagcacccccctgcacgtggccgtgaggacaggccaggtggagatcgtggagcacttcctgagcctgggcctggagatcaatgcccgggaccgggagggggacacagccctgcatgatgctgtgcggctgaaccgctacaagatcatcaagctgctgctgctgcacggggctgacatgatgaccaagaacctggccggcaagacccccacagacctggtgcagctgtggcaggccgacaccaggcatgccctggagcaccctgagcccggggctgagcacaacggcctggagggccccaatgattctggccgggagaccccccagcctgtgcctgcccagtag

SEQ ID NO: 143690 - DNA, 1002 bp, Artificial Sequence
  Description of Artificial Sequence: Synthetic coding sequence
atggatggcaccatggaggacagcgaggccgtgcagagggccacagccctgattgagcagaggctggcccaggaggaggagaatgagaagctgcggggagatgcccggcagaagctgcccatggacctgctggtgctggaggatgagaagcaccacggggcccagagcgctgccctgcagaaggtgaagggccaggagcgggtgaggaagaccagcctggacctgcggcgggagatcattgatgtgggcggcatccagaacctgattgagctgaggaagaagaggaagcagaagaagagagatgccctggccgccagccatgagcccccacctgagcctgaggagatcactggacctgtggatgaggagaccttcctgaaggctgctgtggagggcaagatgaaggtgattgagaagttcctggctgatggcggcagcgctgacacctgtgaccagttccggaggacagccctgcaccgggccagcctggagggccacatggagatcctggagaagctgctggacaacggggccaccgtggacttccaggaccggctggactgcacagccatgcactgggcctgccggggcggccacctggaggtggtgaagctgctgcagagccatggagctgacaccaacgtgcgggacaagctgctgagcacccccctgcacgtggccgtgaggacaggccaggtggagatcgtggagcacttcctgagcctgggcctggagatcaatgcccgggaccgggagggggacacagccctgcatgatgctgtgcggctgaaccgctacaagatcatcaagctgctgctgctgcatggagctgacatgatgaccaagaacctggccggcaagacccccacagacctggtgcagctgtggcaggccgacaccaggcatgccctggagcaccctgagcctggagctgagcacaacggcctggagggccccaatgacagcggccgggagaccccccagcctgtgcctgcccagtag

SEQ ID NO: 143691 - DNA, 903 bp, Artificial Sequence
  Description of Artificial Sequence: Synthetic coding sequence
atggatggcaccatggaggacagcgaggccgtgcagagggccacagccctgattgagcagaggctggcccaggaggaggagaatgagaagctgcggggagatgcccggcagaagctgcccatggacctgctggtgctggaggatgagaagcaccacggggcccagagcgctgccctgcagaaggtgaagggccaggagcgggtgaggaagaccagcctggacctgcggcgggagatcattgatgtgggcggcatccagaacctgattgagctgaggaagaagaggaagcagaagaagagagatgccctggccgccagccatgagcccccacctgagcctgaggagatcactggacctgtggatgaggagaccttcctgaaggctgctgtggagggcaagatgaaggtgattgagaagttcctggctgatggcggcagcgctgacacctgtgaccagttccggaggacagccctgcaccgggccagcctggagggccacatggagatcctggagaagctgctggacaacggggccaccgtggacttccaggaccggctggactgcacagccatgcactgggcctgccggggcggccacctggaggtggtgaagctgctgcagagccatggagctgacaccaacgtgcgggacaaggagggggacacagccctgcatgatgctgtgcggctgaaccgctacaagatcatcaagctgctgctgctgcacggggctgacatgatgaccaagaacctggccggcaagacccccacagacctggtgcagctgtggcaggccgacaccaggcatgccctggagcaccctgagcccggggctgagcacaacggcctggagggccccaatgattctggccgggagaccccccagcctgtgcctgcccagtag

SEQ ID NO: 143692 - DNA, 918 bp, Artificial Sequence
  Description of Artificial Sequence: Synthetic coding sequence
atggacttcatcagcatccagcagctggtgtctggagagcgggtggagggcaaggtgctgggcttcggccacggcgtgcctgaccccggggcctggcccagcgactggaggcggggcccccaggaggccgtggcccgggagaagctgaagctggaggaggagaagaagaagaagctggagcgcttcaacagcacccgcttcaacctggacaacctggccgacctggagaacctggtgcagaggaggaagaagaggctgcggcaccgggtgccccccaggaagccagagcccctggtgaagccccagagccaggcccaggtggagcctgtgggcctggagatgttcctgaaggctgctgctgagaaccaggagtacctgattgacaagtacctgacagatggaggagaccccaatgcccatgacaagctgcacaggacagccctgcactgggcctgcctgaagggccacagccagctggtgaacaagctgctggtggccggggccaccgtggatgcccgggacctgctggacaggacccctgtgttctgggcctgccggggcggccacctggtgatcctgaagcagctgctgaaccagggcgcccgggtgaatgcccgggacaagattggcagcacccccctgcacgtggccgtgaggaccaggcacccagactgcctggagcacctgattgaatgtggggcccacctgaatgcccaggacaaggagggggacacagccctgcacgaggccgtgagacatggcagctacaaggccatgaagctgctgctgctgtatggagctgagctgggcgtgagaaatgctgcctctgtgacccctgtgcagctggcccgggactggcagaggggcatccgggaggccctgcaggcccacgtggcccaccccaggacccgctgctag

SEQ ID NO: 143693 - DNA, 792 bp, Artificial Sequence
  Description of Artificial Sequence: Synthetic coding sequence
atggacttcatcagcatccagcagctggtgtctggagagcgggtggagggcaaggtgctgggcttcggccacggcgtgcctgaccccggggcctggcccagcgactggaggcggggcccccaggaggccgtggcccgggagaagctgaagctggaggaggagaagaagaagaagctggagcgcttcaacagcacccgcttcaacctggacaacctggccgacctggagaacctggtgcagaggaggaagaagaggctgcggcaccgggtgccccccaggaagccagagcccctggtgaagctgcacaggacagccctgcactgggcctgcctgaagggccacagccagctggtgaacaagctgctggtggccggggccaccgtggatgcccgggacctgctggacaggacccctgtgttctgggcctgccggggcggccacctggtgatcctgaagcagctgctgaaccagggcgcccgggtgaatgcccgggacaagattggcagcacccccctgcacgtggccgtgaggaccaggcacccagactgcctggagcacctgattgaatgtggggcccacctgaatgcccaggacaaggagggggacacagccctgcacgaggccgtgagacatggcagctacaaggccatgaagctgctgctgctgtatggagctgagctgggcgtgagaaatgctgcctctgtgacccctgtgcagctggcccgggactggcagaggggcatccgggaggccctgcaggcccacgtggcccaccccaggacccgctgctag

SEQ ID NO: 143694 - DNA, 918 bp, Artificial Sequence; identical to SEQ ID NO: 143692
  Description of Artificial Sequence: Synthetic coding sequence

SEQ ID NO: 143695 - DNA, 3804 bp, Artificial Sequence
  Description of Artificial Sequence: Synthetic coding sequence
atgaaccacatgttccacatcaagaggcacagcatctctgctggaacagatgcctacaagaagaccaagcccatccagaacctcttccagaagcccctgtatgaccactgcagcgccaacaactacaagtccatggagcctgagctggagaatgtgcgcagcagcccccccaggggggacaggaccagcaaggtgtccctgaaggaggagctgcagcaggacatgcagcgcttcaagaatgagatcggcatgctgaaggtggagttccaggccctggagaaggagaaggtgcagctgcagaaggaggtggaggaggagaggaagaagcacagaaataatgagatggaggtgtctgccaacatccatgatggagccacagatgatgctgaagatgatgatgatgatgatggcctcatccagaagaggaagagcggggagacagaccaccagcagttccccaggaaggagaacaaggagtatgccagcagcggccctgccctgcagatgaaggaggtgaagagcacagagaaggagaagaggaccagcaaggagagcgtgaacagccctgtgtttgggaaggccagcctgctgaccggcggcctgctgcaggtggatgatgacagcagcctgtctgaaattgatgaagatgagggccggcccaccaagaagaccagcaatgagaagaacaaggtgaagaaccagatccagagcatggatgatgtggatgacctgacccagagcagcgagacagccagcgaggactgtgagctgccccacagcagctacaagaacttcatgctgctgattgagcagctgggcatggagtgcaaggacagcgtgtccctgctgaagatccaggatgctgccctgagctgtgagcggctgctggagctgaagaagaaccactgtgagctgctgactgtgaagatcaagaagatggaggacaaggtgaatgtgctgcagcgggagctgtctgagaccaaggagatcaagagccagctggagcaccagaaggtggagtgggagcgggagctgtgcagcctgcgcttcagcctgaaccaggaggaggagaagagaagaaatgctgacaccctgtatgagaagatccgggagcagctgcggaggaaggaggagcagtacaggaaggaggtggaggtgaagcagcagctggagctgagcctgcagaccctggagatggagctgaggacagtgaagagcaacctgaaccaggtggtgcaggagagaaatgatgcccagaggcagctgagccgggagcagaatgccaggatgctgcaggacggcatcctgaccaaccacctgagcaagcagaaggagattgagatggcccagaagaagatgaacagcgagaacagccacagccatgaggaggagaaggacctgagccacaagaacagcatgctgcaggaggagatcgccatgctgcggctggagattgacaccatcaagaaccagaaccaggagaaggagaagaagtgctttgaggacctgaagatcgtgaaggagaagaatgaagacctgcagaagaccatcaagcagaatgaggagaccctgacccagaccatcagccagtacaacggccgcctgtctgtgctgacagcagaaaatgccatgctgaacagcaagctggagaatgagaagcagagcaaggagcggctggaggccgaggtggagagctaccacagccggctggccgccgccatccatgaccgggaccagagcgagaccagcaagcgggagctggagctggccttccagagggccagagatgaatgttcccggctgcaggacaagatgaactttgatgtgagcaacctgaaggacaacaatgagatcctgagccagcagctgttcaagacagagagcaagctgaacagcctggagattgagttccaccacaccagagatgccctgcgggagaagaccctgggcctggagcgggtgcagaaggacctgagccagacccagtgccagatgaaggagatggagcagaagtaccagaatgagcaggtgaaggtgaacaagtacatcggcaagcaggagagcgtggaggagcggctgagccagctgcagagcgagaacatgctgctgcggcagcagctggatgatgcccacaacaaggctgacaacaaggagaagacagtcatcaacatccaggaccagttccacgccatcgtgcagaagctgcaggccgagagcgagaagcagagcctgctgctggaggagaggaacaaggagctgatcagcgagtgcaaccacctgaaggagcggcagtaccagtatgaaaatgagaaggccgagcgggaggtggtggtgcggcagctgcagcaggagctggccgacaccctgaagaagcagagcatgtctgaggccagcctggaggtgaccagccgctaccgcatcaacctggaggatgagacccaggacctgaagaagaagctgggccagatccggaaccagctgcaggaggcccaggacagacacacagaagctgtgcgctgtgccgagaagatgcaggaccacaagcagaagctggagaaggacaatgccaagctgaaggtgacagtgaagaagcagatggacaagattgaggagctgcagaagaacctgctgaatgccaacctgtctgaagatgagaaggagcagctgaagaagctgatggagctgaagcagagcctggagtgcaacctggaccaggagatgaagaagaatgtggagctggagcgggagatcaccggcttcaagaacctgctgaagatgaccaggaagaagctgaatgaatatgaaaatggagagttctccttccacggggacctgaagaccagccagtttgagatggacatccagatcaacaagctgaagcacaagattgatgacctgacagctgagctggagacagctggcagcaagtgcctgcacctggacaccaagaaccagatcctgcaggaggagctgctgtccatgaagacagtgcagaagaagtgtgagaagctgcagaagaacaagaagaagctggagcaggaggtgatcaacctgcggagccacatcgagaggaacatggtggagctgggccaggtgaagcagtacaagcaggagattgaggagcgggcccggcaggagattgctgagaagctgaaggaggtgaacctcttcctgcaggcccaggccgccagccaggagaacctggagcagttccgggagaacaactttgcctccatgaagagccagatggagctgcgcatcaaggacctggagagcgagctgagcaagatcaagaccagccaggaggacttcaacaagacagagctggagaagtacaagcagctgtacctggaggagctgaaggtgaggaagagcctgagcagcaagctgaccaagaccaatgaaaggctggccgaggtgaacaccaagctgctggtggagaagcagcagagccgcagcctcttcaccaccctgaccaccaggcctgtgatggagcccccctgtgtgggcaacctgaacaacagcctggacctgaacaggaagctgatcccccgggagaacctggtgatcagcaccagcaacccccgggccagcaacaacagcatggagaactacctgagcaagatgcagcaggagctggagaagaacatcacccgggagctgaaggaggccgctgctgagctggagagcggcagcatcgccagccccctgggcagcacagatgagagcaacctgaaccaggacctggtgtggaaggccagccgggagtatgtgcaggtgctgaagaagaactacatgatctag

SEQ ID NO: 143696 - DNA, 5133 bp, Artificial Sequence
  Description of Artificial Sequence: Synthetic coding sequence
atgaagaagatcttcagcaagaagggggagagccccctgggcagctttgcccggcggcagaggagcagcgctgggggcggcggggagcccggggagggcgcctacagccagcccggctaccacgtgcgggaccgggacctgggcaagatccacaaggccgccagcgctggaaatgtggccaaggtgcagcagatcctgctgctgaggaagaatggcctgaatgaccgggacaagatgaacagaacagccctgcacctggcctgtgccaacggccaccctgaggtggtgaccctgctggtggacaggaagtgccagctgaatgtgtgtgacaatgaaaatagaacagccctgatgaaggctgtgcagtgccaggaggagaagtgtgccaccatcctgctggagcacggggctgaccccaacctggctgatgtgcacggcaacacagccctgcactatgctgtgtacaatgaagacatctctgtggccaccaagctgctgctgtatgatgccaacatcgaggccaagaacaaggatgacctgacccccctgctgctggccgtgtctgggaagaagcagcagatggtggagttcctgatcaagaagaaggccaacgtgaatgctgtggacaagctggagagcagccaccagctgatcagcgagtacaaggaggagcgcatccccaagcacagcagccagaacagcaacagcgtggatgagagcagcgaggacagcctgagccggctgagcggcaagccaggagtggatgacagctggcccaccagtgatgatgaggacctgaactttgacaccaagaatgtgcccaagcccagcctggccaagctgatgacagccagccagcagagcaggaagaacctggaggccacctacggcaccgtgaggactggaaacagaaccctgtttgaggaccgggacagcgacagccaggatgaggtggtggtggagagcctgcccaccaccagcatcaaggtgcagtgcttcagccaccccacctaccagagcccagacctgctgcccaagcccagccacaagagcctggccaaccctggcctgatgaaggaggagcccaccaagccaggcatcgccaagaaggaaaatggcatcgacatcattgaaagtgcccccctggagcagaccaacaatgacaacctgacctacgtggatgaggtgcacaagaacaacagaagtgacatgatgtctgccctgggcctgggccaggaggaggacatcgagagcccctgggacagcgagagcatcagcgagaacttcccccagaagtatgtggaccccctggccggggctgctgatggcaaggagaagaacattggaaatgagcaggccgaggatgtgttctacatccccagctgcatgagcggcagcaggaacttcaagatggccaagctggaggacaccagaaatgtgggcatgcctgtggcccacatggagagccctgagcgctacctgcacctgaagcccaccatcgagatgaaggacagcgtgcccaacaaggccggcggcatgaaggatgtgcagaccagcaaggctgctgagcatgacctggaggtggccagcgaggaggagcaggagcgggagggcagcgagaacaaccagccccaggtggaggaggagaggaagaagcacaggaacaatgagatggaggtgtctgccaacatccatgatggagccacagatgatgctgaagatgatgatgatgatgatggcctcatccagaagaggaagtctggagaaacagaccaccagcagttccccaggaaagaaaacaaggagtatgccagcagcggccctgccctgcagatgaaggaggtgaagagcacagagaaggagaagaggaccagcaaggagagcgtgaacagccctgtgtttgggaaggccagcctgctgactggaggcctgctgcaggtggatgatgacagcagcctgtctgaaattgatgaagatgagggccggcccaccaagaagaccagcaatgagaagaacaaggtgaagaaccagatccagagcatggatgatgtggatgacctgacccagagcagcgagacagccagcgaggactgtgagctgccccacagcagctacaagaacttcatgctgctgattgagcagctgggcatggagtgcaaggacagcgtgtccctgctgaagatccaggatgctgccctgagctgtgagcggctgctggagctgaagaagaaccactgtgagctgctgactgtgaagatcaagaagatggaggacaaggtgaatgtgctgcagcgggagctgtctgagaccaaggagatcaagagccagctggagcaccagaaggtggagtgggagcgggagctgtgcagcctgcgcttcagcctgaaccaggaggaggagaagagaagaaatgctgacaccctgtatgagaagatccgggagcagctgcggaggaaggaggagcagtacaggaaggaggtggaggtgaagcagcagctggagctgagcctgcagaccctggagatggagctgaggacagtgaagagcaacctgaaccaggtggtgcaggagagaaatgatgcccagaggcagctgagccgggagcagaatgccaggatgctgcaggacggcatcctgaccaaccacctgagcaagcagaaggagattgagatggcccagaagaagatgaacagcgagaacagccacagccatgaggaggagaaggacctgagccacaagaacagcatgctgcaggaggagatcgccatgctgcggctggagattgacaccatcaagaaccagaaccaggagaaggagaagaagtgctttgaggacctgaagatcgtgaaggagaagaatgaagacctgcagaagaccatcaagcagaatgaggagaccctgacccagaccatcagccagtacaacggccgcctgtctgtgctgacagcagaaaatgccatgctgaacagcaagctggagaatgagaagcagagcaaggagcggctggaggccgaggtggagagctaccacagccggctggccgccgccatccatgaccgggaccagagcgagaccagcaagcgggagctggagctggccttccagagggccagagatgagtgcagccggctgcaggacaagatgaactttgatgtgagcaacctgaaggacaacaatgagatcctgagccagcagctgttcaagacagagagcaagctgaacagcctggagattgagttccaccacaccagagatgccctgcgggagaagaccctgggcctggagcgggtgcagaaggacctgagccagacccagtgccagatgaaggagatggagcagaagtaccagaatgagcaggtgaaggtgaacaagtacatcggcaagcaggagagcgtggaggagcggctgagccagctgcagagcgagaacatgctgctgcggcagcagctggatgatgcccacaacaaggctgacaacaaggagaagacagtcatcaacatccaggaccagttccacgccatcgtgcagaagctgcaggccgagagcgagaagcagagcctgctgctggaggagaggaacaaggagctgatcagcgagtgcaaccacctgaaggagcggcagtaccagtatgaaaatgagaaggccgagcgggaggtggtggtgcggcagctgcagcaggagctggccgacaccctgaagaagcagagcatgtctgaggccagcctggaggtgaccagccgctaccgcatcaacctggaggatgagacccaggacctgaagaagaagctgggccagatccggaaccagctgcaggaggcccaggacagacacacagaggccgtgcgctgtgccgagaagatgcaggaccacaagcagaagctggagaaggacaatgccaagctgaaggtgacagtgaagaagcagatggacaagattgaggagctgcagaagaacctgctgaatgccaacctgtctgaagatgagaaggagcagctgaagaagctgatggagctgaagcagagcctggagtgcaacctggaccaggagatgaagaagaatgtggagctggagcgggagatcaccggcttcaagaacctgctgaagatgaccaggaagaagctgaatgaatatgaaaatggagagttctccttccatggagacctgaagaccagccagtttgagatggacatccagatcaacaagctgaagcacaagattgatgacctgacagctgagctggagacagctggcagcaagtgcctgcacctggacaccaagaaccagatcctgcaggaggagctgctgtccatgaagacagtgcagaagaagtgtgagaagctgcagaagaacaagaagaagctggagcaggaggtgatcaacctgcggagccacattgaaagaaacatggtggagctgggccaggtgaagcagtacaagcaggagattgaggagcgggcccggcaggagattgctgagaagctgaaggaggtgaacctcttcctgcaggcccaggccgccagccaggagaacctggagcagttccgggagaacaactttgcctccatgaagagccagatggagctgcgcatcaaggacctggagagcgagctgagcaagatcaagaccagccaggaggacttcaacaagacagagctggagaagtacaagcagctgtacctggaggagctgaaggtgaggaagagcctgagcagcaagctgaccaagaccaatgaaaggctggccgaggtgaacaccaagctgctggtggagaagcagcagagccgcagcctcttcaccaccctgaccaccaggcctgtgatggagcccccctgtgtgggcaacctgaacaacagcctggacctgaacaggaagctgatcccccgggagaacctggtgatcagcaccagcaacccccgggccagcaacaacagcatggagaactacctgagcaagatgcagcaggagctggagaagaacatcacccgggagctgaaggaggccgctgctgagctggagagcggcagcatcgccagccccctgggcagcacagatgagagcaacctgaaccaggacctggtgtggaaggccagccgggagtatgtgcaggtgctgaagaagaactacatgatctag

SEQ ID NO: 143697 - DNA, 5181 bp, Artificial Sequence
  Description of Artificial Sequence: Synthetic coding sequence
atgaagaagatcttcagcaagaagggggagagccccctgggcagctttgcccggcggcagaggagcagcgctgggggcggcggggagcccggggagggcgcctacagccagcccggctaccacgtgcgggaccgggacctgggcaagatccacaaggccgccagcgctggaaatgtggccaaggtgcagcagatcctgctgctgaggaagaatggcctgaatgaccgggacaagatgaacagaacagccctgcacctggcctgtgccaacggccaccctgaggtggtgaccctgctggtggacaggaagtgccagctgaatgtgtgtgacaatgaaaatagaacagccctgatgaaggctgtgcagtgccaggaggagaagtgtgccaccatcctgctggagcacggggctgaccccaacctggctgatgtgcacggcaacacagccctgcactatgctgtgtacaatgaagacatctctgtggccaccaagctgctgctgtatgatgccaacatcgaggccaagaacaaggatgacctgacccccctgctgctggccgtgtctgggaagaagcagcagatggtggagttcctgatcaagaagaaggccaacgtgaatgctgtggacaagctggagagcagccaccagctgatcagcgagtacaaggaggagcgcatccccaagcacagcagccagaacagcaacagcgtggatgagagcagcgaggacagcctgagcagcctcttctacttcatcttctttgagaccaagagctgcaccgtggcccaggccggcgtgctgcagcacgacctgagcagcctgcagagcctgctgcccggcttcacccagttcttctgcctgcacctgcccagctcctgggaccaccggctgagcggcaagccaggagtggatgacagctggcccaccagtgatgatgaggacctgaactttgacaccaagaatgtgcccaagcccagcctggccaagctgatgacagccagccagcagagcaggaagaacctggaggccacctatggaacagtgaggacaggcaacagaaccctgtttgaagatcgggacagcgacagccaggatgaggtggtggtggagagcctgcccaccaccagcatcaaggtgcagtgcttcagccaccccacctaccagagcccagacctgctgcccaagcccagccacaagagcctggccaaccctggcctgatgaaggaggagcccaccaagccaggcatcgccaagaaggaaaatggaattgacatcatcgagagcgcccccctggagcagaccaacaatgacaacctgacctacgtggatgaggtgcacaagaacaacagaagtgacatgatgtctgccctgggcctgggccaggaggaggacatcgagagcccctgggacagcgagagcatcagcgagaacttcccccagaagtatgtggaccccctggccggggctgctgatggcaaggagaagaacattggaaatgagcaggccgaggagagccctgagcgctacctgcacctgaagcccaccatcgagatgaaggacagcgtgcccaacaaggccggcggcatgaaggatgtgcagaccagcaaggctgctgagcatgacctggaggtggccagcgaggaggagcaggagcgggagggcagcgagaacaaccagccccaggtggaggaggagaggaagaagcacaggaacaatgagatggaggtgtctgccaacatccatgatggagccacagatgatgctgaagatgatgatgatgatgatggcctcatccagaagaggaagtctggagaaacagaccaccagcagttccccaggaaagaaaacaaggagtatgccagcagcggccctgccctgcagatgaaggaggtgaagagcacagagaaggagaagaggaccagcaaggagagcgtgaacagccctgtgtttgggaaggccagcctgctgactggaggcctgctgcaggtggatgatgacagcagcctgtctgaaattgatgaagatgagggccggcccaccaagaagaccagcaatgagaagaacaaggtgaagaaccagatccagagcatggatgatgtggatgacctgacccagagcagcgagacagccagcgaggactgtgagctgccccacagcagctacaagaacttcatgctgctgattgagcagctgggcatggagtgcaaggacagcgtgtccctgctgaagatccaggatgctgccctgagctgtgagcggctgctggagctgaagaagaaccactgtgagctgctgactgtgaagatcaagaagatggaggacaaggtgaatgtgctgcagcgggagctgtctgagaccaaggagatcaagagccagctggagcaccagaaggtggagtgggagcgggagctgtgcagcctgcgcttcagcctgaaccaggaggaggagaagagaagaaatgctgacaccctgtatgagaagatccgggagcagctgcggaggaaggaggagcagtacaggaaggaggtggaggtgaagcagcagctggagctgagcctgcagaccctggagatggagctgaggacagtgaagagcaacctgaaccaggtggtgcaggagagaaatgatgcccagaggcagctgagccgggagcagaatgccaggatgctgcaggacggcatcctgaccaaccacctgagcaagcagaaggagattgagatggcccagaagaagatgaacagcgagaacagccacagccatgaggaggagaaggacctgagccacaagaacagcatgctgcaggaggagatcgccatgctgcggctggagattgacaccatcaagaaccagaaccaggagaaggagaagaagtgctttgaggacctgaagatcgtgaaggagaagaatgaagacctgcagaagaccatcaagcagaatgaggagaccctgacccagaccatcagccagtacaacggccgcctgtctgtgctgacagcagaaaatgccatgctgaacagcaagctggagaatgagaagcagagcaaggagcggctggaggccgaggtggagagctaccacagccggctggccgccgccatccatgaccgggaccagagcgagaccagcaagcgggagctggagctggccttccagagggccagagatgagtgcagccggctgcaggacaagatgaactttgatgtgagcaacctgaaggacaacaatgagatcctgagccagcagctgttcaagacagagagcaagctgaacagcctggagattgagttccaccacaccagagatgccctgcgggagaagaccctgggcctggagcgggtgcagaaggacctgagccagacccagtgccagatgaaggagatggagcagaagtaccagaatgagcaggtgaaggtgaacaagtacatcggcaagcaggagagcgtggaggagcggctgagccagctgcagagcgagaacatgctgctgcggcagcagctggatgatgcccacaacaaggctgacaacaaggagaagacagtcatcaacatccaggaccagttccacgccatcgtgcagaagctgcaggccgagagcgagaagcagagcctgctgctggaggagaggaacaaggagctgatcagcgagtgcaaccacctgaaggagcggcagtaccagtatgaaaatgagaaggccgagcgggaggtggtggtgcggcagctgcagcaggagctggccgacaccctgaagaagcagagcatgtctgaggccagcctggaggtgaccagccgctaccgcatcaacctggaggatgagacccaggacctgaagaagaagctgggccagatccggaaccagctgcaggaggcccaggacagacacacagaggccgtgcgctgtgccgagaagatgcaggaccacaagcagaagctggagaaggacaatgccaagctgaaggtgacagtgaagaagcagatggacaagattgaggagctgcagaagaacctgctgaatgccaacctgtctgaagatgagaaggagcagctgaagaagctgatggagctgaagcagagcctggagtgcaacctggaccaggagatgaagaagaatgtggagctggagcgggagatcaccggcttcaagaacctgctgaagatgaccaggaagaagctgaatgaatatgaaaatggagagttctccttccatggagacctgaagaccagccagtttgagatggacatccagatcaacaagctgaagcacaagattgatgacctgacagctgagctggagacagctggcagcaagtgcctgcacctggacaccaagaaccagatcctgcaggaggagctgctgtccatgaagacagtgcagaagaagtgtgagaagctgcagaagaacaagaagaagctggagcaggaggtgatcaacctgcggagccacattgaaagaaacatggtggagctgggccaggtgaagcagtacaagcaggagattgaggagcgggcccggcaggagattgctgagaagctgaaggaggtgaacctcttcctgcaggcccaggccgccagccaggagaacctggagcagttccgggagaacaactttgcctccatgaagagccagatggagctgcgcatcaaggacctggagagcgagctgagcaagatcaagaccagccaggaggacttcaacaagacagagctggagaagtacaagcagctgtacctggaggagctgaaggtgaggaagagcctgagcagcaagctgaccaagaccaatgaaaggctggccgaggtgaacaccaagctgctggtggagaagcagcagagccgcagcctcttcaccaccctgaccaccaggcctgtgatggagcccccctgtgtgggcaacctgaacaacagcctggacctgaacaggaagctgatcccccgggagaacctggtgatcagcaccagcaacccccgggccagcaacaacagcatggagaactacctgagcaagatgcagcaggagctggagaagaacatcacccgggagctgaaggaggccgctgctgagctggagagcggcagcatcgccagccccctgggcagcacagatgagagcaacctgaaccaggacctggtgtggaaggccagccgggagtatgtgcaggtgctgaagaagaactacatgatctag

SEQ ID NO: 143698 - DNA, 642 bp, Artificial Sequence
  Description of Artificial Sequence: Synthetic coding sequence
tgattccgggagaacaactttgcctccatgaagagccagatggagctgcgcatcaaggacctggagagcgagctgagcaagatcaagaccagccaggaggacttcaacaagacagagctggagaagtacaagcagctgtacctggaggagctgaaggtgaggaagagcctgagcagcaagctgaccaagaccaatgaaaggctggccgaggtgaacaccaagctgctggtggagaagcagcagagccgcagcctcttcaccaccctgaccaccaggcctgtgatggagcccccctgtgtgggcaacctgaacaacagcctggacctgaacaggaagctgatcccccgggagaacctggtgatcagcaccagcaacccccgggccagcaacaacagcatggagaactacctgagcaagatgcagcaggagctggagaagaacatcacccgggagctgaaggaggccgctgctgagctggagagcggcagcatcgccagccccctgggcagcacagatgagagcaacctgaaccaggacctggtgtggaaggccagccgggagtatggccccagtgatgagacccctcatgactatgtgctgatgacagaccagtgcctgaccagcaggacagacctgcagtag

SEQ ID NO: 143699 - DNA, 3261 bp, Artificial Sequence
  Description of Artificial Sequence: Synthetic coding sequence
atgagccgggtgtgcatcgtggtgctggaggaggtggaggatgagagccctgccttcatcagcaagctgccccaggagaacaagagcctgcacagccccccatctggaaatgtgctggtgcgctaccccagcctggtgcaggccatcttcaatggagaccctgatgaggtgcgggccctgatcttcaagaaggaggatgtgaacttccaggacaatgagaagaggacccccctgcacgccgccgcctacctgggagatgctgagatcatcgagctgctgatcctgagcggggcccgggtgaatgccaaggacagcaagtggctgacccccctgcacagagctgtggccagctgcagcgaggaggccgtgcaggtgctgctgaagcacagcgcagatgtgaatgcccgggacaagaactggcagacccccctgcacatcgccgccgccaacaaggctgtgaagtgtgccgaggccctggtgcccctgctgagcaatgtgaatgtgtctgaccgggccggccgcacagccctgcaccacgccgccttcagcggccatggagagatggtgaagctgctgctgagcagaggagccaacatcaatgcctttgacaagaaggacagaagagccatccactgggccgcctacatgggccacatcgaggtggtgaagctgctggtgagccacggggctgaggtgacctgcaaggacaagaagagctacacccccctgcatgctgctgccagcagcggcatgatctctgtggtgaagtacctgctggacctgggcgtggacatgaatgagcccaatgcctacggcaacacccccctgcacgtggcctgctacaacggccaggatgtggtggtgaatgagctgattgactgtggggccatcgtgaaccagaagaatgagaagggcttcacccccctgcactttgctgctgccagcacccatggagccctgtgcctggagctgctggtgggcaatggagcagatgtgaacatgaagagcaaggatggcaagacccccctgcacatgacagccctgcacggccgcttcagccgcagccagaccatcatccagagcggggctgtgattgactgtgaggacaagaatggaaacacccccctgcacatcgccgcccgctatggccacgagctgctgatcaacaccctcatcaccagcggggctgacacagccaagaggggcatccacggcatgttccccctgcacctggccgccctgagcggcttcagtgactgctgcaggaagctgctgagcagcggctttgatattgacaccccagatgactttggaagaacctgcctgcacgccgctgctgctgggggcaacctggagtgcctgaacctgctgctgaacacaggagctgacttcaacaagaaggacaagtttggccgcagccccctgcactacgccgccgccaactgcaactaccagtgcctgtttgccctggtgggcagcggggcctctgtgaatgacctggatgagcggggctgcacccccctgcactatgctgccaccagtgacacagatggcaagtgcctggagtacctgctgagaaatgatgccaaccctggcatccgggacaagcagggctacaatgctgtgcactacagcgctgcctacggccaccggctgtgcctgcagctgattgccagcgagacccccctggatgtgctgatggagaccagcggcacagacatgctgagtgacagcgacaacagagccaccatcagccccctgcacctggccgcctaccacggccaccaccaggccctggaggtgctggtgcagagcctgctggacctggatgtgaggaacagcagcggccgcacccccctggacctggccgccttcaagggccacgtggagtgtgtggatgtgctgatcaaccagggcgccagcatcctggtgaaggactacatcctgaagaggacccccatccacgccgccgccaccaacggccacagcgagtgcctgcggctgctgattggaaatgctgagccccagaatgctgtggacatccaggatggaaatggccagacccccctgatgctgtctgtgctgaatggccacacagactgtgtgtacagcctgctgaacaagggggccaacgtggatgccaaggacaagtggggccgcacagccctgcacagaggagctgtgactggacatgaagaatgtgtggatgccctgctgcagcacggggccaagtgcctgctgcgggacagccggggccgcacccccatccacctgtctgctgcctgtggccacatcggcgtgctgggcgccctgctgcagagcgctgcctccatggatgccaacccagccacagctgacaaccacggctacacagccctgcactgggcctgctacaatggacatgagacctgtgtggagctgctgctggagcaggaggtgttccagaagacagagggcaatgccttcagccccctgcactgtgccgtcatcaatgacaatgaaggagctgctgagatgctgattgacaccctgggcgccagcatcgtgaatgccacagacagcaaaggaagaacacccctgcacgccgccgccttcacagaccacgtggagtgcctgcagctgctgctgagccacaatgcccaggtgaacagcgtggacagcacaggcaagacccccctgatgatggctgctgaaaatggccagaccaacacagtggagatgctggtgtcctctgccagcgctgagctgaccctgcaggacaacagcaagaacacagccctgcacctggcctgcagcaaaggacatgagaccagcgccctgctgatcctggagaagatcacagacaggaacctgatcaatgccaccaatgctgccctgcagacccccctgcacgtggccgccagaaatggcctgaccatggtggtgcaggagctgctgggcaaaggagcctctgtgctggccgtggatgaaaatggctacaccccagccctggcctgtgcccccaacaaggatgtggccgactgcctggccctgatcctggccaccatgatgcctgtgagcagcagcagccccctgagcagcctgaccttcaatgccatcaaccgctacaccaacaccagcaagacagtgtcctttgaggccctgcccatcatgagaaatgagcccagcagctactgcagcttcaacaacatcggcggggagcaggagtacctgtacacagatgtggatgagctgaatgacagcgacagcgagacctactag

SEQ ID NO: 143700 - DNA, 3162 bp, Artificial Sequence
  Description of Artificial Sequence: Synthetic coding sequence
atggccttcctgaagctgcgggaccagcccagcctggtgcaggccatcttcaacggggaccctgatgaggtgcgggccctgatcttcaagaaggaggatgtgaacttccaggacaatgagaagaggacccccctgcatgctgctgcctacctgggagatgctgagatcatcgagctgctgatcctgagcggggcccgggtgaatgccaaggacagcaagtggctgacccccctgcacagagctgtggccagctgcagcgaggaggccgtgcaggtgctgctgaagcacagcgcagatgtgaatgcccgggacaagaactggcagacccccctgcacatcgctgctgccaacaaggctgtgaagtgtgccgaggccctggtgcccctgctgagcaatgtgaatgtgtctgacagagctggccgcacagccctgcaccacgccgccttcagcggccacggggagatggtgaagctgctgctgagcagaggagccaacatcaatgcctttgacaagaaggaccggcgggccatccactgggccgcctacatgggccacatcgaggtggtgaagctgctggtgtcccatggagctgaggtgacctgcaaggacaagaagagctacacccccctgcacgccgccgccagcagcggcatgatctctgtggtgaagtacctgctggacctgggcgtggacatgaatgagcccaatgcctacggcaacacccccctgcacgtggcctgctacaacggccaggatgtggtggtgaatgagctgattgactgtggggccatcgtgaaccagaagaatgagaagggcttcacccccctgcactttgctgctgccagcacccacggggccctgtgcctggagctgctggtgggcaatggagcagatgtgaacatgaagagcaaggatggcaagacccccctgcacatgacagccctgcacggccgcttcagccgcagccagaccatcatccagagcggggccgtcatcgactgtgaggacaagaatggaaacacccccctgcacatcgccgcccgctatggccacgagctgctgatcaacaccctcatcaccagcggggctgacacagccaagaggggcatccacggcatgttccccctgcacctggccgccctgagcggcttcagtgactgctgcaggaagctgctgagcagcggctttgacatcgacaccccagatgactttggccgcacctgcctgcatgctgctgctgctgggggcaacctggagtgcctgaacctgctgctgaacacaggagctgacttcaacaagaaggacaagtttggccgcagccccctgcactatgctgctgccaactgcaactaccagtgcctgtttgccctggtgggcagcggggcctctgtgaatgacctggatgagcggggctgcacccccctgcactacgccgccaccagtgacacagatggcaagtgcctggagtacctgctgagaaatgatgccaaccctggcatccgggacaagcagggctacaatgctgtgcactacagcgctgcctacggccaccggctgtgcctgcagctgattgccagcgagacccccctggatgtgctgatggagaccagcggcacagacatgctgagtgacagcgacaacagagccaccatcagccccctgcacctggccgcctaccacggccaccaccaggccctggaggtgctggtgcagagcctgctggacctggatgtgaggaacagcagcggccgcacccccctggacctggccgccttcaagggccacgtggagtgtgtggatgtgctgatcaaccagggcgccagcatcctggtgaaggactacatcctgaagaggacccccatccatgctgctgccaccaacggccacagtgaatgtctgcggctgctgattggaaatgctgagccccagaatgctgtggacatccaggatggaaatggccagacccccctgatgctgtctgtgctgaatggccacacagactgtgtgtacagcctgctgaacaagggggccaacgtggatgccaaggacaagtggggccgcacagccctgcacagaggagctgtgacaggccacgaggagtgtgtggatgccctgctgcagcacggggccaagtgcctgctgcgggacagccggggccgcacccccatccacctgtctgctgcctgtggccacatcggcgtgctgggcgccctgctgcagagcgctgcctccatggatgccaacccagccacagctgacaaccacggctacacagccctgcactgggcctgctacaacggccacgagacctgtgtggagctgctgctggagcaggaggtgttccagaagacagagggcaatgccttcagccccctgcactgtgctgtgatcaatgacaatgaaggagctgctgagatgctgattgacaccctgggcgccagcatcgtgaatgccacagacagcaagggccgcacccccctgcatgctgctgccttcacagaccacgtggagtgcctgcagctgctgctgagccacaatgcccaggtgaacagcgtggacagcacaggcaagacccccctgatgatggccgcagaaaatggccagaccaacacagtggagatgctggtgagcagcgccagcgctgagctgaccctgcaggacaacagcaagaacacagccctgcacctggcctgcagcaagggccacgagaccagcgccctgctgatcctggagaagatcacagacaggaacctgatcaatgccaccaatgctgccctgcagacccccctgcacgtggccgccagaaatggcctgaccatggtggtgcaggagctgctgggcaagggggcctctgtgctggccgtggatgaaaatggctacaccccagccctggcctgtgcccccaacaaggatgtggccgactgcctggccctgatcctggccaccatgatgcctgtgagcagcagcagccccctgagcagcctgaccttcaatgccatcaaccgctacaccaacaccagcaagacagtgtcctttgaggccctgcccatcatgagaaatgagcccagcagctactgcagcttcaacaacattggaggagagcaggagtacctgtacacagatgtggatgagctgaatgacagcgacagcgagacctactag

SEQ ID NO: 143701 - DNA, 3162 bp, Artificial Sequence; identical to SEQ ID NO: 143700
  Description of Artificial Sequence: Synthetic coding sequence

SEQ ID NO: 143702 - DNA, 4026 bp, Artificial Sequence
  Description of Artificial Sequence: Synthetic coding sequence
atgaccaagaggaagaagaccatcaacctgaacatccaggatgcccagaagaggacagccctgcactgggcctgtgtgaatggacatgaggaggtggtgaccttcctggtggacaggaagtgccagctggatgtgctggatggagagcacaggacccccctgatgaaggccctgcagtgccaccaggaggcctgtgccaacatcctgattgacagcggggctgacatcaacctggtggatgtgtatggcaacacagccctgcactatgctgtgtacagcgagatcctgtctgtggtggccaagctgctgagccatggagctgtgattgaggtgcacaacaaggccagcctgacccccctgctgctgagcatcaccaagaggtctgagcagatcgtggagttcctgctgatcaagaatgccaatgccaatgctgtgaacaagtacaagtgcacagccctgatgctggccgtgtgccacggcagcagcgagatcgtgggcatgctgctgcagcagaatgtggatgtgtttgctgctgacatctgtggggtgacagctgagcactatgctgtgacctgtggcttccaccacatccacgagcagatcatggagtacatcaggaagctgagcaagaaccaccagaacaccaaccctgagggcaccagcgctggcaccccagatgaggccgcccccctggccgagaggaccccagacacagctgagagcctggtggagaagaccccagatgaggccgcccccctggtggagaggaccccagacacagctgagagcctggtggagaagaccccagatgaggccgccagcctggtggagggcaccagtgacaagatccagtgcctggagaaggccaccagcggcaagtttgagcagagcgctgaggagaccccccgggagatcaccagccctgccaaggagaccagcgagaagttcacctggccagccaagggccggcccaggaagatcgcctgggagaagaaggaggacaccccccgggagatcatgagccctgccaaggagaccagcgagaagttcacctgggccgccaagggccggcccaggaagatcgcctgggagaagaaggagacccctgtgaagacaggctgtgtggcccgggtgaccagcaacaagaccaaggtgctggagaagggccgcagcaagatgattgcctgccccaccaaggagagcagcaccaaggccagcgccaatgaccagcgcttccccagcgagagcaagcaggaggaggatgaggagtacagctgtgacagccgcagcctgtttgagagcagcgccaagatccaggtgtgcatccctgagagcatctaccagaaggtgatggagatcaaccgggaggtggaggagccccccaagaagcccagcgccttcaagccagccatcgagatgcagaacagcgtgcccaacaaggcctttgagctgaagaatgagcagaccctgcgggctgaccccatgtttcctcctgagagcaagcagaaggactatgaagaaaattcctgggacagcgagagcctgtgtgagaccgtgtcccagaaggatgtgtgcctgcccaaggccacccaccagaaggagattgacaagatcaatggcaagctggaggagagccccaacaaggatggcctgctgaaggccacctgtggcatgaaggtgtccatccccaccaaggccctggagctgaaggacatgcagaccttcaaggccgagcccccaggcaagcccagcgcctttgagcccgccacagagatgcagaagtctgtgcccaacaaggccctggagctgaagaatgagcagaccctgcgggcagatgagatcctgcccagcgagagcaagcagaaggactatgaggagaacagctgggacacagagagcctgtgtgaaacagtgtcccagaaggatgtgtgcctgcccaaggccgcccaccagaaggagattgacaagatcaacgggaagctggagggcagccctgtgaaggatggcctgctgaaggccaactgtggcatgaaggtgtccatccccaccaaggccctggagctgatggacatgcagaccttcaaggccgagcccccagagaagcccagcgcctttgagcccgccatcgagatgcagaagtctgtgcccaacaaggccctggagctgaagaatgagcagaccctgcgggcagatgagatcctgcccagcgagagcaagcagaaggactatgaggagagctcctgggacagcgagagcctgtgtgagaccgtgtcccagaaggatgtgtgcctgcccaaggccacccaccagaaggagattgacaagatcaatggcaagctggaggagagcccagacaatgatggcttcctgaaggccccctgcaggatgaaggtgtccatccccaccaaggccctggagctgatggacatgcagaccttcaaggccgagcccccagagaagcccagcgcctttgagcccgccatcgagatgcagaagtctgtgcccaacaaggccctggagctgaagaatgagcagaccctgcgggctgaccagatgttccccagcgagagcaagcagaagaaggtggaggagaacagctgggacagcgagagcctgcgggagaccgtgtcccagaaggatgtgtgtgtgcccaaggccacccaccagaaggagatggacaagatcagcggcaagctggaggacagcaccagcctgagcaagatcctggacacagtgcacagctgtgagcgggcccgggagctgcagaaggaccactgtgagcagaggacaggcaagatggagcagatgaagaagaagttctgtgtgctgaagaagaagctgtctgaggccaaggagatcaagagccagctggagaaccagaaggtgaagtgggagcaggagctgtgcagcgtgcggctgaccctgaaccaggaggaggagaagagaagaaatgctgacatcctgaatgagaagatccgggaggagctgggcagaattgaggagcagcacaggaaggagctggaggtgaagcagcagctggagcaggccctgcgcatccaggacatcgagctgaagtctgtggagagcaacctgaaccaggtgagccacacccatgaaaatgaaaactacctgctgcacgagaactgcatgctgaagaaggagatcgccatgctgaagctggagatcgccaccctgaagcaccagtaccaggagaaggagaacaagtactttgaggacatcaagatcctgaaggagaagaatgctgagctgcagatgaccctgaagctgaaggaggagagcctgaccaagagggccagccagtacagcggccagctgaaggtgctgattgctgagaacaccatgctgaccagcaagctgaaggagaagcaggacaaggagatcctggaggccgagattgagagccaccacccccggctggccagcgctgtgcaggaccatgaccagatcgtgaccagcaggaagagccaggagcccgccttccacatcgctggagatgcctgcctgcagaggaagatgaatgtggatgtgagcagcaccatctacaacaatgaggtgctgcaccagcccctgtctgaggcccagaggaagagcaagagcctgaagatcaacctgaactatgctggagatgccctgcgggagaacaccctggtgtctgaacatgcccagagggaccagcgggagacccagtgccagatgaaggaggccgagcacatgtaccagaatgagcaggacaacgtgaacaagcacacagagcagcaggagagcctggaccagaagctgttccagctgcagagcaagaacatgtggctgcagcagcagctggtgcacgcccacaagaaggctgacaacaagagcaagatcaccatcgacatccacttcctggagaggaagatgcagcaccacctgctgaaggagaagaatgaggagatcttcaactacaacaaccacctgaagaaccgcatctaccagtatgagaaggagaaggccgagacagagaacagctag

SEQ ID NO: 143703 - DNA, 360 bp, Artificial Sequence
  Description of Artificial Sequence: Synthetic coding sequence
atgggcaccaggaccctgcagtttgagatcagtgacagccatgagaaggaggaggacctgctgcacaagaaccacctgatgcaggatgaaattgcccggctgcggctggagatccacaccatcaagaaccagatcctggagaagaagtacctgaaggacatcgagatcatcaagaggaagcatgaggacctgcagaaggccctgaagcagaatggagagaagagcaccaagaccatcgcccactacagcggccagctgacagccctgacagatgagaacaccatgctgcggagcaagctggagaaggagaagcagagccggcagaggctgaccaagtggaaccacaccatcgtggactag

SEQ ID NO: 143704 - DNA, 759 bp, Artificial Sequence
  Description of Artificial Sequence: Synthetic coding sequence
atgagccaggccgccaaggccagcgccagcgccaccgtggccgtgaaccctggccctgacaccaagggcaagggggcccctcctgctggcaccagccccagccctggcaccaccctggcccccaccaccgtgcccatcaccagcgccaaggctgctgagctgcccccaggcaactaccgcctggtggtgtttgagctggagaacttccagggccggcgggcagagttctctggagaatgtagcaacctggccgaccggggctttgacagagtgcgcagcatcatcgtgtctgctggcccctgggtggcctttgagcagagcaacttccggggggagatgttcatcctggagaagggggagtacccccgctggaacacctggagcagcagctacagaagtgaccggctgatgtccttccggcccatcaagatggatgcccaggagcacaagatcagcctgtttgagggcgccaacttcaagggcaacaccatcgagatccagggagatgatgcccccagcctgtgggtgtatggcttcagtgacagagtgggctctgtgaaggtgagcagcggcacctgggtgggctaccagtacccaggctaccggggctaccagtacctgctggagcccggggacttccgccactggaatgagtggggcgccttccagccccagatgcagagcctgcggcggctgcgggacaagcagtggcacctggagggcagcttccctgtgctggccacagagccccccaagtag

SEQ ID NO: 143705 - DNA, 627 bp, Artificial Sequence
  Description of Artificial Sequence: Synthetic coding sequence
tgaagagatgagctgcgctgcaagatcccagctggccgcctgcggcgggccgcccggccccaccggcggctgggccccaccgggaaggaggtgcacgccctgaagaggctgcgggacagcgccaatgccaatgatgtggagaccgtgcagcagctgctggaggatggagctgacccctgtgccgcagatgacaagggccgcacagccctgcactttgccagctgcaatggaaatgaccagatcgtgcagctgctgctggaccacggggctgaccccaaccagagagatggcctgggcaacacccccctgcacctggagtgcagcccccagctggtgcctgctggggcccgggtggatgccctggaccgggccggccgcacccccctgcacctggccaagagcaagctgaacatcctgcaggagggccacgcccagtgcctggaggccgtgcggctggaggtgaagcagatcatccacatgctgcgggagtacctggagcggctgggccagcacgagcagcgggagcggctggatgacctgtgcacccggctgcagatgaccagcaccaaggagcaggtggatgaggtgacagacctgctggccagcttcaccagcctgagcctgtag

SEQ ID NO: 143706 - DNA, 2184 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggaccggcaggacaaggatggcaacacagccctgcacgaggcctcctggcacggcttcagccagagcgccaagctgctgatcaaggccggggccaacgtgctggccaagaacaaggccggcaacacagccctgcacctggcctgccagaacagccacagccagagcaccagggtgctgctgctggccggcagcagagctgacctgaagaacaatgctggggacacctgcctgcacgtggccgcccgctacaaccacctgagcatcatccggctgctgctgacagccttctgcagcgtgcatgagaagaaccaggccggggacacagccctgcacgtggccgccgccctgaaccacaagaaggtggccaagatcctgctggaggccggggctgacaccaccatcgtgaacaatgccggccagacccccctggagacagcccgctaccacaacaaccctgaggtggccctgctgctgaccaaggccccccaggtgctgcgcttcagccggggccgcagcctgaggaagaagcgggagcggctgaaggaggagcggcgggcccagagcgtgcccagagatgaggtggcccagagcaaaggatctgtgtctgctggggacacccccagcagcgagcaggccgtggccaggaaggaggaggcccgggaggagttcctgagcgccagccctgagccccgggccaaggatgacagaagaaggaagagccggcccaaggtgtctgccttcagtgaccccaccccacctgctgaccagcagcccggccaccagaagaacctgcacgcccacaaccaccccaagaagaggaacagacaccgctgcagcagccccccacctcctcatgagttccgggcctaccagctgtacaccctgtaccggggcaaggatggcaaggtgatgcaggcccccatcaatggctgccgctgtgagcccctcatcaacaagctggagaaccagctggaggccaccgtggaggagatcaaggccgagctgggctctgtgcaggacaagatgaacaccaagctgggccagatggagaacaagacccagcaccagatgagggtgctggacaagctgatggtggagcggctgtctgctgagaggacagaatgtctgaaccggctgcagcagcacagcgacacagagaagcatgaaggagagaagaggcagatcagcctggtggatgagctgaagacctggtgcatgctgaagatccagaacctggagcagaagctgagcggggacagccgggcctgccgggccaagagcacccccagcacctgtgagagcagcactggagtggaccagctggtggtgacagctggccctgctgctgccagtgacagcagcccccctgtggtgcggcccaaggagaaggccctgaacagcacagccacccagaggctgcagcaggagctgagcagcagtgactgcaccggcagccggctgagaaatgtgaaggtgcagacagccctgctgcccatgaatgaagctgcccggagtgaccagcaggccggcccctgtgtgaacagaggcacccagaccaagaagagcggcaagagcggccccaccaggcaccgggcccagcagcctgctgccagcagcacctgtggccagcccccaccagccactggaagtgagcagacaggcccccacatccgggacaccagccaggccctggagctgacccagtacttctttgaggccgtgtccacccagatggagaagtggtatgaaaggaagattgaggaggcccggagccaggccaaccagaaggcccagcaggacaaggccaccctgaaggagcacatcaagagcctggaggaggagctggccaagctgcggaccagggtgcagaaggagaactag

SEQ ID NO: 143707 - DNA, 2079 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggaccggcaggacaaggatggcaacacagccctgcacgaggcctcctggcacggcttcagccagagcgccaagctgctgatcaaggccggggccaacgtgctggccaagaacaaggccggcaacacagccctgcacctggcctgccagaacagccacagccagagcaccagggtgctgctgctggccggcagcagagctgacctgaagaacaatgctggggacacctgcctgcacgtggccgcccgctacaaccacctgagcatcatccggctgctgctgacagccttctgcagcgtgcatgagaagaaccaggccggggacacagccctgcacgtggccgccgccctgaaccacaagaaggtggccaagatcctgctggaggccggggctgacaccaccatcgtgaacaatgccggccagacccccctggagacagcccgctaccacaacaaccctgaggtggccctgctgctgaccaaggccccccagggctctgtgtctgctggggacacccccagcagcgagcaggccgtggccaggaaggaggaggcccgggaggagttcctgagcgccagccctgagccccgggccaaggatgacagaagaaggaagagccggcccaaggtgtctgccttcagtgaccccaccccacctgctgaccagcagcccggccaccagaagaacctgcacgcccacaaccaccccaagaagaggaacagacaccgctgcagcagccccccacctcctcatgagttccgggcctaccagctgtacaccctgtaccggggcaaggatggcaaggtgatgcaggcccccatcaatggctgccgctgtgagcccctcatcaacaagctggagaaccagctggaggccaccgtggaggagatcaaggccgagctgggctctgtgcaggacaagatgaacaccaagctgggccagatggagaacaagacccagcaccagatgagggtgctggacaagctgatggtggagcggctgtctgctgagaggacagagtgcctgaaccggctgcagcagcacagcgacacagagaagcatgaaggagagaagaggcagatcagcctggtggatgagctgaagacctggtgcatgctgaagatccagaacctggagcagaagctgagcggggacagccgggcctgccgggccaagagcacccccagcacctgtgagagcagcactggagtggaccagctggtggtgacagctggccctgctgctgccagtgacagcagcccccctgtggtgcggcccaaggagaaggccctgaacagcacagccacccagaggctgcagcaggagctgagcagcagtgactgcaccggcagccggctgagaaatgtgaaggtgcagacagccctgctgcccatgaatgaggccgcccggagtgaccagcaggccggcccctgtgtgaacagaggcacccagaccaagaagagcggcaagagcggccccaccaggcaccgggcccagcagcctgctgccagcagcacctgtggccagcccccaccagccaccggcagcgagcagacaggcccccacatccgggacaccagccaggccctggagctgacccagtacttctttgaagctgtgtccacccagatggagaagtggtatgaaaggaagattgaggaggcccggagccaggccaaccagaaggcccagcaggacaaggccaccctgaaggagcacatcaagagcctggaggaggagctggccaagctgcggaccagggtgcagaaggaaaattag

SEQ ID NO: 143708 - DNA, 2169 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggaccggcaggacaaggatggcaacacagccctgcacgaggcctcctggcacggcttcagccagagcgccaagctgctgatcaaggccggggccaacgtgctggccaagaacaaggccggcaacacagccctgcacctggcctgccagaacagccacagccagagcaccagggtgctgctgctggccggcagcagagctgacctgaagaacaatgctggggacacctgcctgcacgtggccgcccgctacaaccacctgagcatcatccggctgctgctgacagccttctgcagcgtgcatgagaagaaccaggccggggacacagccctgcacgtggccgccgccctgaaccacaagaaggtggccaagatcctgctggaggccggggctgacaccaccatcgtgaacaatgccggccagacccccctggagacagcccgctaccacaacaaccctgaggtggccctgctgctgaccaaggccccccaggtgctgcgcttcagccggggccgcagcctgaggaagaagcgggagcggctgaaggaggagcggcgggcccagagcgtgcccagagatgaggtggcccagagcaaaggatctgtgtctgctggggacacccccagcagcgagcaggccgtggccaggaaggaggaggcccgggaggagttcctgagcgccagccctgagccccgggccaaggatgacagaagaaggaagagccggcccaaggtgtctgccttcagtgaccccaccccacctgctgaccagcagcccggccaccagaagaacctgcacgcccacaaccaccccaagaagaggaacagacaccgctgcagcagccccccacctcctcatgagttccgggcctaccagctgtacaccctgtaccggggcaaggatggcaaggtgatgcaggcccccatcaatggctgccgctgtgagcccctcatcaacaagctggagaaccagctggaggccaccgtggaggagatcaaggccgagctgggctctgtgcaggacaagatgaacaccaagctgggccagatggagaacaagacccagcaccagatgagggtgctggacaagctgatggtggagcggctgtctgctgagaggacagaatgtctgaaccggctgcagcagcacagcgacacagagaagcatgaaggagagaagaggcagatcagcctggtggatgagctgaagacctggtgcatgctgaagatccagaacctggagcagaagctgagcggggacagccgggcctgccgggccaagagcacccccagcacctgtgtggaccagctggtggtgacagctggccctgctgctgccagtgacagcagcccccctgtggtgcggcccaaggagaaggccctgaacagcacagccacccagaggctgcagcaggagctgagcagcagtgactgcaccggcagccggctgagaaatgtgaaggtgcagacagccctgctgcccatgaatgaggccgcccggagtgaccagcaggccggcccctgtgtgaacagaggcacccagaccaagaagagcggcaagagcggccccaccaggcaccgggcccagcagcctgctgccagcagcacctgtggccagcccccaccagccaccggcagcgagcagacaggcccccacatccgggacaccagccaggccctggagctgacccagtacttctttgaagctgtgtccacccagatggagaagtggtatgaaaggaagattgaggaggcccggagccaggccaaccagaaggcccagcaggacaaggccaccctgaaggagcacatcaagagcctggaggaggagctggccaagctgcggaccagggtgcagaaggaaaattag

SEQ ID NO: 143709 - DNA, 528 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggaccggcaggacaaggatggcaacacagccctgcacgaggcctcctggcacggcttcagccagagcgccaagctgctgatcaaggccggggccaacgtgctggccaagaacaaggccggcaacacagccctgcacctggcctgccagaacagccacagccagagcaccagggtgctgctgctggccggcagcagagctgacctgaagaacaatgctggggactag

SEQ ID NO: 143710 - DNA, 243 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcactag

SEQ ID NO: 143711 - DNA, 2184 bp, Artificial Sequence; identical to SEQ ID NO: 143706
  Description of Artificial Sequence: Synthetic coding sequence

SEQ ID NO: 143712 - DNA, 357 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggaccggcaggacaaggatggcaacacagccctgcacgaggcctcctggcactag

SEQ ID NO: 143713 - DNA, 309 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggactag

SEQ ID NO: 143714 - DNA, 1992 bp, Artificial Sequence
  Description of Artificial Sequence: Synthetic coding sequence
atgagccagcaggatgctgtggccgccctgtctgagcggctgctggtggccgcctacaagggccagacagaaaatgtggtgcagctgatcaacaagggggcccgggtggccgtgaccaagcacggccgcacccccctgcacctggccgccaacaagggccacctgcctgtggtgcagatcctgctgaaggccggctgtgacctggatgtgcaggatgatggagaccagacagccctgcaccgggccaccgtggtgggcaacacagagatcatcgccgccctgatccacgagggctgtgccctggaccggcaggacaaggccggcaacacagccctgcacctggcctgccagaacagccacagccagagcaccagggtgctgctgctggccggcagcagagctgacctgaagaacaatgctggggacacctgcctgcacgtggccgcccgctacaaccacctgagcatcatccggctgctgctgacagccttctgcagcgtgcatgagaagaaccaggccggggacacagccctgcacgtggccgccgccctgaaccacaagaaggtggccaagatcctgctggaggccggggctgacaccaccatcgtgaacaacgtgctgcgcttcagccggggccgcagcctgaggaagaagcgggagcggctgaaggaggagcggcgggcccagagcgtgcccagagatgaggtggcccagagcaagggctctgtgtctgctggggacacccccagcagcgagcaggccgtggccaggaaggaggaggcccgggaggagttcctgagcgccagccctgagccccgggccaaggatgacagaagaaggaagagccggcccaaggtgtctgccttcagtgaccccaccccacctgctgaccagcagcccggccaccagaagaacctgcacgcccacaaccaccccaagaagaggaacagacaccgctgcagcagccccccacctcctcatgagttccgggcctaccagctgtacaccctgtaccggggcaaggatggcaaggtgatgcaggcccccatcaatggctgccgctgtgagcccctcatcaacaagctggagaaccagctggaggccaccgtggaggagatcaaggccgagctgggctctgtgcaggacaagatgaacaccaagctgggccagatggagaacaagacccagcaccagatgagggtgctggacaagctgatggtggagcggctgtctgctgagaggacagagtgcctgaaccggctgcagcagcacagcgacacagagaagcatgaaggagagaagaggcagatcagcctggtggatgagctgaagacctggtgcatgctgaagatccagaacctggagcagaagctgagcggggacagccgggcctgccgggccaagagcacccccagcacctgtgtggaccagctggtggtgacagctggccctgctgctgccagtgacagcagcccccctgtggtgcggcccaaggagaaggccctgaacagcacagccacccagaggctgcagcaggagctgagcagcagtgactgcaccggcagccggctgagaaatgtgaaggtgcagacagccctgctgcccatgaatgaagctgcccggagtgaccagcaggccggcccctgtgtgaacagaggcacccagaccaagaagagcggcaagagcggccccaccaggcaccgggcccagcagcctgctgccagcagcacctgtggccagcccccaccagccactggaagtgagcagacaggcccccacatccgggacaccagccaggccctggagctgacccagtacttctttgaggccgtgtccacccagatggagaagtggtatgaaaggaagattgaggaggcccggagccaggccaaccagaaggcccagcaggacaaggccaccctgaaggagcacatcaagagcctggaggaggagctggccaagctgcggaccagggtgcagaaggagaactag

SEQ ID NO: 143715 - DNA, 765 bp, Artificial Sequence
  Description of Artificial Sequence: Synthetic coding sequence
atgaacaagctgttctccttctggaagaggaagaatgagaccaggagccagggctacaacctgcgggagaaggacctgaagaagctgcaccgggccgcctctgtgggggacctgaagaagctgaaggagtacctgcagatcaagaagtatgatgtgaacatgcaggacaagaagtaccgcacccccctgcacctggcctgtgccaacggccacacagatgtggtgctcttcctgattgagcagcagtgcaagatcaacgtgcgggacagcgagaacaagagccccctcatcaaggctgtgcagtgccagaatgaagactgtgccaccatcctgctgaactttggagctgaccctgacctgcgggacatccgctacaacacagtgctgcactatgctgtgtgtggccagagcctgagcctggtggagaagctgctggagtatgaagctgacctggaggccaagaacaaggatggctacacccccctgctggtggccgtcatcaacaacaaccccaagatggtgaagttcctgctggagaagggagcagatgtgaatgccagtgacaactaccagaggacagccctgatcctggccgtgtctggagagcccccctgcctggtgaagctgctgctgcagcagggcgtggagctgtgctatgagggcatcgtggacagccagctgaggaacatgttcatctccatggtgctgctgcaccgctacccccagttcaccgccagccacggcaagaagaagcacgccaagtag

SEQ ID NO: 143716 - DNA, 825 bp, Artificial Sequence
  Description of Artificial Sequence: Synthetic coding sequence
atgaacaagctgttctccttctggaagaggaagaatgagaccaggagccagggctacaacctgcgggagaaggacctgaagaagctgcaccgggccgcctctgtgggggacctgaagaagctgaaggagtacctgcagatcaagaagtatgatgtgaacatgcaggacaagaagtacagcgtggtgcagagcagccgctggctgctgagctacaccacccccctgaatgacttcatccgcacccccctgcacctggcctgtgccaacggccacacagatgtggtgctcttcctgattgagcagcagtgcaagatcaacgtgcgggacagcgagaacaagagccccctcatcaaggctgtgcagtgccagaatgaagactgtgccaccatcctgctgaactttggagctgaccctgacctgcgggacatccgctacaacacagtgctgcactatgctgtgtgtggccagagcctgagcctggtggagaagctgctggagtatgaagctgacctggaggccaagaacaaggatggctacacccccctgctggtggccgtcatcaacaacaaccccaagatggtgaagttcctgctggagaagggagcagatgtgaatgccagtgacaactaccagaggacagccctgatcctggccgtgtctggagagcccccctgcctggtgaagctgctgctgcagcagggcgtggagctgtgctatgagggcatcgtggacagccagctgaggaacatgttcatctccatggtgctgctgcaccgctacccccagttcaccgccagccacggcaagaagaagcacgccaagtag

SEQ ID NO: 143717 - DNA, 606 bp, Artificial Sequence
  Description of Artificial Sequence: Synthetic coding sequence
atgcaggacaagaagtaccgcacccccctgcacctggcctgtgccaacggccacacagatgtggtgctcttcctgattgagcagcagtgcaagatcaacgtgcgggacagcgagaacaagagccccctcatcaaggctgtgcagtgccagaatgaagactgtgccaccatcctgctgaactttggagctgaccctgacctgcgggacatccgctacaacacagtgctgcactatgctgtgtgtggccagagcctgagcctggtggagaagctgctggagtatgaggccgacctggaggccaagaacaaggatggctacacccccctgctggtggccgtcatcaacaacaaccccaagatggtgaagttcctgctggagaagggagcagatgtgaatgccagtgacaactaccagaggacagccctgatcctggccgtgtctggagagcccccctgcctggtgaagctgctgctgcagcagggcgtggagctgtgctatgagggcatcgtggacagccagctgaggaacatgttcatctccatggtgctgctgcaccgctacccccagttcaccgccagccacggcaagaagaagcacgccaagtag

SEQ ID NO: 143718 - DNA, 942 bp, Artificial Sequence
  Description of Artificial Sequence: Synthetic coding sequence
atggacaccagcaccaacctggacattggagcccagctgattgtggaggagtgccccagcacctacagcctgaccggcatgccagacatcaagattgagcaccccctggaccccaacagcgaggagggcagcgcccagggcgtggccatgggcatgaagttcatcctgcccaacagatttgacatgaatgtgtgcagcagatttgtgaagagcctgaatgaggaggacagcaagaacatccaggaccaggtgaacagcgacctggaggtggcctctgtgctcttcaaggccgagtgcaacatccacaccagccccagccctggcatccaggtgagacatgtgtacacccccagcaccaccaagcacttcagccccatcaagcagagcaccaccctgaccaacaagcacagaggaaatgaggtgtccaccacccccctgctggccaacagcctgtctgtgcaccagctggccgcccagggcgagatgctgtacctggccaccagaattgagcaggagaatgtcatcaaccacacagatgaggagggcttcacccccctgatgtgggccgccgcccacggccagattgctgtggtggagttcctgctgcagaatggagctgacccccagctgctgggcaagggccgggagagcgccctgagcctggcctgcagcaagggctacacagacatcgtgaagatgctgctggactgtggggtggatgtgaatgaatatgactggaatggaggcacccccctgctgtatgctgtgcacggcaaccacgtgaagtgtgtgaagatgctgctggagagcggggctgaccccaccatcgagacagacagcggctacaacagcatggacctggccgtggccctgggctacagatctgtgcagcaggtgattgagagccacctgctgaagctgctgcagaacatcaaggagtag

SEQ ID NO: 143719 - DNA, 1428 bp, Artificial Sequence
  Description of Artificial Sequence: Synthetic coding sequence
atggccgccagcgccctgcggggcctgcctgtggccggcggcggggagagcagcgagagtgaagatgatggctgggagatcggctacctggacaggaccagccagaagctgaagaggctgctgcccatcgaggagaagaaggagaagttcaagaaggccatgaccatcggagatgtgtccctggtgcaggagctgctggacagcggcatctctgtggacagcaacttccagtatggctggacccccctgatgtatgctgcctctgtggccaatgctgagctggtgcgggtgctgctggacagaggagccaatgccagctttgagaaggacaagcagagcatcctgatcacagcctgcagcgcccacggcagcgaggagcagatcctgaagtgtgtggagctgctgctgagcagaaatgctgaccccaacgtggcctgccggcggctgatgacccccatcatgtatgctgccagagatggccacacccaggtggtggccctgctggtggcccatggagctgaggtgaacacccaggatgaaaatggctacacagccctgacctgggccgcccggcagggccacaagaacatcgtgctgaagctgctggagctgggcgccaacaagatgctgcagaccaaggatggcaagatgcccagcgagatcgccaagaggaacaagcaccacgagatcttcaacctgctgtccttcaccctgaaccccctggagggcaagctgcagcagctgaccaaggaggacaccatctgcaagatcctgaccacagacagcgaccgggagaaggaccacatcttcagcagctacacagccttcggggacctggaggtgttcctgcacggcctgggcctggagcacatgacagacctgctgaaggagcgggacatcaccctgcggcacctgctgaccatgagagaagatgagttcaccaagaatggcatcaccagcaaggaccagcagaagatcctggccgccctgaaggagctgcaggtggaggagatccagtttggagagctgtctgaggagaccaagctggagatctctggagatgagttcctgaacttcctgctgaagctgaacaagcagtgtggccacctgatcacagctgtgcagaatgtcatcacagagctgcctgtgaacagccagaagatcaccctggagtgggccagcccccagaacttcacctctgtgtgtgaggagctggtgaacaacgtggaggacctgtctgagaaggtgtgcaagctgaaggacctgatccagaagctgcagaatgaaagagaaaatgaccccacccacatccagctgcgggaggaggtgtccacctggaacagccgcatcctgaagaggacagccatcaccatctgtggcttcggcttcctgctcttcatctgcaagctgaccttccagaggaagtag

SEQ ID NO: 143720 - DNA, 1041 bp, Artificial Sequence
  Description of Artificial Sequence: Synthetic coding sequence
atggccatggtgtctgagttcctgaagcaggcctggttcattgaaaatgaggagcaggagtatgtgcagacagtgaagagcagcaaaggaggccctggcagcgctgtgagcccctaccccaccttcaaccccagcagtgatgtggccgccctgcacaaggccatcatggtgaagggcgtggatgaggccaccatcatcgacatcctgaccaagaggaacaatgcccagaggcagcagatcaaggccgcctacctgcaggagaccgggaagcccctggatgagaccctgaagaaggccctgaccggccacctggaggaggtggtgctggccctgctgaagaccccagcccagtttgatgctgatgagctgcgggccgccatgaagggcctgggcacagatgaggacaccctcatcgagatcctggccagcaggaccaacaaggagatccgggacatcaacagagtgtaccgggaggagctgaagagggacctggccaaggacatcaccagtgacaccagcggggacttcagaaatgccctgctgagcctggccaagggggacagaagtgaggactttggagtgaatgaagacctggccgacagtgatgcccgggccctgtatgaagctggggagaggaggaagggcacagatgtgaatgtgttcaacaccatcctgaccaccaggagctacccccagctgcggcgggtcttccagaagtacaccaagtacagcaagcatgacatgaacaaggtgctggacctggagctgaagggggacatcgagaagtgcctgacagccatcgtgaagtgtgccaccagcaagccagccttctttgctgagaagctgcaccaggccatgaagggcgtgggcaccaggcacaaggccctgatccgcatcatggtgagccgctcagaaattgacatgaatgacatcaaggccttctaccagaagatgtatggcatcagcctgtgccaggccatcctggatgagaccaagggggactatgagaagatcctggtggccctgtgtggcggcaactag

SEQ ID NO: 143721 - DNA, 1041 bp, Artificial Sequence; identical to SEQ ID NO: 143720
  Description of Artificial Sequence: Synthetic coding sequence

SEQ ID NO: 143722 - DNA, 348 bp, Artificial Sequence
  Description of Artificial Sequence: Synthetic coding sequence
atggccatggtgtctgagttcctgaagcaggcctggttcattgaaaatgaggagcaggagtatgtgcagacagtgaagagcagcaaaggaggccctggcagcgctgtgagcccctaccccaccttcaaccccagcagtgatgtggccgccctgcacaaggccatcatggtgaagggcgtggatgaggccaccatcatcgacatcctgaccaagaggaacaatgcccagaggcagcagatcaaggccgcctacctgcaggagaccgggaagcccctggatgagaccctgaagaaggccctgaccggccacctggaggaggtggtgctggccctgctgaagaccccctag

SEQ ID NO: 143723 - DNA, 615 bp, Artificial Sequence
  Description of Artificial Sequence: Synthetic coding sequence
atgaacctgatcctgcgctacaccttcagcaagatggccatggtgtctgagttcctgaagcaggcctggttcattgaaaatgaggagcaggagtatgtgcagacagtgaagagcagcaagggcggccctggcagcgctgtgagcccctaccccaccttcaaccccagcagtgatgtggccgccctgcacaaggccatcatggtgaagggcgtggatgaggccaccatcatcgacatcctgaccaagagaaataatgcccagaggcagcagatcaaggccgcctacctgcaggagaccgggaagcccctggatgagaccctgaagaaggccctgaccggccacctggaggaggtggtgctggccctgctgaagaccccagcccagtttgatgctgatgagctgcgggccgccatgaagggcctgggcacagatgaggacaccctgattgagatcctggccagcaggaccaacaaggagatccgggacatcaacagagtgtaccgggaggagctgaagagggacctggccaaggacatcaccagtgacaccagcggggacttcagaaatgccctgctgagcctggccaagggggacagaagtgaagattttggatag

SEQ ID NO: 143724 - DNA, 975 bp, Artificial Sequence
  Description of Artificial Sequence: Synthetic coding sequence
atgttctgtggggactatgtgcagggcaccatcttccctgcccccaacttcaaccccatcatggatgcccagatgctgggcggggccctgcagggctttgactgtgacaaggacatgctgatcaacatcctgacccagcgctgcaatgcccagaggatgatgattgctgaggcctaccagagcatgtatggccgggacctgattggagacatgagggagcagctgagtgaccacttcaaggatgtgatggccggcctgatgtaccccccacccctgtatgatgcccacgagctgtggcacgccatgaagggcgtgggcacagatgagaactgcctgattgagatcctggccagcaggaccaatggagagatcttccagatgagggaggcctactgcctgcagtacagcaacaacctgcaggaggacatctacagcgagaccagcggccacttccgggacaccctgatgaacctggtgcagggcacccgggaggagggctacacagatcctgccatggccgcccaggatgccatggtgctgtgggaggcctgccagcagaagacaggagagcacaagaccatgctgcagatgatcctgtgcaacaagagctaccagcagctgcggctggtgttccaggagttccagaacatcagcggccaggacatggtggatgccatcaatgaatgttatgatggctacttccaggagctgctggtggccatcgtgctgtgtgtgcgggacaagccagcctactttgcctaccgcctgtacagcgccatccatgactttggcttccacaacaagacagtcatccgcatcctgattgcccggagtgaaattgacctgctgaccatcaggaagcgctacaaggagagatatggcaagagcctcttccatgacatccggaactttgccagcggccactacaagaaggccctgctggccatctgtgctggagatgctgaggactactag

SEQ ID NO: 143725 - DNA, 975 bp, Artificial Sequence
  Description of Artificial Sequence: Synthetic coding sequence
atgttctgcagcaacctggtgcagggcaccatcttccctgcccccaacttcaaccccatcatggatgcccagatgctgggcggggccctgcagggctttgactgtgacaaggacatgctgatcaacatcctgacccagcgctgcaatgcccagaggatgatgattgctgaggcctaccagagcatgtatggccgggacctgattggagacatgagggagcagctgagtgaccacttcaaggatgtgatggccggcctgatgtaccccccacccctgtatgatgcccacgagctgtggcacgccatgaagggcgtgggcacagatgagaactgcctgattgagatcctggccagcaggaccaatggagagatcttccagatgagggaggcctactgcctgcagtacagcaacaacctgcaggaggacatctacagcgagaccagcggccacttccgggacaccctgatgaacctggtgcagggcacccgggaggagggctacacagatcctgccatggccgcccaggatgccatggtgctgtgggaggcctgccagcagaagacaggagagcacaagaccatgctgcagatgatcctgtgcaacaagagctaccagcagctgcggctggtgttccaggagttccagaacatcagcggccaggacatggtggatgccatcaatgaatgttatgatggctacttccaggagctgctggtggccatcgtgctgtgtgtgcgggacaagccagcctactttgcctaccgcctgtacagcgccatccatgactttggcttccacaacaagacagtcatccgcatcctgattgcccggagtgaaattgacctgctgaccatcaggaagcgctacaaggagagatatggcaagagcctcttccatgacatccggaactttgccagcggccactacaagaaggccctgctggccatctgtgctggagatgctgaggactactag

SEQ ID NO: 143726 - DNA, 1518 bp, Artificial Sequence
  Description of Artificial Sequence: Synthetic coding sequence
atgagctacccaggctacccacctcctcctgggggctaccccccagctgcccctgggggcggcccctggggcggggccgcctacccacctcctccttccatgccacccatcggcctggacaacgtggccacctacgccggccagttcaaccaggactacctgagcggcatggccgccaacatgagcggcacctttggaggagccaacatgcccaacctgtacccaggggcccctggggccggctacccacctgtgcccccaggcggcttcggccagcccccatctgcccagcagcctgtgcccccctacggcatgtacccacctcctgggggcaacccccccagcaggatgcccagctacccaccctacccaggggcccctgtgcccggccagcccatgcctcctcctggccagcagcccccaggggcctacccaggccagccccctgtgacctacccaggccagccccctgtgcccctgcccggccagcagcagcctgtgcccagctacccaggctacccaggcagcggcaccgtgaccccagctgtgccccccacccagtttggcagccggggcaccatcacagatgcccctggctttgaccccctgagagatgctgaggtgctgaggaaggccatgaagggcttcggcacagatgagcaggccatcatcgactgcctgggcagccgcagcaacaagcagaggcagcagatcctgctgtccttcaagacagcctacggcaaggacctgatcaaggacctgaagtctgagctgagcggcaactttgagaagaccatcctggccctgatgaagacccctgtgctgtttgacatctatgagatcaaggaggccatcaagggcgtgggcacagatgaggcctgcctgattgagatcctggccagccgcagcaatgagcacatccgggagctgaacagagcctacaaggccgagttcaagaagaccctggaggaggccatccgcagtgacaccagcggccacttccagaggctgctgatcagcctgagccagggcaacagagatgagagcaccaacgtggacatgagcctggcccagagagatgcccaggagctgtatgctgctggagaaaatcggctgggcacagatgagagcaagttcaatgctgtgctgtgcagccgcagccgggcccacctggtggccgtgttcaatgagtaccagaggatgacaggccgggacatcgagaagagcatctgccgggagatgtctggggacctggaggagggcatgctggccgtggtgaagtgcctgaagaacaccccagccttctttgctgagcggctgaacaaggccatgagaggagctggcaccaaggacaggaccctcatccgcatcatggtgagccgctcagaaacagacctgctggacatccgctctgagtacaagaggatgtatggcaagagcctgtaccatgacatcagcggggacaccagcggggactacaggaagatcctgctgaagatctgtggcggcaatgactag

SEQ ID NO: 143727 - DNA, 1518 bp, Artificial Sequence; identical to SEQ ID NO: 143726
  Description of Artificial Sequence: Synthetic coding sequence

SEQ ID NO: 143728 - DNA, 489 bp, Artificial Sequence
  Description of Artificial Sequence: Synthetic coding sequence
atgagcctggcccagagagatgcccaggagctgtatgctgctggggagaaccggctgggcacagatgagagcaagttcaatgctgtgctgtgcagccgcagccgggcccacctggtggccgtgttcaatgagtaccagaggatgacaggccgggacatcgagaagagcatctgccgggagatgtctggggacctggaggagggcatgctggccgtggtgaagtgcctgaagaacaccccagccttctttgctgagcggctgaacaaggccatgagaggagctggcaccaaggacaggaccctcatccgcatcatggtgagccgctcagaaacagacctgctggacatccgctctgagtacaagaggatgtatggcaagagcctgtaccatgacatcagcagcatcagctgcatgcctgccagctatggccacctggaggaggccacctgcctggccctgaagctgctgcgggtggagggcaatgactag

SEQ ID NO: 143729 - DNA, 1518 bp, Artificial Sequence; identical to SEQ ID NO: 143726
  Description of Artificial Sequence: Synthetic coding sequence

SEQ ID NO: 143730 - DNA, 1518 bp, Artificial Sequence; identical to SEQ ID NO: 143726
  Description of Artificial Sequence: Synthetic coding sequence

SEQ ID NO: 143731 - DNA, 1518 bp, Artificial Sequence; identical to SEQ ID NO: 143726
  Description of Artificial Sequence: Synthetic coding sequence

SEQ ID NO: 143732 - DNA, 1239 bp, Artificial Sequence
  Description of Artificial Sequence: Synthetic coding sequence
atgaggggcagcagcaccaggaccatcagccgggagtgctggaggctgtgggccgcccccctgtgcccagctgcctgcagcagcctgtgggatgtgtccacccccaggaggaagcccaccctgcaggatgccctgatcagcgccatcccctacccaggccagccccctgtgacctacccaggccagccccctgtgcccctgcccggccagcagcagcctgtgcccagctacccaggctacccaggcagcggcaccgtgaccccagctgtgccccccacccagtttggcagccggggcaccatcacagatgcccctggctttgaccccctgagagatgctgaggtgctgaggaaggccatgaagggctttggaacagatgagcaggccatcatcgactgcctgggcagccgcagcaacaagcagaggcagcagatcctgctgtccttcaagacagcctacggcaaggacctgatcaaggacctgaagtctgagctgagcggcaactttgagaagaccatcctggccctgatgaagacccctgtgctgtttgacatctatgagatcaaggaggccatcaagggcgtgggcacagatgaggcctgcctgattgagatcctggccagccgcagcaatgagcacatccgggagctgaacagagcctacaaggccgagttcaagaagaccctggaggaggccatccgcagtgacaccagcggccacttccagaggctgctgatcagcctgagccagggcaacagagatgagagcaccaacgtggacatgagcctggcccagagagatgcccaggagctgtatgctgctggggagaaccggctgggcacagatgagagcaagttcaatgctgtgctgtgcagccgcagccgggcccacctggtggccgtgttcaatgagtaccagaggatgacaggccgggacatcgagaagagcatctgccgggagatgtctggggacctggaggagggcatgctggccgtggtgaagtgcctgaagaacaccccagccttctttgctgagcggctgaacaaggccatgagaggagctggcaccaaggacaggaccctcatccgcatcatggtgagccgctcagaaacagacctgctggacatccgctctgagtacaagaggatgtatggcaagagcctgtaccatgacatcagcggggacaccagcggggactacaggaagatcctgctgaagatctgtggcggcaatgactag

SEQ ID NO: 143733 - DNA, 453 bp, Artificial Sequence
  Description of Artificial Sequence: Synthetic coding sequence
atgagctacccaggctacccacctcctcctgggggctaccccccagctgcccctgggggcggcccctggggcggggccgcctacccacctcctccttccatgccacccatcggcctggacaacgtggccacctacgccggccagttcaaccaggactacctgagcggcatggccgccaacatgagcggcacctttggaggagccaacatgcccaacctgtacccaggggcccctggggccggctacccacctgtgcccccaggcggcttcggccagcccccatctgcccagcagcctgtgcccccctacggcatgtacccacctcctgggggcaacccccccagcaggatgcccagctacccaccctacccaggggcccctgtgcccggccagcccatgcctcctcctggccagcagcccccaggggcctacccaggccagccccctgtgtag

SEQ ID NO: 143734 - DNA, 1518 bp, Artificial Sequence; identical to SEQ ID NO: 143726
  Description of Artificial Sequence: Synthetic coding sequence

SEQ ID NO: 143735 - DNA, 615 bp, Artificial Sequence
  Description of Artificial Sequence: Synthetic coding sequence
atgagctacccaggctacccacctcctcctgggggctaccccccagctgcccctgggggcggcccctggggcggggccgcctacccacctcctccttccatgccacccatcggcctggacaacgtggccacctacgccggccagttcaaccaggactacctgagcggcatggccgccaacatgagcggcacctttggaggagccaacatgcccaacctgtacccaggggcccctggggccggctacccacctgtgcccccaggcggcttcggccagcccccatctgcccagcagcctgtgcccccctacggcatgtacccacctcctgggggcaacccccccagcaggatgcccagctacccaccctacccaggggcccctgtgcccggccagcccatgcctcctcctggccagcagcccccaggggcctacccaggccagccccctgtgacctacccaggccagccccctgtgcccctgcccggccagcagcagcctgtgcccagctacccaggctacccaggcagcggcaccgtgaccccagctgtgccccccacccagtttggcagccggggcaccatcacagatgcccctggctttgaccccctgaggtag

SEQ ID NO: 143736 - DNA, 447 bp, Artificial Sequence
  Description of Artificial Sequence: Synthetic coding sequence
tgagaaaatcggctgggcacagatgagagcaagttcaatgctgtgctgtgcagccgcagccgggcccacctggtggccgtgttcaatgagtaccagaggatgacaggccgggacatcgagaagagcatctgccgggagatgtctggggacctggaggagggcatgctggccgtggtgaagtgcctgaagaacaccccagccttctttgctgagcggctgaacaaggccatgagaggagctggcaccaaggacaggaccctcatccgcatcatggtgagccgctcagaaacagacctgctggacatccgctctgagtacaagaggatgtatggcaagagcctgtaccatgacatcagcagcatcagctgcatgcctgccagctatggccacctggaggaggccacctgcctggccctgaagctgctgcgggtggagggcaatgactag

SEQ ID NO: 143737 - DNA, 1518 bp, Artificial Sequence; identical to SEQ ID NO: 143726
  Description of Artificial Sequence: Synthetic coding sequence

SEQ ID NO: 143738 - DNA, 1419 bp, Artificial Sequence
  Description of Artificial Sequence: Synthetic coding sequence
atgccacccatcggcctggacaacgtggccacctacgccggccagttcaaccaggactacctgagcggcatggccgccaacatgagcggcaccttcggcggggccaacatgcccaacctgtacccaggggcccctggagctggctacccacctgtgcccccaggcggcttcggccagccccccagcgcccagcagcctgtgcccccctacggcatgtacccacctcctgggggcaacccccccagcaggatgcccagctacccaccctacccaggggcccctgtgcccggccagcccatgcctcctcctggccagcagcccccaggggcctacccaggccagccccctgtgacctacccaggccagccccctgtgcccctgcccggccagcagcagcctgtgcccagctacccaggctacccaggcagcggcaccgtgaccccagctgtgccccccacccagtttggcagccggggcaccatcacagatgcccctggctttgaccccctgagagatgctgaggtgctgaggaaggccatgaagggctttggaacagatgagcaggccatcatcgactgcctgggcagccgcagcaacaagcagaggcagcagatcctgctgtccttcaagacagcctacggcaaggacctgatcaaggacctgaagtctgagctgagcggcaactttgagaagaccatcctggccctgatgaagacccctgtgctgtttgacatctatgagatcaaggaggccatcaagggcgtgggcacagatgaggcctgcctgattgagatcctggccagccgcagcaatgagcacatccgggagctgaacagagcctacaaggccgagttcaagaagaccctggaggaggccatccgcagtgacaccagcggccacttccagaggctgctgatcagcctgagccagggcaacagagatgagagcaccaacgtggacatgagcctggcccagagagatgcccaggagctgtatgctgctggggagaaccggctgggcacagatgagagcaagttcaatgctgtgctgtgcagccgcagccgggcccacctggtggccgtgttcaatgagtaccagaggatgacaggccgggacatcgagaagagcatctgccgggagatgtctggggacctggaggagggcatgctggccgtggtgaagtgcctgaagaacaccccagccttctttgctgagcggctgaacaaggccatgagaggagctggcaccaaggacaggaccctcatccgcatcatggtgagccgctcagaaacagacctgctggacatccgctctgagtacaagaggatgtatggcaagagcctgtaccatgacatcagcggggacaccagcggggactacaggaagatcctgctgaagatctgtggcggcaatgactag

SEQ ID NO: 143739 - DNA, 1074 bp, Artificial Sequence
  Description of Artificial Sequence: Synthetic coding sequence
atgggccggcagctggccggctgtggagatgctgggaagaaggccagcttcaagatgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagcaggaccaaccaggagctgcaggagatcaacagagtgtacaaggagatgtacaagacagacctggagaaggacatcatcagtgacaccagcggggacttcaggaagctgatggtggccctggccaagggccggcgggcagaagatggcagcgtcatcgactatgagctgattgaccaggatgcccgggacctgtatgatgctggggtgaagaggaagggcacagatgtgcccaagtggatcagcatcatgacagagaggtctgtgccccacctgcagaaggtgtttgaccgctacaagagctacagcccctatgacatgctggagagcatcaggaaggaggtgaagggggacctggagaatgccttcctgaacctggtgcagtgcatccagaacaagcccctgtactttgctgaccggctgtatgacagcatgaagggcaagggcacccgggacaaggtgctgatccgcatcatggtgagccgctctgaggtggacatgctgaagatccgctctgagttcaagaggaaatatggcaagagcctgtactactacatccagcaggacaccaagggggactaccagaaggccctgctgtacctgtgtggaggagatgactag

SEQ ID NO: 143740 - DNA, 1020 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagcaggaccaaccaggagctgcaggagatcaacagagtgtacaaggagatgtacaagacagacctggagaaggacatcatcagtgacaccagcggggacttcaggaagctgatggtggccctggccaagggccggcgggcagaagatggcagcgtcatcgactatgagctgattgaccaggatgcccgggacctgtatgatgctggggtgaagaggaagggcacagatgtgcccaagtggatcagcatcatgacagagaggtctgtgccccacctgcagaaggtgtttgaccgctacaagagctacagcccctatgacatgctggagagcatcaggaaggaggtgaagggggacctggagaatgccttcctgaacctggtgcagtgcatccagaacaagcccctgtactttgctgaccggctgtatgacagcatgaagggcaagggcacccgggacaaggtgctgatccgcatcatggtgagccgctctgaggtggacatgctgaagatccgctctgagttcaagaggaaatatggcaagagcctgtactactacatccagcaggacaccaagggggactaccagaaggccctgctgtacctgtgtggaggagatgactag

SEQ ID NO: 143741 - DNA, 1020 bp, Artificial Sequence; identical to SEQ ID NO: 143740
  Description of Artificial Sequence: Synthetic coding sequence

SEQ ID NO: 143742 - DNA, 1020 bp, Artificial Sequence; identical to SEQ ID NO: 143740
  Description of Artificial Sequence: Synthetic coding sequence

SEQ ID NO: 143743 - DNA, 246 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaagtag

SEQ ID NO: 143744 - DNA, 531 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagcaggaccaaccaggagctgcaggagatcaacagagtgtacaaggagatgtacaagacagacctggagaaggacatcatcagtgacaccagcggggacttcaggaagctgatggtggccctggccaagtag

SEQ ID NO: 143745 - DNA, 144 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagtag

SEQ ID NO: 143746 - DNA, 405 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagctag

SEQ ID NO: 143747 - DNA, 402 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgctag

SEQ ID NO: 143748 - DNA, 450 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagcaggaccaaccaggagctgcaggagatcaacagagtgtacaaggagtag

SEQ ID NO: 143749 - DNA, 198 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaactag

SEQ ID NO: 143750 - DNA, 360 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagtag

SEQ ID NO: 143751 - DNA, 771 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagcaggaccaaccaggagctgcaggagatcaacagagtgtacaaggagatgtacaagacagacctggagaaggacatcatcagtgacaccagcggggacttcaggaagctgatggtggccctggccaagggccggcgggcagaagatggcagcgtcatcgactatgagctgattgaccaggatgcccgggacctgtatgatgctggggtgaagaggaagggcacagatgtgcccaagtggatcagcatcatgacagagaggtctgtgccccacctgcagaaggtgtttgaccgctacaagagctacagcccctatgacatgctggagagcatcaggaaggaggtgaagggggacctggagaatgccttctag

SEQ ID NO: 143752 - DNA, 360 bp, Artificial Sequence; identical to SEQ ID NO: 143750
  Description of Artificial Sequence: Synthetic coding sequence

SEQ ID NO: 143753 - DNA, 531 bp, Artificial Sequence; identical to SEQ ID NO: 143744
  Description of Artificial Sequence: Synthetic coding sequence

SEQ ID NO: 143754 - DNA, 684 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgatgccagcgagctgaaggcctccatgaagggcctgggcacagatgaggacagcctgattgagatcatctgcagcaggaccaaccaggagctgcaggagatcaacagagtgtacaaggagatgtacaagacagacctggagaaggacatcatcagtgacaccagcggggacttcaggaagctgatggtggccctggccaagggccggcgggcagaagatggcagcgtcatcgactatgagctgattgaccaggatgcccgggacctgtatgatgctggggtgaagaggaagggcacagatgtgcccaagtggatcagcatcatgacagagaggtctgtgccccacctgcagaagtag

SEQ ID NO: 143755 - DNA, 531 bp, Artificial Sequence; identical to SEQ ID NO: 143744
  Description of Artificial Sequence: Synthetic coding sequence

SEQ ID NO: 143756 - DNA, 333 bp, Artificial Sequence
  Description of Artificial Sequence: Synthetic coding sequence
atgagcacagtgcatgagatcctgtgcaagctgagcctggagggggaccacagcaccccacccagcgcctacggctctgtgaaggcctacaccaactttgatgctgagagagatgccctgaacatcgagacagccatcaagaccaagggcgtggatgaggtgaccatcgtgaacatcctgaccaacagaagcaatgcccagaggcaggacatcgcctttgcctaccagaggaggaccaagaaggagctggccagcgccctgaagagcgccctgagcggccacctggagaccgtcatcctgggcctgctgaagaccccagcccagtatgactag

SEQ ID NO: 143757 - DNA, 972 bp, Artificial Sequence
  Description of Artificial Sequence: Synthetic coding sequence
atggccagcatctgggtgggccaccggggcaccgtgcgggactacccagacttcagccccagcgtggatgctgaggccatccagaaggccatccggggcatcggcacagatgagaagatgctgatcagcatcctgacagagaggagcaatgcccagaggcagctgattgtgaaggagtaccaggccgcctacggcaaggagctgaaggatgacctgaagggggacctgagcggccactttgagcacctgatggtggccctggtgaccccacctgctgtgtttgatgccaagcagctgaagaagtccatgaagggggccggcaccaatgaagatgccctgattgagatcctgaccaccaggaccagccggcagatgaaggacatcagccaggcctactacacagtgtacaagaagagcctgggagatgacatcagcagcgagaccagcggggacttcaggaaggccctgctgaccctggctgatggaagaagagatgagagcctgaaggtggatgagcacctggccaagcaggatgcccagatcctgtacaaggctggagaaaatcgctggggcacagatgaggacaagttcacagagatcctgtgcctgcgctccttcccccagctgaagctgacctttgatgagtacagaaacatcagccagaaggacatcgtggacagcatcaagggggagctgagcggccactttgaggacctgctgctggccatcgtgaactgtgtgaggaacaccccagccttcctggccgagcggctgcaccgggccctgaagggcattggaacagatgagttcaccctgaaccgcatcatggtgagccgctcagaaattgacctgctggacatcagaacagagttcaagaagcactacggctacagcctgtacagcgccatcaagagtgacaccagcggggactatgagatcaccctgctgaagatctgtggaggagatgactag

SEQ ID NO: 143758 - DNA, 405 bp, Artificial Sequence
  Description of Artificial Sequence: Synthetic coding sequence
atggccagcatctgggtgggccaccggggcaccgtgcgggactacccagacttcagccccagcgtggatgctgaggccatccagaaggccatccggggcatcggcacagatgagaagatgctgatcagcatcctgacagagaggagcaatgcccagaggcagctgattgtgaaggagtaccaggccgcctacggcaaggagctgaaggatgacctgaagggggacctgagcggccactttgagcacctgatggtggccctggtgaccccacctgctgtgtttgatgccaagcagctgaagaagtccatgaagggggccggcaccaatgaagatgccctgattgagatcctgaccaccaggaccagccggcagatgaaggacatcagccaggcctactacacctag

SEQ ID NO: 143759 - DNA, 315 bp, Artificial Sequence
  Description of Artificial Sequence: Synthetic coding sequence
atggccagcatctgggtgggccaccggggcaccgtgcgggactacccagacttcagccccagcgtggatgctgaggccatccagaaggccatccggggcatcggcacagatgagaagatgctgatcagcatcctgacagagaggagcaatgcccagaggcagctgattgtgaaggagtaccaggccgcctacggcaaggagctgaaggatgacctgaagggggacctgagcggccactttgagcacctgatggtggccctggtgaccccacctgctgtgtttgatgccaagcagctgaagaagtccatgaagtag

SEQ ID NO: 143760 - DNA, 465 bp, Artificial Sequence
  Description of Artificial Sequence: Synthetic coding sequence
atggccagcatctgggtgggccaccggggcaccgtgcgggactacccagacttcagccccagcgtggatgctgaggccatccagaaggccatccggggcatcggcacagatgagaagatgctgatcagcatcctgacagagaggagcaatgcccagaggcagctgattgtgaaggagtaccaggccgcctacggcaaggagctgaaggatgacctgaagggggacctgagcggccactttgagcacctgatggtggccctggtgaccccacctgctgtgtttgatgccaagcagctgaagaagtccatgaagggggccggcaccaatgaagatgccctgattgagatcctgaccaccaggaccagccggcagatgaaggacatcagccaggcctactacacagtgtacaagaagagcctgggagatgacatcagcagcgagaccagcggggacttcaggaagtag

SEQ ID NO: 143761 - DNA, 966 bp, Artificial Sequence
  Description of Artificial Sequence: Synthetic coding sequence
atggccatggccaccaagggcggcaccgtgaaggccgccagcggcttcaatgccatggaggatgcccagaccctgaggaaggccatgaagggcctgggcacagatgaagatgccatcatctctgtgctggcctacagaaacacagcccagaggcaggagatcagaacagcctacaagagcaccatcggccgggacctgattgatgacctgaagtctgagctgagcggcaactttgagcaggtgattgtgggcatgatgacccccaccgtgctgtatgatgtgcaggagctgcggcgggccatgaagggggccggcacagatgagggctgcctgattgagatcctggccagcaggaccccagaggagatccgccgcatcagccagacctaccagcagcagtatggccgcagcctggaggatgacatccgcagtgacaccagcttcatgttccagagggtgctggtgtccctgtctgctgggggcagagatgagggcaactacctggatgatgccctggtgcggcaggatgcccaggacctgtatgaagctggggagaagaagtggggcacagatgaggtgaagttcctgactgtgctgtgcagcaggaacagaaaccacctgctgcacgtgtttgatgagtacaagaggatcagccagaaggacatcgagcagagcatcaagtctgagaccagcggcagctttgaagatgccctgctggccatcgtgaagtgcatgaggaacaagagcgcctactttgctgagaagctgtacaagtccatgaagggcctgggcacagatgacaacaccctcatccgggtgatggtgtccagagctgagattgacatgctggacatccgggcccacttcaagaggctgtatggcaagagcctgtacagcttcatcaagggggacaccagcggggactacaggaaggtgctgctggtgctgtgtggaggagatgactag

SEQ ID NO: 143762 - DNA, 900 bp, Artificial Sequence
  Description of Artificial Sequence: Synthetic coding sequence
atggccatggccaccaagggcggcaccgtgaaggccgccagcggcttcaatgccatggaggatgcccagaccctgaggaaggccatgaagggcctgggcacagatgaagatgccatcatctctgtgctggcctacagaaacacagcccagaggcaggagatcagaacagcctacaagagcaccatcggccgggacctgattgatgacctgaagtctgagctgagcggcaactttgagcagggcgccggcacagatgagggctgcctgattgagatcctggccagcaggaccccagaggagatccgccgcatcagccagacctaccagcagcagtatggccgcagcctggaggatgacatccgcagtgacaccagcttcatgttccagagggtgctggtgtccctgtctgctgggggcagagatgagggcaactacctggatgatgccctggtgcggcaggatgcccaggacctgtatgaagctggggagaagaagtggggcacagatgaggtgaagttcctgactgtgctgtgcagcaggaacagaaaccacctgctgcacgtgtttgatgagtacaagaggatcagccagaaggacatcgagcagagcatcaagtctgagaccagcggcagctttgaagatgccctgctggccatcgtgaagtgcatgaggaacaagagcgcctactttgctgagaagctgtacaagtccatgaagggcctgggcacagatgacaacaccctcatccgggtgatggtgtccagagctgagattgacatgctggacatccgggcccacttcaagaggctgtatggcaagagcctgtacagcttcatcaagggggacaccagcggggactacaggaaggtgctgctggtgctgtgtggaggagatgactag

SEQ ID NO: 143763 - DNA, 714 bp, Artificial Sequence
  Description of Artificial Sequence: Synthetic coding sequence
atgatgacccccaccgtgctgtatgatgtgcaggagctgcggcgggccatgaagggggccggcacagatgagggctgcctgattgagatcctggccagcaggaccccagaggagatccgccgcatcagccagacctaccagcagcagtatggccgcagcctggaggatgacatccgcagtgacaccagcttcatgttccagagggtgctggtgtccctgtctgctgggggcagagatgagggcaactacctggatgatgccctggtgcggcaggatgcccaggacctgtatgaagctggggagaagaagtggggcacagatgaggtgaagttcctgactgtgctgtgcagcaggaacagaaaccacctgctgcacgtgtttgatgagtacaagaggatcagccagaaggacatcgagcagagcatcaagtctgagaccagcggcagctttgaagatgccctgctggccatcgtgaagtgcatgaggaacaagagcgcctactttgctgagaagctgtacaagtccatgaagggcctgggcacagatgacaacaccctcatccgggtgatggtgtccagagctgagattgacatgctggacatccgggcccacttcaagaggctgtatggcaagagcctgtacagcttcatcaagggggacaccagcggggactacaggaaggtgctgctggtgctgtgtggaggagatgactag

SEQ ID NO: 143764 - DNA, 963 bp, Artificial Sequence
  Description of Artificial Sequence: Synthetic coding sequence
atggcccaggtgctgcggggcaccgtgacagacttccctggctttgatgaaagagcagatgctgagaccctgaggaaggccatgaagggcctgggcacagatgaggagagcatcctgaccctgctgaccagccgcagcaatgcccagaggcaggagatctctgctgccttcaagaccctgtttggccgggacctgctggatgacctgaagtctgagctgaccgggaagtttgagaagctgattgtggccctgatgaagcccagccggctgtatgatgcctatgagctgaagcacgccctgaagggagctggcaccaatgagaaggtgctgacagagatcatcgccagcaggaccccagaggagctgcgggccatcaagcaggtgtatgaggaggagtatggcagcagcctggaggatgatgtggtgggggacaccagcggctactaccagaggatgctggtggtgctgctgcaggccaacagagatcctgatgctggcattgatgaggcccaggtggagcaggatgcccaggccctcttccaggccggggagctgaagtggggcacagatgaggagaagttcatcaccatcttcggcaccaggtctgtgagccacctgaggaaggtgtttgacaagtacatgaccatcagcggcttccagatcgaggagaccatcgaccgggagaccagcggcaacctggagcagctgctgctggccgtggtgaagagcatccgcagcatcccagcctacctggccgagaccctgtactatgccatgaagggggccggcacagatgaccacaccctcatccgggtgatggtgagccgctcagaaattgacctcttcaacatcaggaaggagttcaggaagaactttgccaccagcctgtacagcatgatcaagggggacaccagcggggactacaagaaggccctgctgctgctgtgtggggaggatgactag

SEQ ID NO: 143765 - DNA, 2022 bp, Artificial Sequence
  Description of Artificial Sequence: Synthetic coding sequence
atggccaagccagcccagggcgccaagtaccggggcagcatccatgacttccctggctttgaccccaaccaggatgctgaggccctgtacacagccatgaagggcttcggcagtgacaaggaggccatcctggacatcatcaccagccgcagcaaccggcagaggcaggaggtgtgccagagctacaagagcctgtatggcaaggacctgattgctgacctgaagtatgagctgaccgggaagtttgagcggctcatcgtgggcctgatgaggcccccagcctactgtgatgccaaggagatcaaggatgccatcagcggcatcggcacagatgagaagtgcctgattgagatcctggccagcaggaccaatgagcagatgcaccagctggtggccgcctacaaggatgcctatgaaagagacctggaggccgacatcattggagacaccagcggccacttccagaagatgctggtggtgctgctgcagggcacccgggaggaggatgatgtggtgtctgaggacctggtgcagcaggatgtgcaggacctgtatgaagctggggagctgaagtggggcacagatgaggcccagttcatctacatcctgggcaacagaagcaagcagcacctgcggctggtgtttgatgagtacctgaagaccaccgggaagcccatcgaggccagcatccggggggagctgagcggggactttgagaagctgatgctggccgtggtgaagtgcatccgcagcaccccagagtactttgctgagcggctcttcaaggccatgaagggcctgggcacccgggacaacaccctcatccgcatcatggtgagccgctctgagctggacatgctggacatccgggagatcttccgcaccaagtatgagaagagcctgtacagcatgatcaagaatgacaccagcggggagtacaagaagaccctgctgaagctgtctggaggagatgatgatgctgctggccagttcttccctgaggccgcccaggtggcctaccagatgtgggagctgtctgctgtggcccgggtggagctgaagggcaccgtgcggcctgccaatgacttcaacccagatgctgatgccaaggccctgaggaaggccatgaagggcctgggcacagatgaggacaccatcatcgacatcatcacccacaggagcaatgtgcagaggcagcagatccggcagaccttcaagagccacttcggccgggacctgatgacagacctgaagtctgagatcagcggggacctggcccggctcatcctgggcctgatgatgcccccagcccactatgatgccaagcagctgaagaaggccatggagggcgccggcacagatgagaaggccctgattgagatcctggccaccaggaccaatgctgagatccgggccatcaatgaggcctacaaggaggactaccacaagagcctggaggatgccctgagcagtgacaccagcggccacttccgccgcatcctgatcagcctggccaccggccaccgggaggagggcggggagaacctggaccaggccagagaagatgcccaggtggccgctgagatcctggagattgctgacaccccatctggggacaagaccagcctggagacccgcttcatgaccatcctgtgcaccaggagctacccccacctgcggcgggtcttccaggagttcatcaagatgaccaactatgatgtggagcacaccatcaagaaggagatgtctggagatgtgagagatgcctttgtggccatcgtgcagagcgtgaagaacaagcccctcttctttgctgacaagctgtacaagtccatgaagggagctggaacagatgagaagaccctgacccgcatcatggtgagccgctcagaaattgacctgctgaacatccggcgggagttcatcgagaagtatgacaagagcctgcaccaggccattgaaggagacaccagcggggacttcctgaaggccctgctggccctgtgtggcggggaggactag

SEQ ID NO: 143766 - DNA, 2004 bp, Artificial Sequence
  Description of Artificial Sequence: Synthetic coding sequence
atggccaagccagcccagggcgccaagtaccggggcagcatccatgacttccctggctttgaccccaaccaggatgctgaggccctgtacacagccatgaagggcttcggcagtgacaaggaggccatcctggacatcatcaccagccgcagcaaccggcagaggcaggaggtgtgccagagctacaagagcctgtatggcaaggacctgattgctgacctgaagtatgagctgaccgggaagtttgagcggctcatcgtgggcctgatgaggcccccagcctactgtgatgccaaggagatcaaggatgccatcagcggcatcggcacagatgagaagtgcctgattgagatcctggccagcaggaccaatgagcagatgcaccagctggtggccgcctacaaggatgcctatgaaagagacctggaggccgacatcattggagacaccagcggccacttccagaagatgctggtggtgctgctgcagggcacccgggaggaggatgatgtggtgtctgaggacctggtgcagcaggatgtgcaggacctgtatgaagctggggagctgaagtggggcacagatgaggcccagttcatctacatcctgggcaacagaagcaagcagcacctgcggctggtgtttgatgagtacctgaagaccaccgggaagcccatcgaggccagcatccggggggagctgagcggggactttgagaagctgatgctggccgtggtgaagtgcatccgcagcaccccagagtactttgctgagcggctcttcaaggccatgaagggcctgggcacccgggacaacaccctcatccgcatcatggtgagccgctctgagctggacatgctggacatccgggagatcttccgcaccaagtatgagaagagcctgtacagcatgatcaagaatgacaccagcggggagtacaagaagaccctgctgaagctgtctggaggagatgatgatgctgctggccagttcttccctgaggccgcccaggtggcctaccagatgtgggagctgtctgctgtggcccgggtggagctgaagggcaccgtgcggcctgccaatgacttcaacccagatgctgatgccaaggccctgaggaaggccatgaagggcctgggcacagatgaggacaccatcatcgacatcatcacccacaggagcaatgtgcagaggcagcagatccggcagaccttcaagagccacttcggccgggacctgatgacagacctgaagtctgagatcagcggggacctggcccggctcatcctgggcctgatgatgcccccagcccactatgatgccaagcagctgaagaaggccatggagggcgccggcacagatgagaaggccctgattgagatcctggccaccaggaccaatgctgagatccgggccatcaatgaggcctacaaggaggactaccacaagagcctggaggatgccctgagcagtgacaccagcggccacttccgccgcatcctgatcagcctggccaccggccaccgggaggagggcggggagaacctggaccaggccagagaagatgcccaggagattgctgacaccccatctggggacaagaccagcctggagacccgcttcatgaccatcctgtgcaccaggagctacccccacctgcggcgggtcttccaggagttcatcaagatgaccaactatgatgtggagcacaccatcaagaaggagatgtctggagatgtgagagatgcctttgtggccatcgtgcagagcgtgaagaacaagcccctcttctttgctgacaagctgtacaagtccatgaagggagctggaacagatgagaagaccctgacccgcatcatggtgagccgctcagaaattgacctgctgaacatccggcgggagttcatcgagaagtatgacaagagcctgcaccaggccattgaaggagacaccagcggggacttcctgaaggccctgctggccctgtgtggcggggaggactag

SEQ ID NO: 143767 - DNA, 333 bp, Artificial Sequence
  Description of Artificial Sequence: Synthetic coding sequence
atggccaagccagcccagggcgccaagtaccggggcagcatccatgacttccctggctttgaccccaaccaggatgctgaggccctgtacacagccatgaagggcttcggcagtgacaaggaggccatcctggacatcatcaccagccgcagcaaccggcagaggcaggaggtgtgccagagctacaagagcctgtatggcaaggacctgattgctgacctgaagtatgagctgaccgggaagtttgagcggctcatcgtgggcctgatgaggcccccagcctactgtgatgccaaggagatcaaggatgccatcagcggcatcggcacctag

SEQ ID NO: 143768 - DNA, 1926 bp, Artificial Sequence
  Description of Artificial Sequence: Synthetic coding sequence
atgaagggcttcggcagtgacaaggaggccatcctggacatcatcaccagccgcagcaaccggcagaggcaggaggtgtgccagagctacaagagcctgtatggcaaggacctgattgctgacctgaagtatgagctgaccgggaagtttgagcggctcatcgtgggcctgatgaggcccccagcctactgtgatgccaaggagatcaaggatgccatcagcggcatcggcacagatgagaagtgcctgattgagatcctggccagcaggaccaatgagcagatgcaccagctggtggccgcctacaaggatgcctatgaaagagacctggaggccgacatcattggagacaccagcggccacttccagaagatgctggtggtgctgctgcagggcacccgggaggaggatgatgtggtgtctgaggacctggtgcagcaggatgtgcaggacctgtatgaagctggggagctgaagtggggcacagatgaggcccagttcatctacatcctgggcaacagaagcaagcagcacctgcggctggtgtttgatgagtacctgaagaccaccgggaagcccatcgaggccagcatccggggggagctgagcggggactttgagaagctgatgctggccgtggtgaagtgcatccgcagcaccccagagtactttgctgagcggctcttcaaggccatgaagggcctgggcacccgggacaacaccctcatccgcatcatggtgagccgctctgagctggacatgctggacatccgggagatcttccgcaccaagtatgagaagagcctgtacagcatgatcaagaatgacaccagcggggagtacaagaagaccctgctgaagctgtctggaggagatgatgatgctgctggccagttcttccctgaggccgcccaggtggcctaccagatgtgggagctgtctgctgtggcccgggtggagctgaagggcaccgtgcggcctgccaatgacttcaacccagatgctgatgccaaggccctgaggaaggccatgaagggcctgggcacagatgaggacaccatcatcgacatcatcacccacaggagcaatgtgcagaggcagcagatccggcagaccttcaagagccacttcggccgggacctgatgacagacctgaagtctgagatcagcggggacctggcccggctcatcctgggcctgatgatgcccccagcccactatgatgccaagcagctgaagaaggccatggagggcgccggcacagatgagaaggccctgattgagatcctggccaccaggaccaatgctgagatccgggccatcaatgaggcctacaaggaggactaccacaagagcctggaggatgccctgagcagtgacaccagcggccacttccgccgcatcctgatcagcctggccaccggccaccgggaggagggcggggagaacctggaccaggccagagaagatgcccaggtggccgctgagatcctggagattgctgacaccccatctggggacaagaccagcctggagacccgcttcatgaccatcctgtgcaccaggagctacccccacctgcggcgggtcttccaggagttcatcaagatgaccaactatgatgtggagcacaccatcaagaaggagatgtctggagatgtgagagatgcctttgtggccatcgtgcagagcgtgaagaacaagcccctcttctttgctgacaagctgtacaagtccatgaagggagctggaacagatgagaagaccctgacccgcatcatggtgagccgctcagaaattgacctgctgaacatccggcgggagttcatcgagaagtatgacaagagcctgcaccaggccattgaaggagacaccagcggggacttcctgaaggccctgctggccctgtgtggcggggaggactag

SEQ ID NO: 143769 - DNA, 1644 bp, Artificial Sequence
  Description of Artificial Sequence: Synthetic coding sequence
atgcaccagctggtggccgcctacaaggatgcctatgaaagagacctggaggccgacatcattggagacaccagcggccacttccagaagatgctggtggtgctgctgcagggcacccgggaggaggatgatgtggtgtctgaggacctggtgcagcaggatgtgcaggacctgtatgaagctggggagctgaagtggggcacagatgaggcccagttcatctacatcctgggcaacagaagcaagcagcacctgcggctggtgtttgatgagtacctgaagaccaccgggaagcccatcgaggccagcatccggggggagctgagcggggactttgagaagctgatgctggccgtggtgaagtgcatccgcagcaccccagagtactttgctgagcggctcttcaaggccatgaagggcctgggcacccgggacaacaccctcatccgcatcatggtgagccgctctgagctggacatgctggacatccgggagatcttccgcaccaagtatgagaagagcctgtacagcatgatcaagaatgacaccagcggggagtacaagaagaccctgctgaagctgtctggaggagatgatgatgctgctggccagttcttccctgaggccgcccaggtggcctaccagatgtgggagctgtctgctgtggcccgggtggagctgaagggcaccgtgcggcctgccaatgacttcaacccagatgctgatgccaaggccctgaggaaggccatgaagggcctgggcacagatgaggacaccatcatcgacatcatcacccacaggagcaatgtgcagaggcagcagatccggcagaccttcaagagccacttcggccgggacctgatgacagacctgaagtctgagatcagcggggacctggcccggctcatcctgggcctgatgatgcccccagcccactatgatgccaagcagctgaagaaggccatggagggcgccggcacagatgagaaggccctgattgagatcctggccaccaggaccaatgctgagatccgggccatcaatgaggcctacaaggaggactaccacaagagcctggaggatgccctgagcagtgacaccagcggccacttccgccgcatcctgatcagcctggccaccggccaccgggaggagggcggggagaacctggaccaggccagagaagatgcccaggtggccgctgagatcctggagattgctgacaccccatctggggacaagaccagcctggagacccgcttcatgaccatcctgtgcaccaggagctacccccacctgcggcgggtcttccaggagttcatcaagatgaccaactatgatgtggagcacaccatcaagaaggagatgtctggagatgtgagagatgcctttgtggccatcgtgcagagcgtgaagaacaagcccctcttctttgctgacaagctgtacaagtccatgaagggagctggaacagatgagaagaccctgacccgcatcatggtgagccgctcagaaattgacctgctgaacatccggcgggagttcatcgagaagtatgacaagagcctgcaccaggccattgaaggagacaccagcggggacttcctgaaggccctgctggccctgtgtggcggggaggactag

SEQ ID NO: 143770 - DNA, 1467 bp, Artificial Sequence
  Description of Artificial Sequence: Synthetic coding sequence
atgagctacccaggctacccacccaccggctacccacccttccctggctaccccccagctggccaggagagcagcttccccccatctggccagtacccctaccccagcggcttcccccccatgggcggcggggcctacccccaggtgcccagcagcggctacccaggagctgggggctacccagcccctgggggctacccagcccctgggggctacccaggggccccccagcccggcggggcccccagctacccaggagtgcccccaggccagggctttggagtgcccccaggaggagctggcttcagcggctacccccagccccccagccagagctatggaggcggccctgcccaggtgcccctgcccggcggcttccctgggggccagatgcccagccagtacccaggcggccagcccacctaccccagccagatcaacacagacagcttcagcagctaccctgtgttcagccctgtgtccctggactacagcagcgagcccgccaccgtgacccaggtgacccagggcaccatccggcctgctgccaactttgatgccatcagagatgctgagatcctgaggaaggccatgaagggctttggaacagatgagcaggccatcgtggatgtggtggccaacagaagcaatgaccagaggcagaagatcaaggccgccttcaagaccagctatggcaaggacctgatcaaggacctgaagtctgagctgagcggcaacatggaggagctgatcctggccctcttcatgccacccacctactatgatgcctggagcctgaggaaggccatgcagggcgccggcacccaggagcgggtgctgattgagatcctgtgcaccaggaccaaccaggagatccgggagatcgtgcgctgctaccagagcgagtttggccgggacctggagaaggacatccgcagtgacaccagcggccactttgagcggctgctggtgtccatgtgccagggcaacagagatgagaaccagagcatcaaccaccagatggcccaggaggatgcccagaggctgtaccaggccggggagggccgcctgggcacagatgagagctgcttcaacatgatcctggccaccaggagcttcccccagctgcgggccaccatggaggcctacagcaggatggccaacagagacctgctgagctctgtgtcccgggagttcagcggctacgtggagagcggcctgaagaccatcctgcagtgtgccctgaacagacctgccttctttgctgagcggctgtactatgccatgaagggggccggcacagatgacagcaccctggtgcgcatcgtggtgaccaggagtgaaattgacctggtgcagatcaagcagatgtttgcccagatgtaccagaagaccctgggcaccatgattgctggggacaccagcggggactacagaaggctgctgctggccatcgtgggccagtag

SEQ ID NO: 143771 - DNA, 1401 bp, Artificial Sequence
  Description of Artificial Sequence: Synthetic coding sequence
atgagctacccaggctacccacccaccggctacccacccttccctggctaccccccagctggccaggagagcagcttccccccatctggccagtacccctaccccagcggcttcccccccatgggcggcggggcctacccccaggtgcccagcagcggctacccaggagctgggggctacccagcccctgggggctacccagcccctgggggctacccaggggccccccagcccggcggggcccccagctacccaggagtgcccccaggccagggctttggagtgcccccaggaggagctggcttcagcggctacccccagccccccagccagagctatggaggcggccctgcccaggtgcccctgcccggcggcttccctgggggccagatgcccagccagtacccaggcggccagcccacctaccccagccagcctgccaccgtgacccaggtgacccagggcaccatccggcctgctgccaactttgatgccatcagagatgctgagatcctgaggaaggccatgaagggctttggaacagatgagcaggccatcgtggatgtggtggccaacagaagcaatgaccagaggcagaagatcaaggccgccttcaagaccagctatggcaaggacctgatcaaggacctgaagtctgagctgagcggcaacatggaggagctgatcctggccctcttcatgccacccacctactatgatgcctggagcctgaggaaggccatgcagggcgccggcacccaggagcgggtgctgattgagatcctgtgcaccaggaccaaccaggagatccgggagatcgtgcgctgctaccagagcgagtttggccgggacctggagaaggacatccgcagtgacaccagcggccactttgagcggctgctggtgtccatgtgccagggcaacagagatgagaaccagagcatcaaccaccagatggcccaggaggatgcccagaggctgtaccaggccggggagggccgcctgggcacagatgagagctgcttcaacatgatcctggccaccaggagcttcccccagctgcgggccaccatggaggcctacagcaggatggccaacagagacctgctgagctctgtgtcccgggagttcagcggctacgtggagagcggcctgaagaccatcctgcagtgtgccctgaacagacctgccttctttgctgagcggctgtactatgccatgaagggggccggcacagatgacagcaccctggtgcgcatcgtggtgaccaggagtgaaattgacctggtgcagatcaagcagatgtttgcccagatgtaccagaagaccctgggcaccatgattgctggggacaccagcggggactacagaaggctgctgctggccatcgtgggccagtag

SEQ ID NO: 143772 - DNA, 435 bp, Artificial Sequence
  Description of Artificial Sequence: Synthetic coding sequence
atgagctacccaggctacccacccaccggctacccacccttccctggctaccccccagctggccaggagagcagcttccccccatctggccagtacccctaccccagcggcttcccccccatgggcggcggggcctacccccaggtgcccagcagcggctacccaggagctgggggctacccagcccctgggggctacccagcccctgggggctacccaggggccccccagcccggcggggcccccagctacccaggagtgcccccaggccagggctttggagtgcccccaggaggagctggcttcagcggctacccccagccccccagccagagctatggaggcggccctgcccaggtgcccctgcccggcggcttccctgggggccagatgcccagccagtacccaggcggccagcccacctaccccagctag

SEQ ID NO: 143773 - DNA, 1011 bp, Artificial Sequence
  Description of Artificial Sequence: Synthetic coding sequence
atgcccagccagtacccaggcggccagcccacctaccccagccagcctgccaccgtgacccaggtgacccagggcaccatccggcctgctgccaactttgatgccatcagagatgctgagatcctgaggaaggccatgaagggctttggaacagatgagcaggccatcgtggatgtggtggccaacagaagcaatgaccagaggcagaagatcaaggccgccttcaagaccagctatggcaaggacctgatcaaggacctgaagtctgagctgagcggcaacatggaggagctgatcctggccctcttcatgccacccacctactatgatgcctggagcctgaggaaggccatgcagggcgccggcacccaggagcgggtgctgattgagatcctgtgcaccaggaccaaccaggagatccgggagatcgtgcgctgctaccagagcgagtttggccgggacctggagaaggacatccgcagtgacaccagcggccactttgagcggctgctggtgtccatgtgccagggcaacagagatgagaaccagagcatcaaccaccagatggcccaggaggatgcccagaggctgtaccaggccggggagggccgcctgggcacagatgagagctgcttcaacatgatcctggccaccaggagcttcccccagctgcgggccaccatggaggcctacagcaggatggccaacagagacctgctgagctctgtgtcccgggagttcagcggctacgtggagagcggcctgaagaccatcctgcagtgtgccctgaacagacctgccttctttgctgagcggctgtactatgccatgaagggggccggcacagatgacagcaccctggtgcgcatcgtggtgaccaggagtgaaattgacctggtgcagatcaagcagatgtttgcccagatgtaccagaagaccctgggcaccatgattgctggggacaccagcggggactacagaaggctgctgctggccatcgtgggccagtag

SEQ ID NO: 143774 - DNA, 984 bp, Artificial Sequence
  Description of Artificial Sequence: Synthetic coding sequence
atggcctggtggaagtcctggattgagcaggagggcgtgacagtgaagagcagcagccacttcaacccagaccctgatgctgagaccctgtacaaggccatgaagggcatcggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaagaagattatggcagcagcctggaggaggacatccaggccgacaccagcggctacctggagcgcatcctggtgtgcctgctgcagggcagcagagatgatgtgagcagctttgtggaccccggcctggccctgcaggatgcccaggacctgtatgctgctggggagaagatccggggcacagatgagatgaagttcatcaccatcctgtgcaccaggtctgccacccacctgctgcgggtgtttgaggagtatgagaagatcgccaacaagagcattgaagattccatcaagtctgagacccacggcagcctggaggaggccatgctgactgtggtgaagtgcacccagaacctgcacagctactttgctgagcggctgtactatgccatgaagggagctggcaccagagatggcaccctcatccggaacatcgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 143775 - DNA, 831 bp, Artificial Sequence
  Description of Artificial Sequence: Synthetic coding sequence
atggcctggtggaagtcctggattgagcaggagggcgtgacagtgaagagcagcagccacttcaacccagaccctgatgctgagaccctgtacaaggccatgaagggcattggagtgggcagccagctgctgagccaccaggccgccgcctttgccttccccagcagcgccctgacctctgtgagcccctggggccagcagggccacctgtgctgcaacccagctggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcagcagagatgatgtgtcctcctttgtggaccccggcctggccctgcaggatgcccaggacctgtatgctgctggggagaagatccggggcacagatgagatgaagttcatcaccatcctgtgcaccaggtctgccacccacctgctgcgggtgaagtgcacccagaacctgcacagctactttgctgagcggctgtactatgccatgaagggggccggcaccagagatggcaccctcatcagaaatattgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 143776 - DNA, 798 bp, Artificial Sequence
  Description of Artificial Sequence: Synthetic coding sequence
atggcctggtggaagtcctgggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaagaagattatggcagcagcctggaggaggacatccaggccgacaccagcggctacctggagcgcatcctggtgtgcctgctgcagggcagcagagatgatgtgagcagctttgtggaccccggcctggccctgcaggatgcccaggacctgtatgctgctggggagaagatccggggcacagatgagatgaagttcatcaccatcctgtgcaccaggtctgccacccacctgctgcgggtgtttgaggagtatgagaagatcgccaacaagagcattgaagattccatcaagtctgagacccacggcagcctggaggaggccatgctgactgtggtgaagtgcacccagaacctgcacagctactttgctgagcggctgtactatgccatgaagggagctggcaccagagatggcaccctcatccggaacatcgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 143777 - DNA, 426 bp, Artificial Sequence
  Description of Artificial Sequence: Synthetic coding sequence
atggcctggtggaagtcctggattgagcaggagggcgtgacagtgaagagcagcagccacttcaacccagaccctgatgctgagaccctgtacaaggccatgaagggcatcggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaggagggccagcagggctag

SEQ ID NO: 143778 - DNA, 1038 bp, Artificial Sequence
  Description of Artificial Sequence: Synthetic coding sequence
atgtctgtgactggaggcaagatggcccccagcctgacccaggagatcctgagccacctgggcctggccagcaagacagctgcctggggcaccctgggcaccctgcggaccttcctgaacttctctgtggacaaggatgcccagaggctgctgcgggccatcaccggccagggcgtggacagaagtgccatcgtggatgtgctgaccaacagaagccgggagcagaggcagctgatcagcaggaacttccaggagaggacccagcaggacctgatgaagagcctgcaggccgccctgagcggcaacctggagcgcatcgtgatggccctgctgcagcccacagcccagtttgatgcccaggagctgaggacagccctgaaggccagtgacagcgctgtggatgtggccatcgagatcctggccaccaggaccccaccccagctgcaggagtgcctggccgtgtacaagcacaacttccaggtggaggccgtggatgacatcaccagcgagaccagcggcatcctgcaggacctgctgctggccctggccaagggcggccgggacagctacagcggcatcatcgactacaacctggccgagcaggatgtgcaggccctgcagagagctgagggccccagccgggaggagacctgggtgcctgtgttcacccagagaaatcctgagcacctgatccgggtgtttgaccagtaccagaggagcacaggccaggagctggaggaggccgtgcagaaccgcttccatggagatgcccaggtggccctgctgggcctggccagcgtcatcaagaacacccccctgtactttgctgacaagctgcaccaggccctgcaggagacagagcccaactaccaggtgctgatccgcatcctgatcagccgctgtgaaacagacctgctgagcatccgggcagagttcaggaagaagtttgggaagagcctgtacagcagcctgcaggatgctgtgaagggggactgccagagcgccctgctggccctgtgcagagctgaggacatgtag

SEQ ID NO: 143779 - DNA, 1929 bp, Artificial Sequence
  Description of Artificial Sequence: Synthetic coding sequence
atgctgacccggcccagccaggtgctgctgaacagcctgtctgtggaccctgatgctgagtgcaagtatggcctgtacttcagagatggaagaaggaaggtggactacatcctggtgtaccaccacaagaggcccagcggcaacagaaccctggtgagaagagtgcagcacagcgacacccccagcggggcccggtctgtgaagcaggaccaccccctgcccgggaagggggccagcctggatgctggcagcggggagccccccatggactaccatgaagatgacaagcgcttcagaagagaggagtatgagggcaacctgctggaggccggcctggagctggagagagatgaggacaccaagatccatggagtgggctttgtgaagatccacgccccctggaatgtgctgtgccgggaggccgagttcctgaagctgaagatgcccaccaagaagatgtaccacatcaatgagacccggggcctgctgaagaagatcaacagcgtgctgcagaagatcacagaccccatccagcccaaggtggccgagcaccggccccagaccatgaagaggctgagctaccccttcagccgggagaagcagcacctgtttgacctgagtgacaaggacagcttctttgacagcaagaccaggagcaccatcgtgtatgagatcctgaagaggaccacctgcaccaaggccaagtacagcatgggcatcaccagcctgctggccaacggggtgtatgctgctgcctaccccctgcatgatggagactacaatggagaaaatgtggagttcaatgacaggaagctgctgtatgaggagtgggcccgctatggagtcttctacaagtaccagcccatcgacctggtgaggaagtactttggagagaagattggcctgtactttgcctggctgggcgtgtacacccagatgctgatcccagccagcatcgtgggcatcatcgtgttcctgtatggctgtgccaccatggatgagaacatccccagcatggagatgtgtgaccagaggcacaacatcaccatgtgccccctgtgtgacaagacctgcagctactggaagatgagcagcgcctgtgccacagcccgggccagccacctgtttgacaacccagccaccgtcttcttctctgtgttcatggccctgtgggccgccaccttcatggagcactggaagaggaagcagatgaggctgaactaccgctgggacctgactggatttgaggaggaggaggaccaccccagggcagaatatgaggcccgggtgctggagaagagcctgaagaaggagagcaggaacaaggagacagacaaggtgaagctgacctggagggaccgcttccctgcctacctgaccaacctggtgtccatcatcttcatgattgctgtgacctttgccatcgtgctgggcgtcatcatctaccgcatctccatggccgccgccctggccatgaacagcagccccagcgtgcgcagcaacatccgggtgacagtgacagccacagctgtgatcatcaacctggtggtgatcatcctgctggatgaggtgtatggctgcatcgcccgctggctgaccaagattgaggtgcccaagacagagaagagctttgaggagcggctcatcttcaaggccttcctgctgaagtttgtgaacagctacacccccatcttctacgtggccttcttcaagggccgctttgtgggccggcctggggactatgtgtacatcttccgctccttcaggatggaggaggtgacagagatcctcttcatcagcggcagccccttctgcctggcctatgacctgagcaccccctgcacctgggagaagcagctgcagcacatctgcagcgccaagagcagccgcttcctgtccttcctgctggagaccttcctgttcccctag

SEQ ID NO: 143780 - DNA, 2961 bp, Artificial Sequence
  Description of Artificial Sequence: Synthetic coding sequence
atgagggtgaatgagaagtacagcaccctgcctgcagaagatagatctgtgcacatcatcaacatctgtgccatcgaggacatcggctacctgcccagcgagggcaccctgctgaacagcctgtctgtggaccctgatgctgagtgcaagtatggcctgtacttcagagatggaagaaggaaggtggactacatcctggtgtaccaccacaagaggcccagcggcaacagaaccctggtgagaagagtgcagcacagcgacacccccagcggggcccggtctgtgaagcaggaccaccccctgcccgggaagggggccagcctggatgctggcagcggggagccccccatggactaccatgaagatgacaagcgcttcagaagagaggagtatgagggcaacctgctggaggccggcctggagctggagagagatgaggacaccaagatccatggagtgggctttgtgaagatccacgccccctggaatgtgctgtgccgggaggccgagttcctgaagctgaagatgcccaccaagaagatgtaccacatcaatgagacccggggcctgctgaagaagatcaacagcgtgctgcagaagatcacagaccccatccagcccaaggtggccgagcaccggccccagaccatgaagaggctgagctaccccttcagccgggagaagcagcacctgtttgacctgagtgacaaggacagcttctttgacagcaagaccaggagcaccatcgtgtatgagatcctgaagaggaccacctgcaccaaggccaagtacagcatgggcatcaccagcctgctggccaacggggtgtatgctgctgcctaccccctgcatgatggagactacaatggagaaaatgtggagttcaatgacaggaagctgctgtatgaggagtgggcccgctatggagtcttctacaagtaccagcccatcgacctggtgaggaagtactttggagagaagattggcctgtactttgcctggctgggcgtgtacacccagatgctgatcccagccagcatcgtgggcatcatcgtgttcctgtatggctgtgccaccatggatgagaacatccccagcatggagatgtgtgaccagaggcacaacatcaccatgtgccccctgtgtgacaagacctgcagctactggaagatgagcagcgcctgtgccacagcccgggccagccacctgtttgacaacccagccaccgtcttcttctctgtgttcatggccctgtgggccgccaccttcatggagcactggaagaggaagcagatgaggctgaactaccgctgggacctgactggatttgaggaggaggaggaggccgtgaaggaccaccccagggcagaatatgaggcccgggtgctggagaagagcctgaagaaggagagcaggaacaaggagaagagaagacacatccctgaggagagcaccaacaagtggaagcagagggtgaagacagccatggccggcgtgaagctgacagacaaggtgaagctgacctggagggaccgcttccctgcctacctgaccaacctggtgtccatcatcttcatgattgctgtgacctttgccatcgtgctgggcgtcatcatctaccgcatctccatggccgccgccctggccatgaacagcagccccagcgtgcgcagcaacatccgggtgacagtgacagccacagctgtgatcatcaacctggtggtgatcatcctgctggatgaggtgtatggctgcatcgcccgctggctgaccaagattgaggtgcccaagacagagaagagctttgaggagcggctcatcttcaaggccttcctgctgaagtttgtgaacagctacacccccatcttctacgtggccttcttcaagggccgctttgtgggccggcctggggactatgtgtacatcttccgctccttcaggatggaggagtgtgcccctgggggctgcctgatggagctgtgcatccagctgagcatcatcatgctgggcaagcagctgatccagaacaacctgtttgaaattggcatccccaagatgaagaagctgatccgctacctgaagctgaagcagcagagccccccagaccatgaagaatgtgtgaagaggaagcagagatatgaggtggactacaacctggagccctttgctggcctgaccccagagtacatggagatgatcatccagtttggatttgtgaccctgtttgtggccagcttccccctggcccccctgtttgccctgctgaacaacatcatcgagatccggctggatgccaagaagtttgtgacagagctgcggcggcctgtggccgtgcgggccaaggacatcggcatctggtacaacatcctgcggggcatcggcaagctggccgtcatcatcaatgcctttgtgatctccttcaccagtgacttcatcccccggctggtgtacctgtacatgtacagcaagaatggcaccatgcacggctttgtgaaccacaccctgagcagcttcaacgtgtctgacttccagaatggaacagccccaaatgaccccctggacctgggctatgaggtgcagatctgccgctacaaggactaccgggagcccccctggagcgagaacaagtatgacatcagcaaggacttctgggccgtgctggccgcccggctggcctttgtgattgtgttccagaacctggtgatgttcatgtctgactttgtggactgggtgatcccagacatccccaaggacatcagccagcagatccacaaggagaaggtgctgatggtggagctgttcatgagggaggagcaggacaagcagcagctgctggagacctggatggagaaggagcggcagaaggatgagcccccctgcaaccaccacaacaccaaggcctgcccagacagcctgggcagccctgcccccagccacgcctaccacggcggcgtgctgtag

SEQ ID NO: 143781 - DNA, 2523 bp, Artificial Sequence
  Description of Artificial Sequence: Synthetic coding sequence
atggactaccatgaagatgacaagcgcttcagaagagaggagtatgagggcaacctgctggaggccggcctggagctggagagagatgaggacaccaagatccatggagtgggctttgtgaagatccacgccccctggaatgtgctgtgccgggaggccgagttcctgaagctgaagatgcccaccaagaagatgtaccacatcaatgagacccggggcctgctgaagaagatcaacagcgtgctgcagaagatcacagaccccatccagcccaaggtggccgagcaccggccccagaccatgaagaggctgagctaccccttcagccgggagaagcagcacctgtttgacctgagtgacaaggacagcttctttgacagcaagaccaggagcaccatcgtgtatgagatcctgaagaggaccacctgcaccaaggccaagtacagcatgggcatcaccagcctgctggccaacggggtgtatgctgctgcctaccccctgcatgatggagactacaatggagaaaatgtggagttcaatgacaggaagctgctgtatgaggagtgggcccgctatggagtcttctacaagtaccagcccatcgacctggtgaggaagtactttggagagaagattggcctgtactttgcctggctgggcgtgtacacccagatgctgatcccagccagcatcgtgggcatcatcgtgttcctgtatggctgtgccaccatggatgagaacatccccagcatggagatgtgtgaccagaggcacaacatcaccatgtgccccctgtgtgacaagacctgcagctactggaagatgagcagcgcctgtgccacagcccgggccagccacctgtttgacaacccagccaccgtcttcttctctgtgttcatggccctgtgggccgccaccttcatggagcactggaagaggaagcagatgaggctgaactaccgctgggacctgactggatttgaggaggaggaggaccaccccagggcagaatatgaggcccgggtgctggagaagagcctgaagaaggagagcaggaacaaggagacagacaaggtgaagctgacctggagggaccgcttccctgcctacctgaccaacctggtgtccatcatcttcatgattgctgtgacctttgccatcgtgctgggcgtcatcatctaccgcatctccatggccgccgccctggccatgaacagcagccccagcgtgcgcagcaacatccgggtgacagtgacagccacagctgtgatcatcaacctggtggtgatcatcctgctggatgaggtgtatggctgcatcgcccgctggctgaccaagattgaggtgcccaagacagagaagagctttgaggagcggctcatcttcaaggccttcctgctgaagtttgtgaacagctacacccccatcttctacgtggccttcttcaagggccgctttgtgggccggcctggggactatgtgtacatcttccgctccttcaggatggaggagtgtgcccctgggggctgcctgatggagctgtgcatccagctgagcatcatcatgctgggcaagcagctgatccagaacaacctgtttgaaattggcatccccaagatgaagaagctgatccgctacctgaagctgaagcagcagagccccccagaccatgaagaatgtgtgaagaggaagcagagatatgaggtggactacaacctggagccctttgctggcctgaccccagagtacatggagatgatcatccagtttggatttgtgaccctgtttgtggccagcttccccctggcccccctgtttgccctgctgaacaacatcatcgagatccggctggatgccaagaagtttgtgacagagctgcggcggcctgtggccgtgcgggccaaggacatcggcatctggtacaacatcctgcggggcatcggcaagctggccgtcatcatcaatgcctttgtgatctccttcaccagtgacttcatcccccggctggtgtacctgtacatgtacagcaagaatggcaccatgcacggctttgtgaaccacaccctgagcagcttcaacgtgtctgacttccagaatggaacagccccaaatgaccccctggacctgggctatgaggtgcagatctgccgctacaaggactaccgggagcccccctggagcgagaacaagtatgacatcagcaaggacttctgggccgtgctggccgcccggctggcctttgtgattgtgttccagaacctggtgatgttcatgtctgactttgtggactgggtgatcccagacatccccaaggacatcagccagcagatccacaaggagaaggtgctgatggtggagctgttcatgagggaggagcaggacaagcagcagctgctggagacctggatggagaaggagcggcagaaggatgagcccccctgcaaccaccacaacaccaaggcctgcccagacagcctgggcagccctgcccccagccacgcctaccacggcggcgtgctgtag

SEQ ID NO: 143782 - DNA, 2523 bp, Artificial Sequence; identical to SEQ ID NO: 143781
  Description of Artificial Sequence: Synthetic coding sequence

SEQ ID NO: 143783 - DNA, 2961 bp, Artificial Sequence
  Description of Artificial Sequence: Synthetic coding sequence
atgagggtgaatgagaagtacagcaccctgcctgcagaagatagatctgtgcacatcatcaacatctgtgccatcgaggacatcggctacctgcccagcgagggcaccctgctgaacagcctgtctgtggaccctgatgctgagtgcaagtatggcctgtacttcagagatggaagaaggaaggtggactacatcctggtgtaccaccacaagaggcccagcggcaacagaaccctggtgagaagagtgcagcacagcgacacccccagcggggcccggtctgtgaagcaggaccaccccctgcccgggaagggggccagcctggatgctggcagcggggagccccccatggactaccatgaagatgacaagcgcttcagaagagaggagtatgagggcaacctgctggaggccggcctggagctggagagagatgaggacaccaagatccatggagtgggctttgtgaagatccacgccccctggaatgtgctgtgccgggaggccgagttcctgaagctgaagatgcccaccaagaagatgtaccacatcaatgagacccggggcctgctgaagaagatcaacagcgtgctgcagaagatcacagaccccatccagcccaaggtggccgagcaccggccccagaccatgaagaggctgagctaccccttcagccgggagaagcagcacctgtttgacctgagtgacaaggacagcttctttgacagcaagaccaggagcaccatcgtgtatgagatcctgaagaggaccacctgcaccaaggccaagtacagcatgggcatcaccagcctgctggccaacggggtgtatgctgctgcctaccccctgcatgatggagactacaatggagaaaatgtggagttcaatgacaggaagctgctgtatgaggagtgggcccgctatggagtcttctacaagtaccagcccatcgacctggtgaggaagtactttggagagaagattggcctgtactttgcctggctgggcgtgtacacccagatgctgatcccagccagcatcgtgggcatcatcgtgttcctgtatggctgtgccaccatggatgagaacatccccagcatggagatgtgtgaccagaggcacaacatcaccatgtgccccctgtgtgacaagacctgcagctactggaagatgagcagcgcctgtgccacagcccgggccagccacctgtttgacaacccagccaccgtcttcttctctgtgttcatggccctgtgggccgccaccttcatggagcactggaagaggaagcagatgaggctgaactaccgctgggacctgactggatttgaggaggaggagaaggccctgctggaccaccccagggcagaatatgaggcccgggtgctggagaagagcctgaagaaggagagcaggaacaaggagaagagaagacacatccctgaggagagcaccaacaagtggaagcagagggtgaagacagccatggccggcgtgaagctgacagacaaggtgaagctgacctggagggaccgcttccctgcctacctgaccaacctggtgtccatcatcttcatgattgctgtgacctttgccatcgtgctgggcgtcatcatctaccgcatctccatggccgccgccctggccatgaacagcagccccagcgtgcgcagcaacatccgggtgacagtgacagccacagctgtgatcatcaacctggtggtgatcatcctgctggatgaggtgtatggctgcatcgcccgctggctgaccaagattgaggtgcccaagacagagaagagctttgaggagcggctcatcttcaaggccttcctgctgaagtttgtgaacagctacacccccatcttctacgtggccttcttcaagggccgctttgtgggccggcctggggactatgtgtacatcttccgctccttcaggatggaggagtgtgcccctgggggctgcctgatggagctgtgcatccagctgagcatcatcatgctgggcaagcagctgatccagaacaacctgtttgaaattggcatccccaagatgaagaagctgatccgctacctgaagctgaagcagcagagccccccagaccatgaagaatgtgtgaagaggaagcagagatatgaggtggactacaacctggagccctttgctggcctgaccccagagtacatggagatgatcatccagtttggatttgtgaccctgtttgtggccagcttccccctggcccccctgtttgccctgctgaacaacatcatcgagatccggctggatgccaagaagtttgtgacagagctgcggcggcctgtggccgtgcgggccaaggacatcggcatctggtacaacatcctgcggggcatcggcaagctggccgtcatcatcaatgcctttgtgatctccttcaccagtgacttcatcccccggctggtgtacctgtacatgtacagcaagaatggcaccatgcacggctttgtgaaccacaccctgagcagcttcaacgtgtctgacttccagaatggaacagccccaaatgaccccctggacctgggctatgaggtgcagatctgccgctacaaggactaccgggagcccccctggagcgagaacaagtatgacatcagcaaggacttctgggccgtgctggccgcccggctggcctttgtgattgtgttccagaacctggtgatgttcatgtctgactttgtggactgggtgatcccagacatccccaaggacatcagccagcagatccacaaggagaaggtgctgatggtggagctgttcatgagggaggagcaggacaagcagcagctgctggagacctggatggagaaggagcggcagaaggatgagcccccctgcaaccaccacaacaccaaggcctgcccagacagcctgggcagccctgcccccagccacgcctaccacggcggcgtgctgtag

SEQ ID NO: 143784 - DNA, 942 bp, Artificial Sequence
  Description of Artificial Sequence: Synthetic coding sequence
atgctggatgctgccagcaaggcccgggaggcccctgaggccgcccctggctgggatgacccccagggcgagggccggcggggccgcggggagggcctgtcctgggccgtgggcccccacccagaccccggggtgctgatgcagggcgaggtgtggagcggccgcttcagccatgctgtgatccagtttggatttgtgaccctgtttgtggccagcttccccctggcccccctgtttgccctgctgaacaacatcatcgagatccggctggatgccaagaagtttgtgacagagctgcggcggcctgtggccgtgcgggccaaggacatcggcatctggtacaacatcctgcggggcatcggcaagctggccgtcatcatcaatgccttcgtcatctccttcaccagtgacttcatcccccggctggtgtacctgtacatgtacagcaagaatggcaccatgcacggctttgtgaaccacaccctgagcagcttcaacgtgtctgacttccagaatggaacagccccaaatgaccccctggacctgggctatgaggtgcagatctgccgctacaaggactaccgggagcccccctggagcgagaacaagtatgacatcagcaaggacttctgggccgtgctggccgcccggctggccttcgtcatcgtgttccagaacctggtgatgttcatgtctgactttgtggactgggtgatcccagacatccccaaggacatcagccagcagatccacaaggagaaggtgctgatggtggagctgttcatgagggaggagcaggacaagcagcagctgctggagacctggatggagaaggagcggcagaaggatgagcccccctgcaaccaccacaacaccaaggcctgcccagacagcctgggcagccctgcccccagccacgcctaccatggaggagtgctgtag

SEQ ID NO: 143785 - DNA, 2235 bp, Artificial Sequence
  Description of Artificial Sequence: Synthetic coding sequence
atgaagaggctgagctaccccttcagccgggagaagcagcacctgtttgacctgagtgacaaggacagcttctttgacagcaagaccaggagcaccatcgtgtatgagatcctgaagaggaccacctgcaccaaggccaagtacagcatgggcatcaccagcctgctggccaacggggtgtatgctgctgcctaccccctgcatgatggagactacaatggagaaaatgtggagttcaatgacaggaagctgctgtatgaggagtgggcccgctatggagtcttctacaagtaccagcccatcgacctggtgaggaagtactttggagagaagattggcctgtactttgcctggctgggcgtgtacacccagatgctgatcccagccagcatcgtgggcatcatcgtgttcctgtatggctgtgccaccatggatgagaacatccccagcatggagatgtgtgaccagaggcacaacatcaccatgtgccccctgtgtgacaagacctgcagctactggaagatgagcagcgcctgtgccacagcccgggccagccacctgtttgacaacccagccaccgtcttcttctctgtgttcatggccctgtgggccgccaccttcatggagcactggaagaggaagcagatgaggctgaactaccgctgggacctgactggatttgaggaggaggagaaggccctgctggaccaccccagggcagaatatgaggcccgggtgctggagaagagcctgaagaaggagagcaggaacaaggagacagacaaggtgaagctgacctggagggaccgcttccctgcctacctgaccaacctggtgtccatcatcttcatgattgctgtgacctttgccatcgtgctgggcgtcatcatctaccgcatctccatggccgccgccctggccatgaacagcagccccagcgtgcgcagcaacatccgggtgacagtgacagccacagctgtgatcatcaacctggtggtgatcatcctgctggatgaggtgtatggctgcatcgcccgctggctgaccaagattgaggtgcccaagacagagaagagctttgaggagcggctcatcttcaaggccttcctgctgaagtttgtgaacagctacacccccatcttctacgtggccttcttcaagggccgctttgtgggccggcctggggactatgtgtacatcttccgctccttcaggatggaggagtgtgcccctgggggctgcctgatggagctgtgcatccagctgagcatcatcatgctgggcaagcagctgatccagaacaacctgtttgaaattggcatccccaagatgaagaagctgatccgctacctgaagctgaagcagcagagccccccagaccatgaagaatgtgtgaagaggaagcagagatatgaggtggactacaacctggagccctttgctggcctgaccccagagtacatggagatgatcatccagtttggatttgtgaccctgtttgtggccagcttccccctggcccccctgtttgccctgctgaacaacatcatcgagatccggctggatgccaagaagtttgtgacagagctgcggcggcctgtggccgtgcgggccaaggacatcggcatctggtacaacatcctgcggggcatcggcaagctggccgtcatcatcaatgcctttgtgatctccttcaccagtgacttcatcccccggctggtgtacctgtacatgtacagcaagaatggcaccatgcacggctttgtgaaccacaccctgagcagcttcaacgtgtctgacttccagaatggaacagccccaaatgaccccctggacctgggctatgaggtgcagatctgccgctacaaggactaccgggagcccccctggagcgagaacaagtatgacatcagcaaggacttctgggccgtgctggccgcccggctggcctttgtgattgtgttccagaacctggtgatgttcatgtctgactttgtggactgggtgatcccagacatccccaaggacatcagccagcagatccacaaggagaaggtgctgatggtggagctgttcatgagggaggagcaggacaagcagcagctgctggagacctggatggagaaggagcggcagaaggatgagcccccctgcaaccaccacaacaccaaggcctgcccagacagcctgggcagccctgcccccagccacgcctaccacggcggcgtgctgtag

SEQ ID NO: 143786 - DNA, 1983 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaacctgcgggccaaggatgagaagatgatccctggctacccccaggccaagctgtacccaggcaagagcctgctgcggcggctgctgaccagcggcatcgtcatccaggtgttccccctgcatgacagcgaggccctgaagaagctggaggacacctggtacaccaggtttgccctgaagtaccagcccatcgacagcatccggggctactttggagagaccatcgccctgtacttcggcttcctggagtacttcacctttgccctgatccccatggccgtcatcggcctgccctactacctgtttgtgtgggaggactatgacaagtatgtgatctttgccagcttcaacctgatctggagcaccgtcatcctggagctgtggaagaggggctgtgccaacatgacctaccgctggggcaccctgctgatgaagaggaagtttgaggagccccggcccggcttccatggagtgctgggcatcaacagcatcaccgggaaggaggagcccctgtaccccagctacaagaggcagctgcgcatctacctggtgtccctgccctttgtgtgcctgtgcctgtacttcagcctgtatgtgatgatgatctactttgacatggaggtgtgggccctgggcctgcacgagaacagcggcagcgagtggacctctgtgctgctgtatgtgcccagcatcatctatgccatcgtcatcgagatcatgaaccggctgtaccgctatgctgctgagttcctgacctcctgggagaaccaccggctggagagcgcctaccagaaccacctgatcctgaaggtgctggtgttcaacttcctgaactgctttgccagcctcttctacatcgcctttgtgctgaaggacatgaagctgctgcggcagagcctggccaccctgctgatcaccagccagatcctgaaccagatcatggagagcttcctgccctactggctgcagaggaagcatggagtgcgggtgaagaggaaggtgcaggccctgaaggctgacattgatgccaccctgtatgagcaggtgatcctggagaaggagatgggcacctacctgggcacctttgatgactacctggagctgttcctgcagtttggctacgtgtccctcttcagctgtgtgtaccccctggccgccgcctttgctgtgctgaacaacttcacagaggtgaacagtgatgccctgaagatgtgcagggtcttcaagaggcccttcagcgagcccagcgccaacatcggcgtgtggcagctggcctttgagaccatgtctgtcatctctgtggtgaccaactgtgccctgattggcatgagcccccaggtgaatgctgtgtttcctgagagcaaggctgacctgatcctgattgtggtggccgtggagcacgccctgctggccctgaagttcatcctggcctttgccatcccagacaagcccaggcacatccagatgaagctggcccggctggagtttgagagcctggaggccctgaagcagcagcagatgaagctggtgacagagaacctgaaggaggagcccatggagagcggcaaggagaaggccacctag

SEQ ID NO: 143787 - DNA, 1413 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaacctgcgggccaaggatgagaagatgatccctggctacccccaggccaagctgtacccaggcaagagcctgctgcggcggctgctgaccagcggcatcgtcatccaggtgttccccctgcatgacagcgaggccctgaagaagctggaggacacctggtacaccaggtttgccctgaagtaccagcccatcgagaaccaccggctggagagcgcctaccagaaccacctgatcctgaaggtgctggtgttcaacttcctgaactgctttgccagcctcttctacatcgcctttgtgctgaaggacatgaagctgctgcggcagagcctggccaccctgctgatcaccagccagatcctgaaccagatcatggagagcttcctgccctactggctgcagaggaagcatggagtgcgggtgaagaggaaggtgcaggccctgaaggctgacattgatgccaccctgtatgagcaggtgatcctggagaaggagatgggcacctacctgggcacctttgatgactacctggagctgttcctgcagtttggctacgtgtccctcttcagctgtgtgtaccccctggccgccgcctttgctgtgctgaacaacttcacagaggtgaacagtgatgccctgaagatgtgcagggtcttcaagaggcccttcagcgagcccagcgccaacatcggcgtgtggcagctggcctttgagaccatgtctgtcatctctgtggtgaccaactgtgccctgattggcatgagcccccaggtgaatgctgtgtttcctgagagcaaggctgacctgatcctgattgtggtggccgtggagcacgccctgctggccctgaagttcatcctggcctttgccatcccagacaagcccaggcacatccagatgaagctggcccggctggagtttgagagcctggaggccctgaagcagcagcagatgaagctggtgacagagaacctgaaggaggagcccatggagagcggcaaggagaaggccacctag

SEQ ID NO: 143788 - DNA, 423 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaacctgcgggccaaggatgaatag

SEQ ID NO: 143789 - DNA, 339 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgattag

SEQ ID NO: 143790 - DNA, 117 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaacagatag

SEQ ID NO: 143791 - DNA, 405 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaactag

SEQ ID NO: 143792 - DNA, 441 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaacctgcgggccaaggatgagaagatgatccctggctactag

SEQ ID NO: 143793 - DNA, 426 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaacctgcgggccaaggatgagaagtag

SEQ ID NO: 143794 - DNA, 1785 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggagacaacaatgatgacttcctgaccatggccgagtgccagttcatcatcaagcatgagctggagaacctgcgggccaaggatgagaagatgatccctggctacccccaggccaagctgtacccaggcaagagcctgctgcggcggctgctgaccagcggcatcgtcatccaggtgttccccctgcatgacagcgaggccctgaagaagctggaggacacctggtacaccaggtttgccctgaagtaccagcccatcgacagcatccggggctactttggagagaccatcgccctgtacttcggcttcctggagtacttcacctttgccctgatccccatggccgtcatcggcctgccctactacctgtttgtgtgggaggactatgacaagtatgtgatctttgccagcttcaacctgatctggagcaccgtcatcctggagctgtggaagaggggctgtgccaacatgacctaccgctggggcaccctgctgatgaagaggaagtttgaggagccccggcccggcttccatggagtgctgggcatcaacagcatcaccgggaaggaggagcccctgtaccccagctacaagaggcagctgcgcatctacctggtgtccctgccctttgtgtgcctgtgcctgtacttcagcctgtatgtgatgatgatctactttgacatggaggtgtgggccctgggcctgcacgagaacagcggcagcgagtggacctctgtgctgctgtatgtgcccagcatcatctatgccatcgtcatcgagatcatgaaccggctgtaccgctatgctgctgagttcctgacctcctgggagaaccaccggctggagagcgcctaccagaaccacctgatcctgaaggtgctggtgttcaacttcctgaactgctttgccagcctcttctacatcgcctttgtgctgaaggacatgaagctgctgcggcagagcctggccaccctgctgatcaccagccagatcctgaaccagatcatggagagcttcctgccctactggctgcagaggaagcatggagtgcgggtgaagaggaaggtgcaggccctgaaggctgacattgatgccaccctgtatgagcaggtgatcctggagaaggagatgggcacctacctgggcacctttgatgactacctggagctgttcctgcagtttggctacgtgtccctcttcagctgtgtgtaccccctggccgccgcctttgctgtgctgaacaacttcacagaggtgaacagtgatgccctgaagatgtgcagggtcttcaagaggcccttcagcgagcccagcgccaacatcggcgtgtggcagctggcctttgagaccatgtctgtcatctctgtggtgaccaactgtgccctgattggcatgagcccccaggtgaatgctgtgtttcctgagagcaaggctgacctgatcctgattgtggtggccgtggagcacgccctgctggccctgaagttcatcctggcctttgccatcccagacaagcccaggcacatccagatgaagctggcccggctggagtttgagagcctggaggccctgaagcagcagcagatgaagctggtgacagagaacctgaaggaggagcccatggagagcggcaaggagaaggccacctag

SEQ ID NO: 143795 - DNA, 1884 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggaggagcccagctgctcttccggcccctgctgaacaagtatgagcaggagaccctggagaaccagaacctgtacctggtgggcgccagcaagatccgcatgctgctgggcgctgaggccgtgggcctggtgaaggaatgtaatgacaacaccatgagggccttcacctaccgcacccggcagaacttcaagggctttgatgacaacaatgatgacttcctgaccatggccgagtgccagttcatcatcaagcatgagctggagaacctgcgggccaaggatgagaagatgatccctggctacccccaggccaagctgtacccaggcaagagcctgctgcggcggctgctgaccagcggcatcgtcatccaggtgttccccctgcatgacagcgaggccctgaagaagctggaggacacctggtacaccaggtttgccctgaagtaccagcccatcgacagcatccggggctactttggagagaccatcgccctgtacttcggcttcctggagtacttcacctttgccctgatccccatggccgtcatcggcctgccctactacctgtttgtgtgggaggactatgacaagtatgtgatctttgccagcttcaacctgatctggagcaccgtcatcctggagctgtggaagaggggctgtgccaacatgacctaccgctggggcaccctgctgatgaagaggaagtttgaggagccccggcccggcttccatggagtgctgggcatcaacagcatcaccgggaaggaggagcccctgtaccccagctacaagaggcagctgcgcatctacctggtgtccctgccctttgtgtgcctgtgcctgtacttcagcctgtatgtgatgatgatctactttgacatggaggtgtgggccctgggcctgcacgagaacagcggcagcgagtggacctctgtgctgctgtatgtgcccagcatcatctatgccatcgtcatcgagatcatgaaccggctgtaccgctatgctgctgagttcctgacctcctgggagaaccaccggctggagagcgcctaccagaaccacctgatcctgaaggtgctggtgttcaacttcctgaactgctttgccagcctcttctacatcgcctttgtgctgaaggacatgaagctgctgcggcagagcctggccaccctgctgatcaccagccagatcctgaaccagatcatggagagcttcctgccctactggctgcagaggaagcatggagtgcgggtgaagaggaaggtgcaggccctgaaggctgacattgatgccaccctgtatgagcaggtgatcctggagaaggagatgggcacctacctgggcacctttgatgactacctggagctgttcctgcagtttggctacgtgtccctcttcagctgtgtgtaccccctggccgccgcctttgctgtgctgaacaacttcacagaggtgaacagtgatgccctgaagatgtgcagggtcttcaagaggcccttcagcgagcccagcgccaacatcggcgtgtggcagctggcctttgagaccatgtctgtcatctctgtggtgaccaactgtgccctgattggcatgagcccccaggtgaatgctgtgtttcctgagagcaaggctgacctgatcctgattgtggtggccgtggaggccgccagctgcaagctggtgtccctgccccgctacagctggagcaccaacagcgtgcccggcaccgtgattggccctggggtgtag

SEQ ID NO: 143796 - DNA, 1650 bp, Artificial Sequence
  Description of Artificial Sequence: Synthetic coding sequence
atgaaggtgaccctgagcgccctggacaccagcgagagcagcttcacccccctggtggtgattgagctggcccaggatgtgaaggaggagaccaaggagtggctgaagaaccgcatcatcgccaagaagaaggatggagtgcggcggctgctgaccagcggcatcgtcatccaggtgttccccctgcatgattctgaggccctgaagaagctggaggacacctggtacaccaggtttgccctgaagtaccagcccatcgacagcatccggggctactttggagagaccatcgccctgtacttcggcttcctggagtacttcacctttgccctgatccccatggctgtgattggcctgccctactacctgtttgtgtgggaggactatgacaagtatgtgatctttgccagcttcaacctgatctggagcaccgtcatcctggagctgtggaagaggggctgtgccaacatgacctaccgctggggcaccctgctgatgaagaggaagtttgaggagcccaggcctggcttccacggcgtgctgggcatcaacagcatcaccgggaaggaggagcccctgtaccccagctacaagaggcagctgcgcatctacctggtgtccctgccctttgtgtgcctgtgcctgtacttcagcctgtatgtgatgatgatctactttgacatggaggtgtgggccctgggcctgcatgaaaattctggcagcgagtggacctctgtgctgctgtatgtgcccagcatcatctatgccatcgtgattgagatcatgaacagactctaccgctatgctgctgagttcctgacctcctgggagaaccaccggctggagagcgcctaccagaaccacctgatcctgaaggtgctggtgttcaacttcctgaactgctttgccagcctcttctacatcgcctttgtgctgaaggacatgaagctgctgcggcagagcctggccaccctgctgatcaccagccagatcctgaaccagatcatggagagcttcctgccctactggctgcagaggaagcacggcgtgcgggtgaagaggaaggtgcaggccctgaaggctgacattgatgccaccctgtatgagcaggtgatcctggagaaggagatgggcacctacctgggcacctttgatgactacctggagctgttcctgcagtttggctacgtgtccctcttcagctgtgtgtaccccctggccgccgcctttgctgtgctgaacaacttcacagaggtgaacagtgatgccctgaagatgtgcagggtcttcaagaggcccttcagcgagcccagcgccaacattggagtgtggcagctggcctttgagaccatgtctgtcatctctgtggtgaccaactgtgccctgattggcatgagcccccaggtgaatgctgtgtttcctgagagcaaggctgacctgatcctgattgtggtggccgtggagcacgccctgctggccctgaagttcatcctggcctttgccatcccagacaagcccaggcacatccagatgaagctggcccggctggagtttgagagcctggaggccctgaagcagcagcagatgaagctggtgacagagaacctgaaggaggagcccatggagagcggcaaggagaaggccacctag

SEQ ID NO: 143797 - DNA, 2997 bp, Artificial Sequence
  Description of Artificial Sequence: Synthetic coding sequence
atgcctgaggacatccccctgctgcccggcagcccccggcggctgagcccccaggccggcagcagaggaggccagggccccaagcacggccagcagtgcctgaagatgcctggcccccgggcccctggcctgcagggcggcagcaacagagaccccggccagccctgtggcggggagagcaccaggagcagcagcgtcatcaacaactacctggatgccaatgaacctgtgtccctggaggcccggctgagcaggatgcacttccatgacagccagaggaaggtggactatgtgctggcctaccactacaggaagaggggcgtgcacctggcccagggcttccctggccacagcctggccatcgtgtccaatggagaaacaggcaaggagccccatgctgggggccctggggacatcgagctgggccccctggatgccctggaggaggagaggaaggagcagcgggaggagtttgagcacaacctgatggaggccggcctggagctggagaaggacctggagaacaagagccagggcagcatctttgtgcgcatccacgccccctggcaggtgctggcccgggaggccgagttcctgaagatcaaggtgcccaccaagaagatgtatgagatcaaggccggcggcagcatcgccaagaagttctctgctgccctgcagaagctgagcagccacctgcagccccgggtgcctgagcacagcaacaacaagatgaagaacctgagctaccccttcagccgggagaagatgtacctgtacaacatccaggagaaggacaccttctttgacaatgccaccaggagccgcatcgtgcatgagatcctgaagaggacagcctgcagccgggccaacaacaccatgggcatcaacagcctgattgccaacaacatctatgaggccgcctaccccctgcatgatggagaatatgacagcccagaagatgacatgaatgacaggaagctgctgtaccaggagtgggcccgctatggagtcttctacaagttccagcccatcgacctgatcaggaagtactttggagagaagattggcctgtactttgcctggctgggcctgtacaccagcttcctgatccccagctctgtgattggagtcatcgtgttcctgtatggctgtgccaccatcgaggaggacatccccagccgggagatgtgtgaccagcagaatgccttcaccatgtgccccctgtgtgacaagagctgtgactactggaacctgagcagcgcctgtggcacagcccaggccagccacctgtttgacaacccagccaccgtcttcttcagcatcttcatggccctgtgggccaccatgttcctggagaactggaagaggctgcagatgaggctgggctacttctgggacctgaccggcatcgaggaggaggaggagcgggcccaggagcacagcaggccagaatatgagaccaaggtgcgggagaagatgctgaaggagagcaaccagagcgctgtgcagaagctggagaccaacaccacagaatgtggagatgaagatgatgaggacaagctgacctggaaggaccgcttccctggctacctgatgaactttgccagcatcctcttcatgattgccctgaccttcagcatcgtgtttggagtcatcgtgtaccgcatcaccacagctgctgccctgagcctgaacaaggccaccaggagcaatgtgcgggtgacagtgacagccacagctgtgatcatcaacctggtggtgatcctgatcctggatgagatctatggagctgtggccaagtggctgaccaagattgaggtgcccaagacagagcagacctttgaggagcggctcatcctgaaggccttcctgctgaagtttgtgaatgcctacagccccatcttctacgtggccttcttcaagggccgctttgtgggccggcccggcagctatgtgtatgtgtttgatggctacaggatggaggagtgtgcccctgggggctgcctgatggagctgtgcatccagctgagcatcatcatgctgggcaagcagctgatccagaacaacatctttgaaattggagtgcccaagctgaagaagctgttcaggaagctgaaggatgaaacagaagctggggagacagacagcgcccacagcaagcaccctgagcagtgggacctggactacagcctggagccctacacaggcctgaccccagagtacatggagatgatcatccagtttggatttgtgaccctgtttgtggccagcttccccctggcccctgtgtttgccctgctgaacaacgtgattgaggtgcggctggatgccaagaagtttgtgacagagctgcggcggccagatgctgtgaggaccaaggacatcggcatctggtttgacatcctgtctggaattggcaagttcagcgtcatcagcaatgcctttgtgattgccatcaccagtgacttcatcccccggctggtgtaccagtacagctacagccacaacggcaccctgcacggctttgtgaaccacaccctgtccttcttcaacgtgtcccagctgaaggagggcacccagcctgagaacagccagtttgaccaggaggtgcagttctgccgcttcaaggactaccgggagcccccctgggcccccaacccctatgagttcagcaagcagtactggttcatcctgagcgcccggctggccttcgtcatcatcttccagaacctggtgatgttcctgtctgtgctggtggactggatgatcccagacatccccacagacatcagtgaccagatcaagaaggagaagagcctgctggtggacttcttcctgaaggaggagcacgagaagctgaagctgatggatgagcccgccctgcggagccctgggggcggggacaggagccgcagccgggccgccagcagcgcccccagcggccagagccagctgggctccatgatgagcagcggcagccagcacaccaacgtgtag

SEQ ID NO: 143798 - DNA, 3000 bp, Artificial Sequence
  Description of Artificial Sequence: Synthetic coding sequence
atgcctgaggacatccccctgctgcccggcagcccccggcggctgagcccccaggccggcagcagaggaggccagggccccaagcacggccagcagtgcctgaagatgcctggcccccgggcccctggcctgcagggcggcagcaacagagaccccggccagccctgtggcggggagagcaccaggagcagcagcgtcatcaacaactacctggatgccaatgaacctgtgtccctggaggcccggctgagcaggatgcacttccatgacagccagaggaaggtggactatgtgctggcctaccactacaggaagaggggcgtgcacctggcccagggcttccctggccacagcctggccatcgtgtccaatggagaaacaggcaaggagccccatgctgggggccctggggacatcgagctgggccccctggatgccctggaggaggagaggaaggagcagcgggaggagtttgagcacaacctgatggaggccggcctggagctggagaaggacctggagaacaagagccagggcagcatctttgtgcgcatccacgccccctggcaggtgctggcccgggaggccgagttcctgaagatcaaggtgcccaccaagaaggagatgtatgagatcaaggccggcggcagcatcgccaagaagttctctgctgccctgcagaagctgagcagccacctgcagccccgggtgcctgagcacagcaacaacaagatgaagaacctgagctaccccttcagccgggagaagatgtacctgtacaacatccaggagaaggacaccttctttgacaatgccaccaggagcagaattgtgcatgagatcctgaagaggacagcctgcagccgggccaacaacaccatgggcatcaacagcctcatcgccaacaacatctatgaagctgcctaccccctgcatgatggagaatatgacagcccagaagatgacatgaatgacaggaagctgctgtaccaggagtgggcccgctatggagtcttctacaagttccagcccatcgacctgatcaggaagtactttggagagaagattggcctgtactttgcctggctgggcctgtacaccagcttcctgatccccagcagcgtcatcggcgtgattgtgttcctgtatggctgtgccaccatcgaggaggacatccccagccgggagatgtgtgaccagcagaatgccttcaccatgtgccccctgtgtgacaagagctgtgactactggaacctgagcagcgcctgtggcacagcccaggccagccacctgtttgacaacccagccaccgtcttcttcagcatcttcatggccctgtgggccaccatgttcctggagaactggaagaggctgcagatgaggctgggctacttctgggacctgactggaattgaggaggaggaggagcgggcccaggagcacagcaggccagaatatgagaccaaggtgcgggagaagatgctgaaggagagcaaccagagcgctgtgcagaagctggagaccaacaccacagaatgtggagatgaagatgatgaggacaagctgacctggaaggaccgcttccctggctacctgatgaactttgccagcatcctcttcatgattgccctgaccttcagcatcgtgtttggagtgattgtgtaccgcatcaccacagctgctgccctgagcctgaacaaggccaccaggagcaatgtgcgggtgacagtgacagccacagctgtgatcatcaacctggtggtgatcctgatcctggatgagatctacggggctgtggccaagtggctgaccaagattgaggtgcccaagacagagcagacctttgaggagcggctcatcctgaaggccttcctgctgaagtttgtgaatgcctacagccccatcttctacgtggccttcttcaagggccgctttgtgggccggcccggcagctatgtgtatgtgtttgatggctacaggatggaggagtgtgcccctgggggctgcctgatggagctgtgcatccagctgagcatcatcatgctgggcaagcagctgatccagaacaacatctttgaaattggagtgcccaagctgaagaagctgttcaggaagctgaaggatgaaacagaggccggggagacagattctgcccacagcaagcaccctgagcagtgggacctggactacagcctggagccctacacaggcctgaccccagagtacatggagatgatcatccagtttggatttgtgaccctgtttgtggccagcttccccctggcccctgtgtttgccctgctgaacaacgtcatcgaggtgcggctggatgccaagaagtttgtgacagagctgcggcggccagatgctgtgaggaccaaggacatcggcatctggtttgacatcctgagcggcatcggcaagttcagcgtcatcagcaatgccttcgtcatcgccatcaccagtgacttcatcccccggctggtgtaccagtacagctacagccacaacggcaccctgcacggctttgtgaaccacaccctgtccttcttcaacgtgtcccagctgaaggagggcacccagcctgagaacagccagtttgaccaggaggtgcagttctgccgcttcaaggactaccgggagcccccctgggcccccaacccctatgagttcagcaagcagtactggttcatcctgagcgcccggctggcctttgtgatcatcttccagaacctggtgatgttcctgtctgtgctggtggactggatgatcccagacatccccacagacatcagtgaccagatcaagaaggagaagagcctgctggtggacttcttcctgaaggaggagcacgagaagctgaagctgatggatgagcccgccctgcggagccctgggggcggggacaggagccgcagcagagctgccagcagcgcccccagcggccagagccagctgggctccatgatgagcagcggcagccagcacaccaacgtgtag

SEQ ID NO: 143799 - DNA, 3012 bp, Artificial Sequence
  Description of Artificial Sequence: Synthetic coding sequence
atggccaccccaggcccccgggacatccccctgctgcccggcagcccccggcggctgagcccccaggccggcagcagaggaggccagggccccaagcacggccagcagtgcctgaagatgcctggcccccgggcccctggcctgcagggcggcagcaacagagaccccggccagccctgtggcggggagagcaccaggagcagcagcgtcatcaacaactacctggatgccaatgaacctgtgtccctggaggcccggctgagcaggatgcacttccatgacagccagaggaaggtggactatgtgctggcctaccactacaggaagaggggcgtgcacctggcccagggcttccctggccacagcctggccatcgtgtccaatggagaaacaggcaaggagccccatgctgggggccctggggacatcgagctgggccccctggatgccctggaggaggagaggaaggagcagcgggaggagtttgagcacaacctgatggaggccggcctggagctggagaaggacctggagaacaagagccagggcagcatctttgtgcgcatccacgccccctggcaggtgctggcccgggaggccgagttcctgaagatcaaggtgcccaccaagaaggagatgtatgagatcaaggccggcggcagcatcgccaagaagttctctgctgccctgcagaagctgagcagccacctgcagccccgggtgcctgagcacagcaacaacaagatgaagaacctgagctaccccttcagccgggagaagatgtacctgtacaacatccaggagaaggacaccttctttgacaatgccaccaggagcagaattgtgcatgagatcctgaagaggacagcctgcagccgggccaacaacaccatgggcatcaacagcctcatcgccaacaacatctatgaagctgcctaccccctgcatgatggagaatatgacagcccagaagatgacatgaatgacaggaagctgctgtaccaggagtgggcccgctatggagtcttctacaagttccagcccatcgacctgatcaggaagtactttggagagaagattggcctgtactttgcctggctgggcctgtacaccagcttcctgatccccagcagcgtcatcggcgtgattgtgttcctgtatggctgtgccaccatcgaggaggacatccccagccgggagatgtgtgaccagcagaatgccttcaccatgtgccccctgtgtgacaagagctgtgactactggaacctgagcagcgcctgtggcacagcccaggccagccacctgtttgacaacccagccaccgtcttcttcagcatcttcatggccctgtgggccaccatgttcctggagaactggaagaggctgcagatgaggctgggctacttctgggacctgactggaattgaggaggaggaggagcgggcccaggagcacagcaggccagaatatgagaccaaggtgcgggagaagatgctgaaggagagcaaccagagcgctgtgcagaagctggagaccaacaccacagaatgtggagatgaagatgatgaggacaagctgacctggaaggaccgcttccctggctacctgatgaactttgccagcatcctcttcatgattgccctgaccttcagcatcgtgtttggagtgattgtgtaccgcatcaccacagctgctgccctgagcctgaacaaggccaccaggagcaatgtgcgggtgacagtgacagccacagctgtgatcatcaacctggtggtgatcctgatcctggatgagatctacggggctgtggccaagtggctgaccaagattgaggtgcccaagacagagcagacctttgaggagcggctcatcctgaaggccttcctgctgaagtttgtgaatgcctacagccccatcttctacgtggccttcttcaagggccgctttgtgggccggcccggcagctatgtgtatgtgtttgatggctacaggatggaggagtgtgcccctgggggctgcctgatggagctgtgcatccagctgagcatcatcatgctgggcaagcagctgatccagaacaacatctttgaaattggagtgcccaagctgaagaagctgttcaggaagctgaaggatgaaacagaggccggggagacagattctgcccacagcaagcaccctgagcagtgggacctggactacagcctggagccctacacaggcctgaccccagagtacatggagatgatcatccagtttggatttgtgaccctgtttgtggccagcttccccctggcccctgtgtttgccctgctgaacaacgtcatcgaggtgcggctggatgccaagaagtttgtgacagagctgcggcggccagatgctgtgaggaccaaggacatcggcatctggtttgacatcctgagcggcatcggcaagttcagcgtcatcagcaatgccttcgtcatcgccatcaccagtgacttcatcccccggctggtgtaccagtacagctacagccacaacggcaccctgcacggctttgtgaaccacaccctgtccttcttcaacgtgtcccagctgaaggagggcacccagcctgagaacagccagtttgaccaggaggtgcagttctgccgcttcaaggactaccgggagcccccctgggcccccaacccctatgagttcagcaagcagtactggttcatcctgagcgcccggctggcctttgtgatcatcttccagaacctggtgatgttcctgtctgtgctggtggactggatgatcccagacatccccacagacatcagtgaccagatcaagaaggagaagagcctgctggtggacttcttcctgaaggaggagcacgagaagctgaagctgatggatgagcccgccctgcggagccctgggggcggggacaggagccgcagcagagctgccagcagcgcccccagcggccagagccagctgggctccatgatgagcagcggcagccagcacaccaacgtgtag

SEQ ID NO: 143800 - DNA, 261 bp, Artificial Sequence
  Description of Artificial Sequence: Synthetic coding sequence
atgttcctgtctgtgctggtggactggatgatcccagacatccccacagacatcagtgaccagatcaagaaggagaagagcctgctggtggacttcttcctgaaggaggagcacgagaagctgaagctgatggatgagcccgccctgcggagccctgggggcggggacaggagccgcagccgggccgccagcagcgcccccagcggccagagccagctgggctccatgatgagcagcggcagccagcacaccaacgtgtag

SEQ ID NO: 143801 - DNA, 3000 bp, Artificial Sequence
  Description of Artificial Sequence: Synthetic coding sequence
atgcctgaggacatccccctgctgcccggcagcccccggcggctgagcccccaggccggcagcagaggaggccagggccccaagcacggccagcagtgcctgaagatgcctggcccccgggcccctggcctgcagggcggcagcaacagagaccccggccagccctgtggcggggagagcaccaggagcagcagcgtcatcaacaactacctggatgccaatgaacctgtgtccctggaggcccggctgagcaggatgcacttccatgacagccagaggaaggtggactatgtgctggcctaccactacaggaagaggggcgtgcacctggcccagggcttccctggccacagcctggccatcgtgtccaatggagaaacaggcaaggagccccatgctgggggccctggggacatcgagctgggccccctggatgccctggaggaggagaggaaggagcagcgggaggagtttgagcacaacctgatggaggccggcctggagctggagaaggacctggagaacaagagccagggcagcatctttgtgcgcatccacgccccctggcaggtgctggcccgggaggccgagttcctgaagatcaaggtgcccaccaagaaggagatgtatgagatcaaggccggcggcagcatcgccaagaagttctctgctgccctgcagaagctgagcagccacctgcagccccgggtgcctgagcacagcaacaacaagatgaagaacctgagctaccccttcagccgggagaagatgtacctgtacaacatccaggagaaggacaccttctttgacaatgccaccaggagcagaattgtgcatgagatcctgaagaggacagcctgcagccgggccaacaacaccatgggcatcaacagcctcatcgccaacaacatctatgaagctgcctaccccctgcatgatggagaatatgacagcccagaagatgacatgaatgacaggaagctgctgtaccaggagtgggcccgctatggagtcttctacaagttccagcccatcgacctgatcaggaagtactttggagagaagattggcctgtactttgcctggctgggcctgtacaccagcttcctgatccccagcagcgtcatcggcgtgattgtgttcctgtatggctgtgccaccatcgaggaggacatccccagccgggagatgtgtgaccagcagaatgccttcaccatgtgccccctgtgtgacaagagctgtgactactggaacctgagcagcgcctgtggcacagcccaggccagccacctgtttgacaacccagccaccgtcttcttcagcatcttcatggccctgtgggccaccatgttcctggagaactggaagaggctgcagatgaggctgggctacttctgggacctgactggaattgaggaggaggagccccgggtgcaggagcacagcaggccagaatatgagaccaaggtgcgggagaagatgctgaaggagagcaaccagagcgctgtgcagaagctggagaccaacaccacagaatgtggagatgaagatgatgaggacaagctgacctggaaggaccgcttccctggctacctgatgaactttgccagcatcctcttcatgattgccctgaccttcagcatcgtgtttggagtgattgtgtaccgcatcaccacagctgctgccctgagcctgaacaaggccaccaggagcaatgtgcgggtgacagtgacagccacagctgtgatcatcaacctggtggtgatcctgatcctggatgagatctacggggctgtggccaagtggctgaccaagattgaggtgcccaagacagagcagacctttgaggagcggctcatcctgaaggccttcctgctgaagtttgtgaatgcctacagccccatcttctacgtggccttcttcaagggccgctttgtgggccggcccggcagctatgtgtatgtgtttgatggctacaggatggaggagtgtgcccctgggggctgcctgatggagctgtgcatccagctgagcatcatcatgctgggcaagcagctgatccagaacaacatctttgaaattggagtgcccaagctgaagaagctgttcaggaagctgaaggatgaaacagaggccggggagacagattctgcccacagcaagcaccctgagcagtgggacctggactacagcctggagccctacacaggcctgaccccagagtacatggagatgatcatccagtttggatttgtgaccctgtttgtggccagcttccccctggcccctgtgtttgccctgctgaacaacgtcatcgaggtgcggctggatgccaagaagtttgtgacagagctgcggcggccagatgctgtgaggaccaaggacatcggcatctggtttgacatcctgagcggcatcggcaagttcagcgtcatcagcaatgccttcgtcatcgccatcaccagtgacttcatcccccggctggtgtaccagtacagctacagccacaacggcaccctgcacggctttgtgaaccacaccctgtccttcttcaacgtgtcccagctgaaggagggcacccagcctgagaacagccagtttgaccaggaggtgcagttctgccgcttcaaggactaccgggagcccccctgggcccccaacccctatgagttcagcaagcagtactggttcatcctgagcgcccggctggcctttgtgatcatcttccagaacctggtgatgttcctgtctgtgctggtggactggatgatcccagacatccccacagacatcagtgaccagatcaagaaggagaagagcctgctggtggacttcttcctgaaggaggagcacgagaagctgaagctgatggatgagcccgccctgcggagccctgggggcggggacaggagccgcagcagagctgccagcagcgcccccagcggccagagccagctgggctccatgatgagcagcggcagccagcacaccaacgtgtag

SEQ ID NO: 143802 - DNA, 2742 bp, Artificial Sequence
  Description of Artificial Sequence: Synthetic coding sequence
atgggagaccctgacctgctggaggtgctggccgaggagggggagaaggtgaacaagcacatcgactacagcttccagatgtctgagcagagcctgagcagccgggagaccagcttcctgatcaatgaggagaccatgcctgccaagcgcttcaacctcttcctgcggcggcggctgatgttccagaagaaccagcagagcaaggacagcatcttcttcagagatggcatccggcagattgactttgtgctgtcctatgtggatgatgtgaagaaggatgctgagctgaaggccgagaggaggaaggagtttgagaccaacctgaggaagacaggcctggagctggagattgaggacaagagggacagtgaagatggccgcacctactttgtgaagatccacgccccctgggaggtgctggtgacctacgccgaggtgctgggcatcaagatgcccatcaaggagagtgacatcccccggcccaagcacacccccatctcctatgtgctgggccctgtgcggctgcccctgtctgtgaagtacccccaccctgagtacttcaccgcccagttcagccgccaccggcaggagctgttcctgattgaggaccaggccaccttcttccccagcagcagcaggaaccgcatcgtgtactacatcctgagccgctgccccttcggcattgaagatggcaagaagagatttggaattgagcggctgctgaacagcaacacctacagcagcgcctaccccctgcatgatggccagtactggaagcccagcgagccccccaaccccaccaatgaaagatacaccctgcaccagaactgggcccgcttctcctacttctacaaggagcagcccctggacctgatcaagaactactacggggagaagattggcatctactttgtgttcctgggcttctacacagagatgctgttctttgctgctgtggtgggcctggcctgcttcatctacggcctgctgtccatggagcacaacaccagcagcacagagatctgtgaccctgagatcggcggccagatgatcatgtgccccctgtgtgaccaggtgtgtgactactggaggctgaacagcacctgcctggccagcaagttcagccacctgtttgacaatgaaagcacagtgttctttgccatcttcatgggcatctgggtgaccctcttcctggagttctggaagcagaggcaggcccggctggagtatgagtgggacctggtggactttgaggaggagcagcagcagctgcagctgcggcctgagtttgaggccatgtgcaagcacaggaagctgaatgctgtgaccaaggagatggagccctacatgcccctgtacacccgcatcccctggtacttcctgagcggggccaccgtgaccctgtggatgagcctggtggtgacctccatggtggccgtgattgtgtaccgcctgtctgtgtttgccacctttgccagcttcatggagagtgatgccagcctgaagcaggtgaagagcttcctgaccccccagatcaccaccagcctgaccggcagctgcctgaacttcatcgtcatcctgatcctgaacttcttctatgagaagatcagcgcctggatcaccaagatggagatccccaggacctaccaggagtatgagagcagcctgaccctgaagatgttcctgttccagtttgtgaacttctacagcagctgcttctacgtggccttcttcaagggcaagtttgtgggctacccaggcaagtacacctacctgttcaatgagtggaggtctgaggagtgtgaccccggcggctgcctgattgagctgaccacccagctgaccatcatcatgaccgggaagcagatcttcggcaacatcaaggaggccatctaccccctggccctgaactggtggaggaggaggaaggcccggaccaacagcgagaagctgtacagccgctgggagcaggaccatgacctggagagctttggccccctgggcctcttctatgagtacctggagaccgtgacccagtttggatttgtgaccctgtttgtggccagcttccccctggcccccctgctggccctgatcaacaacatcgtggagatccgggtggatgcctggaagctgaccacccagtacagaagaacagtggccagcaaggcccacagcattggagtgtggcaggacatcctgtatggcatggctgtgctgtctgtggccaccaatgccttcatcgtggccttcaccagtgacatcatcccccggctggtgtactactatgcctacagcaccaatgccacccagcccatgacaggctacgtgaacaacagcctgagcgtcttcctgattgctgacttccccaaccacacagcccccagcgagaagagggacttcatcacctgccgctacagagactaccgctaccccccagatgatgagaacaagtacttccacaacatgcagttctggcacgtgctggccgccaagatgaccttcatcatcgtgatggagcacgtggtgttcctggtgaagttcctgctggcctggatgatcccagatgtgcccaaggatgtggtggagcgcatcaagcgggagaagctgatgaccatcaagatcctgcatgactttgagctgaacaagctgaaggagaacctgggcatcaacagcaatgaatttgccaagcacgtgatgattgaggagaacaaggcccagctggccaagagcaccctgtag

SEQ ID NO: 143803 - DNA, 2733 bp, Artificial Sequence
  Description of Artificial Sequence: Synthetic coding sequence
atgaagaagatgagcagaaatgtgctgctgcagatggaggaggaggaggatgatgatgatggagacatcgtgctggagaacctgggccagaccatcgtgcctgacctgggcagcctggagagccagcacgacttccgcaccccagagtttgaggagttcaacgggaagccagacagcctcttcttcaatgatggccagaggagaattgactttgtgctggtgtatgaagatgagagcaggaaggagaccaacaagaagggcaccaatgagaagcagaggaggaagaggcaggcctatgagagcaacctgatctgccacggcctgcagctggaggccaccaggtctgtgctggatgacaagctggtgtttgtgaaggtgcacgccccctgggaggtgctgtgcacctatgcagagatcatgcacatcaagctgcccctgaagcccaatgacctgaagaacagaagcagcgccttcggcaccctgaactggttcaccaaggtgctgtctgtggatgagagcatcatcaagccagagcaggagttcttcaccgccccctttgagaagaacaggatgaatgacttctacatcgtggacagagatgccttcttcaacccagccaccaggagcagaattgtgtacttcatcctgagccgggtgaagtaccaggtgatcaacaacgtgtccaagtttggcatcaaccggctggtgaacagcggcatctacaaggccgccttccccctgcatgactgcaagttccggcggcagagcgaggaccccagctgccccaatgaaagatacctgctgtaccgggagtgggcccaccccaggagcatctacaagaagcagcccctggacctgatcaggaagtactatggagagaagattggcatctactttgcctggctgggctactacacccagatgctgctgctggccgctgtggtgggcgtggcctgcttcctgtatggctacctgaaccaggacaactgcacctggagcaaggaggtgtgccacccagacattggaggcaagatcatcatgtgcccccagtgtgaccggctgtgccccttctggaagctgaacatcacctgtgagagcagcaagaagctgtgcatctttgacagctttggcaccctggtgtttgctgtgttcatgggcgtgtgggtgaccctcttcctggagttctggaagaggcggcaggccgagctggagtatgagtgggacacagtggagctgcagcaggaggagcaggcccggccagaatatgaggcccgctgcacccacgtggtgatcaatgagatcacccaggaggaggagcgcatccccttcaccgcctggggcaagtgcatccgcatcaccctgtgtgccagcgctgtgttcttctggatcctgctgatcatcgcctctgtgattggcatcatcgtgtaccgcctgtctgtgttcatcgtgttttctgccaagctgcccaagaacatcaatggaacagaccccatccagaagtacctgaccccccagacagccaccagcatcacagccagcatcatctccttcatcatcatcatgatcctgaacaccatctatgagaaggtggccatcatgatcaccaactttgagctgcccaggacccagacagattatgagaacagcctgaccatgaagatgttcctgttccagtttgtgaactactacagcagctgcttctacatcgccttcttcaagggcaagtttgtgggctacccaggggaccctgtgtactggctgggcaagtacagaaatgaggagtgtgaccccggcggctgcctgctggagctgaccacccagctgaccatcatcatgggcggcaaggccatctggaacaacatccaggaggtgctgctgccctggatcatgaacctgattggccgcttccaccgggtgtctggcagcgagaagatcaccccccgctgggagcaggactaccacctgcagcccatgggcaagctgggcctcttctatgagtacctggagatgatcatccagtttggatttgtgaccctgtttgtggccagcttccccctggcccccctgctggccctggtgaacaacatcctggagatccgggtggatgcctggaagctgaccacccagttccggcggctggtgcctgagaaggcccaggacattggagcctggcagcccatcatgcagggcatcgccatcctggccgtggtgaccaatgccatgatcatcgccttcaccagtgacatgatcccccggctggtgtactactggagcttctctgtgcccccctacggggaccacaccagctacaccatggagggctacatcaacaacaccctgagcatcttcaaggtggccgacttcaagaacaagagcaaaggaaacccctacagcgacctgggcaaccacaccacctgccgctacagagacttccgctacccacctggccacccccaggagtacaagcacaacatctactactggcacgtgattgctgccaagctggccttcatcatcgtgatggagcacgtgatctacagcgtgaagttcttcatctcctatgccatcccagatgtgtccaagaggaccaagagcaagatccagcgggagaagtacctgacccagaagctgctgcacgagaaccacctgaaggacatgaccaagaacatgggcgtgattgctgagaggatgattgaggccgtggacaacaacctgcggcccaagtctgagtag

SEQ ID NO: 143804 - DNA, 2790 bp, Artificial Sequence
  Description of Artificial Sequence: Synthetic coding sequence
atgaagaagatgagcagaaatgtgctgctgcagatggaggaggaggaggatgatgatgatggagacatcgtgctggagaacctgggccagaccatcgtgcctgacctgggcagcctggagagccagcacgacttccgcaccccagagtttgaggagttcaacgggaagccagacagcctcttcttcaatgatggccagaggagaattgactttgtgctggtgtatgaagatgagagcaggaaggagaccaacaagaagggcaccaatgagaagcagaggaggaagaggcaggcctatgagagcaacctgatctgccacggcctgcagctggaggccaccaggtctgtgctggatgacaagctggtgtttgtgaaggtgcacgccccctgggaggtgctgtgcacctatgcagagatcatgcacatcaagctgcccctgaagcccaatgacctgaagaacagaagcagcgccttcggcaccctgaactggttcaccaaggtgctgtctgtggatgagagcatcatcaagccagagcaggagttcttcaccgccccctttgagaagaacaggatgaatgacttctacatcgtggacagagatgccttcttcaacccagccaccaggagcagaattgtgtacttcatcctgagccgggtgaagtaccaggtgatcaacaacgtgtccaagtttggcatcaaccggctggtgaacagcggcatctacaaggccgccttccccctgcatgactgcaagttccggcggcagagcgaggaccccagctgccccaatgaaagatacctgctgtaccgggagtgggcccaccccaggagcatctacaagaagcagcccctggacctgatcaggaagtactatggagagaagattggcatctactttgcctggctgggctactacacccagatgctgctgctggccgctgtggtgggcgtggcctgcttcctgtatggctacctgaaccaggacaactgcacctggagcaaggaggtgtgccacccagacattggaggcaagatcatcatgtgcccccagtgtgaccggctgtgccccttctggaagctgaacatcacctgtgagagcagcaagaagctgtgcatctttgacagctttggcaccctggtgtttgctgtgttcatgggcgtgtgggtgaccctcttcctggagttctggaagaggcggcaggccgagctggagtatgagtgggacacagtggagctgcagcaggaggagcaggcccggccagaatatgaggcccgctgcacccacgtggtgatcaatgagatcacccaggaggaggagcgcatccccttcaccgcctggggcaagtgcatccgcatcaccctgtgtgccagcgctgtgttcttctggatcctgctgatcatcgcctctgtgattggcatcatcgtgtaccgcctgtctgtgttcatcgtgttttctgccaagctgcccaagaacatcaatggaacagaccccatccagaagtacctgaccccccagacagccaccagcatcacagccagcatcatctccttcatcatcatcatgatcctgaacaccatctatgagaaggtggccatcatgatcaccaactttgagctgcccaggacccagacagattatgagaacagcctgaccatgaagatgttcctgttccagtttgtgaactactacagcagctgcttctacatcgccttcttcaagggcaagtttgtgggctacccaggggaccctgtgtactggctgggcaagtacagaaatgaggagtgtgaccccggcggctgcctgctggagctgaccacccagctgaccatcatcatgggcggcaaggccatctggaacaacatccaggaggtgctgctgccctggatcatgaacctgattggccgcttccaccgggtgtctggcagcgagaagatcaccccccgctgggagcaggactaccacctgcagcccatgggcaagctgggcctcttctatgagtacctggagatgatcatccagtttggatttgtgaccctgtttgtggccagcttccccctggcccccctgctggccctggtgaacaacatcctggagatccgggtggatgcctggaagctgaccacccagttccggcggctggtgcctgagaaggcccaggacattggagcctggcagcccatcatgcagggcatcgccatcctggccgtggtgaccaatgccatgatcatcgccttcaccagtgacatgatcccccggctggtgtactactggagcttctctgtgcccccctacggggaccacaccagctacaccatggagggctacatcaacaacaccctgagcatcttcaaggtggccgacttcaagaacaagagcaaaggaaacccctacagcgacctgggcaaccacaccacctgccgctacagagacttccgctacccacctggccacccccaggagtacaagcacaacatctactactggcacgtgattgctgccaagctggccttcatcatcgtgatggagtacctggccctgctgccccggctgggccacagcggcatgatcctggcccactgcaacctgcggctgcctgtggactgctgcatgtgctacagatttgtggatgagatccggctgctggagcagctgaccagtgacttcatcgacagcctgtactacatcttcagcatcagcatcatcagcatcttcttctctgtgaccttcttcttcctgctgctgagcctgggccccaccccctgcttctctgtgagcaacttcctgtcctag

SEQ ID NO: 143805 - DNA, 2790 bp, Artificial Sequence; identical to SEQ ID NO: 143804
  Description of Artificial Sequence: Synthetic coding sequence

SEQ ID NO: 143806 - DNA, 2679 bp, Artificial Sequence
  Description of Artificial Sequence: Synthetic coding sequence
atgttctgtgccgctgtgctggagaacctgggccagaccatcgtgcctgacctgggcagcctggagagccagcacgacttccgcaccccagagtttgaggagttcaacgggaagccagacagcctcttcttcaatgatggccagaggagaattgactttgtgctggtgtatgaagatgagagcaggaaggagaccaacaagaagggcaccaatgagaagcagaggaggaagaggcaggcctatgagagcaacctgatctgccacggcctgcagctggaggccaccaggtctgtgctggatgacaagctggtgtttgtgaaggtgcacgccccctgggaggtgctgtgcacctatgcagagatcatgcacatcaagctgcccctgaagcccaatgacctgaagaacagaagcagcgccttcggcaccctgaactggttcaccaaggtgctgtctgtggatgagagcatcatcaagccagagcaggagttcttcaccgccccctttgagaagaacaggatgaatgacttctacatcgtggacagagatgccttcttcaacccagccaccaggagcagaattgtgtacttcatcctgagccgggtgaagtaccaggtgatcaacaacgtgtccaagtttggcatcaaccggctggtgaacagcggcatctacaaggccgccttccccctgcatgactgcaagttccggcggcagagcgaggaccccagctgccccaatgaaagatacctgctgtaccgggagtgggcccaccccaggagcatctacaagaagcagcccctggacctgatcaggaagtactatggagagaagattggcatctactttgcctggctgggctactacacccagatgctgctgctggccgctgtggtgggcgtggcctgcttcctgtatggctacctgaaccaggacaactgcacctggagcaaggaggtgtgccacccagacattggaggcaagatcatcatgtgcccccagtgtgaccggctgtgccccttctggaagctgaacatcacctgtgagagcagcaagaagctgtgcatctttgacagctttggcaccctggtgtttgctgtgttcatgggcgtgtgggtgaccctcttcctggagttctggaagaggcggcaggccgagctggagtatgagtgggacacagtggagctgcagcaggaggagcaggcccggccagaatatgaggcccgctgcacccacgtggtgatcaatgagatcacccaggaggaggagcgcatccccttcaccgcctggggcaagtgcatccgcatcaccctgtgtgccagcgctgtgttcttctggatcctgctgatcatcgcctctgtgattggcatcatcgtgtaccgcctgtctgtgttcatcgtgttttctgccaagctgcccaagaacatcaatggaacagaccccatccagaagtacctgaccccccagacagccaccagcatcacagccagcatcatctccttcatcatcatcatgatcctgaacaccatctatgagaaggtggccatcatgatcaccaactttgagctgcccaggacccagacagattatgagaacagcctgaccatgaagatgttcctgttccagtttgtgaactactacagcagctgcttctacatcgccttcttcaagggcaagtttgtgggctacccaggggaccctgtgtactggctgggcaagtacagaaatgaggagtgtgaccccggcggctgcctgctggagctgaccacccagctgaccatcatcatgggcggcaaggccatctggaacaacatccaggaggtgctgctgccctggatcatgaacctgattggccgcttccaccgggtgtctggcagcgagaagatcaccccccgctgggagcaggactaccacctgcagcccatgggcaagctgggcctcttctatgagtacctggagatgatcatccagtttggatttgtgaccctgtttgtggccagcttccccctggcccccctgctggccctggtgaacaacatcctggagatccgggtggatgcctggaagctgaccacccagttccggcggctggtgcctgagaaggcccaggacattggagcctggcagcccatcatgcagggcatcgccatcctggccgtggtgaccaatgccatgatcatcgccttcaccagtgacatgatcccccggctggtgtactactggagcttctctgtgcccccctacggggaccacaccagctacaccatggagggctacatcaacaacaccctgagcatcttcaaggtggccgacttcaagaacaagagcaaaggaaacccctacagcgacctgggcaaccacaccacctgccgctacagagacttccgctacccacctggccacccccaggagtacaagcacaacatctactactggcacgtgattgctgccaagctggccttcatcatcgtgatggagcacgtgatctacagcgtgaagttcttcatctcctatgccatcccagatgtgtccaagaggaccaagagcaagatccagcgggagaagtacctgacccagaagctgctgcacgagaaccacctgaaggacatgaccaagaacatgggcgtgattgctgagaggatgattgaggccgtggacaacaacctgcggcccaagtctgagtag

SEQ ID NO: 143807 - DNA, 2796 bp, Artificial Sequence
  Description of Artificial Sequence: Synthetic coding sequence
atgaagaagatgagcagaaatgtgctgctgcagatggaggaggaggaggatgatgatgatggagacattggagatgtgcctgccagccggcggcccttcctgaccccccacacccacctgcccagcagcctggtgctggagaacctgggccagaccatcgtgcctgacctgggcagcctggagagccagcacgacttccgcaccccagagtttgaggagttcaacgggaagccagacagcctcttcttcaatgatggccagaggagaattgactttgtgctggtgtatgaagatgagagcaggaaggagaccaacaagaagggcaccaatgagaagcagaggaggaagaggcaggcctatgagagcaacctgatctgccacggcctgcagctggaggccaccaggtctgtgctggatgacaagctggtgtttgtgaaggtgcacgccccctgggaggtgctgtgcacctacgccgagatcatgcacatcaagctgcccctgaagcccaatgacctgaagaacagaagcagcgccttcggcaccctgaactggttcaccaaggtgctgtctgtggatgagagcatcatcaagccagagcaggagttcttcaccgccccctttgagaagaacaggatgaatgacttctacatcgtggacagagatgccttcttcaacccagccaccaggagccgcatcgtgtacttcatcctgagccgggtgaagtaccaggtgatcaacaacgtgtccaagtttggcatcaaccggctggtgaacagcggcatctacaaggccgccttccccctgcatgactgcaagttccggcggcagagcgaggaccccagctgccccaatgaaagatacctgctgtaccgggagtgggcccaccccaggagcatctacaagaagcagcccctggacctgatcaggaagtactacggggagaagattggcatctactttgcctggctgggctactacacccagatgctgctgctggccgctgtggtgggcgtggcctgcttcctgtatggctacctgaaccaggacaactgcacctggagcaaggaggtgtgccacccagacatcggcggcaagatcatcatgtgcccccagtgtgaccggctgtgccccttctggaagctgaacatcacctgtgagagcagcaagaagctgtgcatctttgacagctttggcaccctggtgtttgctgtgttcatgggcgtgtgggtgaccctcttcctggagttctggaagaggcggcaggccgagctggagtatgagtgggacacagtggagctgcagcaggaggagcaggcccggccagaatatgaggcccgctgcacccacgtggtgatcaatgagatcacccaggaggaggagcgcatccccttcaccgcctggggcaagtgcatccgcatcaccctgtgtgccagcgctgtgttcttctggatcctgctgatcatcgccagcgtcatcggcatcatcgtgtaccgcctgagcgtcttcatcgtgttcagcgccaagctgcccaagaacatcaatggaacagaccccatccagaagtacctgaccccccagacagccaccagcatcacagccagcatcatctccttcatcatcatcatgatcctgaacaccatctatgagaaggtggccatcatgatcaccaactttgagctgcccaggacccagacagattatgagaacagcctgaccatgaagatgttcctgttccagtttgtgaactactacagcagctgcttctacatcgccttcttcaagggcaagtttgtgggctacccaggggaccctgtgtactggctgggcaagtacagaaatgaagaatgtgaccccggcggctgcctgctggagctgaccacccagctgaccatcatcatgggcggcaaggccatctggaacaacatccaggaggtgctgctgccctggatcatgaacctgattggccgcttccaccgggtgtctggcagcgagaagatcaccccccgctgggagcaggactaccacctgcagcccatgggcaagctgggcctcttctatgagtacctggagatgatcatccagtttggatttgtgaccctgtttgtggccagcttccccctggcccccctgctggccctggtgaacaacatcctggagatccgggtggatgcctggaagctgaccacccagttccggcggctggtgcctgagaaggcccaggacatcggggcctggcagcccatcatgcagggcatcgccatcctggccgtggtgaccaatgccatgatcatcgccttcaccagtgacatgatcccccggctggtgtactactggagcttctctgtgcccccctatggagaccacaccagctacaccatggagggctacatcaacaacaccctgagcatcttcaaggtggccgacttcaagaacaagagcaagggcaacccctacagcgacctgggcaaccacaccacctgccgctacagagacttccgctacccacctggccacccccaggagtacaagcacaacatctactactggcacgtgattgctgccaagctggccttcatcatcgtgatggagcacgtgatctacagcgtgaagttcttcatctcctatgccatcccagatgtgtccaagaggaccaagagcaagatccagcgggagaagtacctgacccagaagctgctgcacgagaaccacctgaaggacatgaccaagaacatgggcgtgattgctgagaggatgattgaagctgtggacaacaacctgcggcccaagtctgagtag

SEQ ID NO: 143808 - DNA, 501 bp, Artificial Sequence
  Description of Artificial Sequence: Synthetic coding sequence
atgatgctgcacagcgccctgggcctgtgcctgctgctggtgacagtgagcagcaacctggccatcgccatcaagaaggagaagaggcctccccagaccctgagccggggctggggagatgacatcacctgggtgcagacctatgaggagggcctcttctacgcccagaagagcaagaagcccctgatggtgatccaccacctggaggactgccagtacagccaggccctgaagaaggtgtttgcccagaatgaggagatccaggagatggcccagaacaagttcatcatgctgaacctgatgcatgagaccacagacaagaacctgagcccagatggccagtatgtgccccgcatcatgtttgtggaccccagcctgactgtgcgggctgacattgctggccgctacagcaaccggctgtacacctatgagccccgggacctgcccctgctgattgagaacatgaagaaggccctgcggctcatccagagcgagctgtag

SEQ ID NO: 143809 - DNA, 453 bp, Artificial Sequence
  Description of Artificial Sequence: Synthetic coding sequence
atgggcgctgctgtgttcttcggctgcacctttgtggccttcggccctgcctttgccctcttcctgatcaccgtggccggggaccccctgcgggtcatcatcctggtggccggcaaggcagatgagggcctggccagcctgtctgaagatggccgcagccccatcagcatccggcagatggcctacgtgtctggcctgagctttggcatcatcagcggggtcttcagcgtcatcaacatcctggctgatgccctgggccctggggtggtgggcatccatggagacagcccctactacttcctgaccagcgccttcctgacagctgccatcatcctgctgcacaccttctggggcgtggtgttctttgatgcctgtgaaagaagacgctactgggccctgggcctggtggtgggcagccacctgctgaccagcggcctgaccttcctgaactag

SEQ ID NO: 143810 - DNA, 744 bp, Artificial Sequence
  Description of Artificial Sequence: Synthetic coding sequence
atgggcgctgctgtgttcttcggctgcacctttgtggccttcggccctgcctttgccctcttcctgatcaccgtggccggggaccccctgcgggtcatcatcctggtggccggggccttcttctggctggtgtccctgctgctggcctctgtggtgtggttcatcctggtgcacgtgacagacagaagtgatgcccggctgcagtatggcctgctgatctttggagctgctgtgtctgtgctgctgcaggaggtgttccgctttgcctactacaagctgctgaagaaggcagatgagggcctggccagcctgtctgaagatggccgcagccccatcagcatccggcagatggcctacgtgtctggcctgagctttggcatcatctctggagtcttcagcgtcatcaacatcctggctgatgccctgggccctggggtggtgggcatccacggggacagcccctactacttcctgaccagcgccttcctgacagctgccatcatcctgctgcacaccttctggggcgtggtgttctttgatgcctgtgagcggcggcgctactgggccctgggcctggtggtgggcagccacctgctgaccagcggcctgaccttcctgaacccctggtatgaggccagcctgctgcccatctatgctgtgacagtgtccatgggcctgtgggccttcatcacagctgggggcagcctgcggagcatccagaggagcctgctgtgcaaggactag

SEQ ID NO: 143811 - DNA, 798 bp, Artificial Sequence
  Description of Artificial Sequence: Synthetic coding sequence
atgggcgctgctgtgttcttcggctgcacctttgtggccttcggccctgcctttgccctcttcctgatcaccgtggccggggaccccctgcgggtcatcatcctggtggccggggccttcttctggctggtgtccctgctgctggcctctgtggtgtggttcatcctggtgcacgtgacagacagaagtgatgcccggctgcagtatggcctgctgatctttggagctgctgtgtctgtgctgctgcaggaggtgttccgctttgcctactacaagctgctgaagaaggcagatgagggcctggccagcctgtctgaagatggccgcagccccatcagcatccggcagatggcctacgtgtctggcctgagctttggcatcatctctggagtcttcagcgtcatcaacatcctggctgatgccctgggccctggggtggtgggcatccacggggacagcccctactacttcctgaccagcgccttcctgacagctgccatcatcctgctgcacaccttctggggcgtggtgttctttgatgcctgtgagcggcggcgctactgggccctgggcctggtggtgggcagccacctgctgaccagcggcctgaccttcctgaacccctggtatgaggccagcctgctgcccatctatgctgtgacagtgtccatgggcctgtgggccttcatcacagctgggggcagcctgcggagcatccagaggagcctgctgtgccggcggcaggaggacagccgggtgatggtgtacagcgccctgcgcatccccccagaggactag

SEQ ID NO: 143812 - DNA, 588 bp, Artificial Sequence
  Description of Artificial Sequence: Synthetic coding sequence
atgggcgctgctgtgttcttcggctgcacctttgtggccttcggccctgcctttgccctcttcctgatcaccgtggccggggaccccctgcgggtcatcatcctggtggccggccgctgcagcgccctgcccaccaccagctgcctgatcagcggcctgagctttggcatcatctctggagtcttcagcgtcatcaacatcctggctgatgccctgggccctggggtggtgggcatccacggggacagcccctactacttcctgaccagcgccttcctgacagctgccatcatcctgctgcacaccttctggggcgtggtgttctttgatgcctgtgagcggcggcgctactgggccctgggcctggtggtgggcagccacctgctgaccagcggcctgaccttcctgaacccctggtatgaggccagcctgctgcccatctatgctgtgacagtgtccatgggcctgtgggccttcatcacagctgggggcagcctgcggagcatccagaggagcctgctgtgccggcggcaggaggacagccgggtgatggtgtacagcgccctgcgcatccccccagaggactag

SEQ ID NO: 143813 - DNA, 774 bp, Artificial Sequence
  Description of Artificial Sequence: Synthetic coding sequence
atgacagctgctgtgttcttcggctgtgccttcatcgccttcggccctgccctggccctgtatgtgttcaccatcgccacagagcccctgcgcatcatcttcctgattgctggggccttcttctggctggtgtccctgctgatcagcagcctggtgtggttcatggcccgggtcatcatcgacaacaaggatggccccacccagaagtacctgctgatctttggagcctttgtgtctgtgtacatccaggagatgttccgctttgcctactacaagctgctgaagaaggccagcgagggcctgaagagcatcaaccctggagaaacagcccccagcatgaggctgctggcctacgtgtctggcctgggcttcggcatcatgtctggagtcttctcctttgtgaacaccctgagtgacagcctgggccctggcaccgtgggcatccatggagacagcccccagttcttcctgtacagcgccttcatgaccctggtgatcatcctgctgcacgtgttctggggcatcgtgttctttgatggctgtgagaagaagaagtggggcatcctgctgattgtgctgctgacccacctgctggtgtctgcccagaccttcatcagcagctactacggcatcaacctggccagcgccttcatcatcctggtgctgatgggcacctgggccttcctggccgccggcggcagctgccgcagcctgaagctgtgcctgctgtgccaggacaagaacttcctgctgtacaaccagaggagcaggtag

SEQ ID NO: 143814 - DNA, 246 bp, Artificial Sequence
  Description of Artificial Sequence: Synthetic coding sequence
atgacagctgctgtgttcttcggctgtgccttcatcgccttcggccctgccctggccctgtatgtgttcaccatcgccacagagcccctgcgcatcatcttcctgattgctggaagaagagtggagacctgcaagaacacagaggccccagactgtgccagccccagcggcagcctgtccttcctgctggtgggcgtgtccacagactttgtgccctgcctggtgcacggcaagagccactactag

SEQ ID NO: 143815 - DNA, 651 bp, Artificial Sequence
  Description of Artificial Sequence: Synthetic coding sequence
atgacagctgctgtgttcttcggctgtgccttcatcgccttcggccctgccctggccctgtatgtgttcaccatcgccacagagcccctgcgcatcatcttcctgattgctggggccttcttctggctggtgtccctgctgatcagcagcctggtgtggttcatggcccgggtcatcatcgacaacaaggatggccccacccagaagtacctgctgatctttggagcctttgtgtctgtgtacatccaggagatgttccgctttgcctactacaagctgctgaagaaggccagcgagggcctgaagagcatcaaccctggagaaacagcccccagcatgaggctgctggcctatgccttcatgaccctggtgatcatcctgctgcacgtgttctggggcatcgtgttctttgatggctgtgagaagaagaagtggggcatcctgctgattgtgctgctgacccacctgctggtgtctgcccagaccttcatcagcagctactacggcatcaacctggccagcgccttcatcatcctggtgctgatgggcacctgggccttcctggccgccggcggcagctgccgcagcctgaagctgtgcctgctgtgccaggacaagaacttcctgctgtacaaccagaggagcaggtag

SEQ ID NO: 143816 - DNA, 1695 bp, Artificial Sequence
  Description of Artificial Sequence: Synthetic coding sequence
atggccacagctgagcggcgggccctgggcatcggcttccagtggctgagcctggccaccctggtgctgatctgtgccggccagggcggcagaagagaagatggcggccctgcctgctacggcggctttgacctgtacttcatcctggacaagagcggctctgtgctgcaccactggaatgagatctactactttgtggagcagctggcccacaagttcatcagcccccagctgaggatgtccttcatcgtgttcagcacccggggcaccaccctgatgaagctgacagaagatcgggagcagatccggcagggcctggaggagctgcagaaggtgctgcccggcggggacacctacatgcatgagggctttgagcgggccagcgagcagatctactatgagaaccggcagggctacagaacagccagcgtcatcatcgccctgacagatggagagctgcatgaagatctcttcttctacagcgagcgggaggccaacagaagccgggacctgggcgccatcgtgtactgtgtgggcgtgaaggacttcaatgagacccagctggccagaattgctgacagcaaggaccacgtgtttcctgtgaatgatggcttccaggccctgcagggcatcatccacagcatcctgaagaagagctgcatcgagatcctggccgctgagcccagcaccatctgtgccggggagagcttccaggtggtggtgagaggaaatggcttcagacatgccagaaatgtggacagagtgctgtgcagcttcaagatcaatgacagcgtgaccctgaatgagaagcccttctctgtggaggacacctacctgctgtgcccagcccccatcctgaaggaggtgggcatgaaggccgccctgcaggtgtccatgaatgatggcctgtccttcatcagcagcagcgtcatcatcaccaccacccactgcagtgatggcagcatcctggccatcgccctgctgatcctcttcctgctgctggccctggccctgctgtggtggttctggcccctgtgctgcaccgtcatcatcaaggaggtgcccccacctcctgctgaggagagcgaggaggaggatgatgatggcctgcccaagaagaagtggcccaccgtggatgccagctactatggaggccggggcgtgggcggcatcaagaggatggaggtgcgctggggcgagaagggcagcacagaggagggcgccaagctggagaaggccaagaatgcccgggtgaagatgcctgagcaggagtatgagttccctgagcccaggaacctgaacaacaacatgaggcggcccagcagccccaggaagtggtacagccccatcaagggcaagctggatgccctgtgggtgctgctgaggaagggctatgacagagtgtctgtgatgaggccccagcccggggacaccggccgctgcatcaacttcaccagggtgaagaacaaccagcctgccaagtaccccctgaacaatgcctaccacaccagcagccccccaccagcccccatctacaccccacctcctccagccccccactgccccccacctcctccttctgcccccaccccacccatccccagcccccccagcaccctgcccccaccaccccaggcccccccacccaacagagcccccccacccagccggcccccaccccggcccagcgtgtag

SEQ ID NO: 143817 - DNA, 1107 bp, Artificial Sequence
  Description of Artificial Sequence: Synthetic coding sequence
atggccacagctgagcggcgggccctgggcatcggcttccagtggctgagcctggccaccctggtgctgatctgtgccggccagggcggcagaagagaagatggcggccctgcctgctacggcggctttgacctgtacttcatcctggacaagagcggctctgtgctgcaccactggaatgagatctactactttgtggagcagctggcccacaagttcatcagcccccagctgaggatgtccttcatcgtgttcagcacccggggcaccaccctgatgaagctgacagaagatcgggagcagatccggcagggcctggaggagctgcagaaggtgctgcccggcggggacacctacatgcatgagggctttgagcgggccagcgagcagatctactatgagaaccggcagggctacagaacagccagcgtcatcatcgccctgacagatggagagctgcatgaagatctcttcttctacagcgagcgggaggccaacagaagccgggacctgggcgccatcgtgtactgtgtgggcgtgaaggacttcaatgagacccagctggccagaattgctgacagcaaggaccacgtgtttcctgtgaatgatggcttccaggccctgcagggcatcatccacagcatcctgaagaagagctgcatcgagatcctggccgctgagcccagcaccatctgtgccggggagagcttccaggtggtggtgagaggaaatggcttcagacatgccagaaatgtggacagagtgctgtgcagcttcaagatcaatgacagcgtgaccctgaatgagaagcccttctctgtggaggacacctacctgctgtgcccagcccccatcctgaaggaggtgggcatgaaggccgccctgcaggtgtccatgaatgatggcctgtccttcatcagcagcagcgtcatcatcaccaccacccactgcagtgatggcagcatcctggccatcgccctgctgatcctcttcctgctgctggccctggccctgctgtggtggttctggcccctgtgctgcaccgtcatcatcaaggaggtgcccccacctcctgctgaggagagcgaggagaacaagatcaagtag

SEQ ID NO: 143818 - DNA, 1002 bp, Artificial Sequence
  Description of Artificial Sequence: Synthetic coding sequence
atggccacagctgagcggcgggccctgggcatcggcttccagtggctgagcctggccaccctggtgctgatctgtgccggccagggcggcagaagagaagatggcggccctgcctgctacggcggctttgacctgtacttcatcctggacaagagcggctctgtgctgcaccactggaatgagatctactactttgtggagcagctggcccacaagttcatcagcccccagctgaggatgtccttcatcgtgttcagcacccggggcaccaccctgatgaagctgacagaagatcgggagcagatccggcagggcctggaggagctgcagaaggtgctgcccggcggggacacctacatgcatgagggctttgagcgggccagcgagcagatctactatgagaaccggcagggctacagaacagccagcgtcatcatcgccctgacagatggagagctgcatgaagatctcttcttctacagcgagcgggaggccaacagaagccgggacctgggcgccatcgtgtactgtgtgggcgtgaaggacttcaatgagacccagctggccagaattgctgacagcaaggaccacgtgtttcctgtgaatgatggcttccaggccctgcagggcatcatccacagcatcctgaagaagagctgcatcgagatcctggccgctgagcccagcaccatctgtgccggggagagcttccaggtggtggtgagaggaaatggcttcagacatgccagaaatgtggacagagtgctgtgcagcttcaagatcaatgacagcgtgaccctgaatgagaagcccttctctgtggaggacacctacctgctgtgcccagcccccatcctgaaggaggtgggcatgaaggccgccctgcaggtgtccatgaatgatggcctgtccttcatcagcagcagcgtcatcatcaccaccacccactgcagcctgcacaagatcgccagcggccccaccacagctgcctgcatggagtag

SEQ ID NO: 143819 - DNA, 969 bp, Artificial Sequence
  Description of Artificial Sequence: Synthetic coding sequence
atggtggccgagaggagccctgcccggagccctggctcctggctgtttcctggcctgtggctgctggtgctgagcggccctgggggcctgctgcgggcccaggagcagcccagctgccggcgggcctttgacctgtactttgtgctggacaagagcggctctgtggccaacaactggattgagatctacaactttgtgcagcagctggccgagagatttgtgtccccagagatgaggctgtccttcatcgtgttcagcagccaggccaccatcatcctgcccctgaccggggaccggggcaagatcagcaagggcctggaggacctgaagagggtgtcccctgtgggggagacctacatccacgagggcctgaagctggccaatgagcagatccagaaggccggcggcctgaagaccagcagcatcatcatcgccctgacagatggcaagctggatggcctggtgcccagctatgcagagaaggaggccaagatcagccgcagcctgggcgcctctgtgtactgtgtgggcgtgctggactttgagcaggcccagctggagagaattgctgacagcaaggagcaggtgtttcctgtgaagggcggcttccaggccctgaagggcatcatcaacagcatcctggcccagagctgcacagagatcctggagctgcagcccagctctgtgtgtgtgggggaggagttccagatcgtgctgagcggccggggcttcatgctgggcagcagaaatggatctgtgctgtgcacctacacagtgaatgagacctacaccacctctgtgaagcctgtgtctgtgcagctgaacagcatgctgtgcccagcccccatcctgaacaaggccggggagtggggcctgactgtgacccaggccggcgtgaagtggcatgacctgacccactgcaccttcggcctgagcggcagcggggacccccccaccagcgccagctag

SEQ ID NO: 143820 - DNA, 1470 bp, Artificial Sequence
  Description of Artificial Sequence: Synthetic coding sequence
atggtggccgagaggagccctgcccggagccctggctcctggctgtttcctggcctgtggctgctggtgctgagcggccctgggggcctgctgcgggcccaggagcagcccagctgccggcgggcctttgacctgtactttgtgctggacaagagcggctctgtggccaacaactggattgagatctacaactttgtgcagcagctggccgagagatttgtgtccccagagatgaggctgtccttcatcgtgttcagcagccaggccaccatcatcctgcccctgaccggggaccggggcaagatcagcaagggcctggaggacctgaagagggtgtcccctgtgggggagacctacatccacgagggcctgaagctggccaatgagcagatccagaaggccggcggcctgaagaccagcagcatcatcatcgccctgacagatggcaagctggatggcctggtgcccagctatgcagagaaggaggccaagatcagccgcagcctgggcgcctctgtgtactgtgtgggcgtgctggactttgagcaggcccagctggagagaattgctgacagcaaggagcaggtgtttcctgtgaagggcggcttccaggccctgaagggcatcatcaacagcatcctggcccagagctgcacagagatcctggagctgcagcccagctctgtgtgtgtgggggaggagttccagatcgtgctgagcggccggggcttcatgctgggcagcagaaatggatctgtgctgtgcacctacacagtgaatgagacctacaccacctctgtgaagcctgtgtctgtgcagctgaacagcatgctgtgcccagcccccatcctgaacaaggccggggagaccctggatgtgtctgtgtccttcaacggcggcaagagcgtcatcagcggcagcctgattgtgacagccacagagtgcagcaatggaattgctgccatcatcgtcatcctggtgctgctgctgctgctgggcatcggcctgatgtggtggttctggcccctgtgctgcaaggtggtgatcaaggaccccccacctcctccagccccagcccccaaggaggaggaggaggagcccctgcccaccaagaagtggcccaccgtggatgccagctactatggaggccggggcgtgggcggcatcaagaggatggaggtgcgctggggagacaagggcagcacagaggagggcgcccggctggagaaggccaagaatgctgtggtgaagatccctgaggagacagaggagcccatccggccccggcccccccggcccaagcccacccaccagcccccccagaccaagtggtacacccccatcaagggccgcctggatgccctgtgggccctgctgcggcggcagtatgacagagtgtccctgatgaggccccaggagggagatgaggtgtgcatctgggagtgcatcgagaaggagctgacagcctag

SEQ ID NO: 143821 - DNA, 1161 bp, Artificial Sequence
  Description of Artificial Sequence: Synthetic coding sequence
atggtggccgagaggagccctgcccggagccctggctcctggctgtttcctggcctgtggctgctggtgctgagcggccctgggggcctgctgcgggcccaggagcagcccagctgccggcgggcctttgacctgtactttgtgctggacaagagcggctctgtggccaacaactggattgagatctacaactttgtgcagcagctggccgagagatttgtgtccccagagatgaggctgtccttcatcgtgttcagcagccaggccaccatcatcctgcccctgaccggggaccggggcaagatcagcaagggcctggaggacctgaagagggtgtcccctgtgggggagacctacatccacgagggcctgaagctggccaatgagcagatccagaaggccggcggcctgaagaccagcagcatcatcatcgccctgacagatggcaagctggatggcctggtgcccagctatgcagagaaggaggccaagatcagccgcagcctgggcgcctctgtgtactgtgtgggcgtgctggactttgagcaggcccagctggagagaattgctgacagcaaggagcaggtgtttcctgtgaagggcggcttccaggccctgaagggcatcatcaacagcagcaatggaattgctgccatcatcgtcatcctggtgctgctgctgctgctgggcatcggcctgatgtggtggttctggcccctgtgctgcaaggtggtgatcaaggaccccccacctcctccagccccagcccccaaggaggaggaggaggagcccctgcccaccaagaagtggcccaccgtggatgccagctactacggcggccggggcgtgggcggcatcaagaggatggaggtgcgctggggagacaagggcagcacagaggagggcgcccggctggagaaggccaagaatgctgtggtgaagatccctgaggagacagaggagcccatccggcccaggcctccccggcccaagcccacccaccagcccccccagaccaagtggtacacccccatcaagggccgcctggatgccctgtgggccctgctgcggcggcagtatgacagagtgtccctgatgaggccccaggagggagatgaggtgtgcatctgggagtgcatcgagaaggagctgacagcctag

SEQ ID NO: 143822 - DNA, 1467 bp, Artificial Sequence
  Description of Artificial Sequence: Synthetic coding sequence
atggtggccgagaggagccctgcccggagccctggctcctggctgtttcctggcctgtggctgctggtgctgagcggccctgggggcctgctgcgggcccaggagcagcccagctgccggcgggcctttgacctgtactttgtgctggacaagagcggctctgtggccaacaactggattgagatctacaactttgtgcagcagctggccgagagatttgtgtccccagagatgaggctgtccttcatcgtgttcagcagccaggccaccatcatcctgcccctgaccggggaccggggcaagatcagcaagggcctggaggacctgaagagggtgtcccctgtgggggagacctacatccacgagggcctgaagctggccaatgagcagatccagaaggccggcggcctgaagaccagcagcatcatcatcgccctgacagatggcaagctggatggcctggtgcccagctatgcagagaaggaggccaagatcagccgcagcctgggcgcctctgtgtactgtgtgggcgtgctggactttgagcaggcccagctggagagaattgctgacagcaaggagcaggtgtttcctgtgaagggcggcttccaggccctgaagggcatcatcaacagcatcctggcccagagctgcacagagatcctggagctgcagcccagctctgtgtgtgtgggggaggagttccagatcgtgctgagcggccggggcttcatgctgggcagcagaaatggatctgtgctgtgcacctacacagtgaatgagacctacaccacctctgtgaagcctgtgtctgtgcagctgaacagcatgctgtgcccagcccccatcctgaacaaggccggggagaccctggatgtgtctgtgtccttcaacggcggcaagagcgtcatcagcggcagcctgattgtgacagccacagagtgcagcaatggaattgctgccatcatcgtcatcctggtgctgctgctgctgctgggcatcggcctgatgtggtggttctggcccctgtgctgcaaggtggtgatcaaggaccccccacctcctccagccccagcccccaaggaggaggaggaggagcccctgcccaccaagaagtggcccaccgtggatgccagctactatggaggccggggcgtgggcggcatcaagaggatggaggtgcgctggggagacaagggcagcacagaggagggcgcccggctggagaaggccaagaatgctgtggtgaagatccctgaggagacagaggagcccatccggccccggcccccccggcccaagcccacccaccagcccccccagaccaagtggtacacccccatcaagggccgcctggatgccctgtgggccctgctgcggcggcagtatgacagagtgtccctgatgaggccccaggagggagatgagggccgctgcatcaacttcagccgggtgcccagccagtag

SEQ ID NO: 143823 - DNA, 2217 bp, Artificial Sequence
  Description of Artificial Sequence: Synthetic coding sequence
atgaggggccccagcggggccctgtggctgctgctggccctgaggacagtgctgggcggcatggaggtgcgctggtgtgccaccagtgaccctgagcagcacaagtgtggcaacatgtctgaggccttccgggaggccggcatccagcccagcctgctgtgtgtgcggggcaccagcgctgaccactgtgtgcagctgattgctgcccaggaggctgatgccatcaccctggatggaggagccatctatgaagctgggaaggagcacggcctgaagcctgtggtgggggaggtgtatgaccaggaggtgggcaccagctactatgctgtggccgtggtgcggcgcagcagccacgtgaccatcgacaccctgaagggcgtgaagagctgccacacaggcatcaacagaacagtgggctggaatgtgcctgtgggctacctggtggagagcggccgcctgtctgtgatgggctgtgatgtgctgaaggctgtgtctgactactttggaggcagctgtgtgcctggggccggggagaccagctacagcgagagcctgtgccgcctgtgccgcggggacagcagcggggagggcgtgtgtgacaagagccccctggagcgctactatgactacagcggggccttccgctgcctggccgagggcgctggagatgtggcctttgtgaagcacagcacagtgctggagaacacagatggcaagaccctgcccagctggggccaggccctgctgagccaggactttgagctgctgtgcagagatggcagcagagcagatgtgacagagtggaggcagtgccacctggcccgggtgcctgcccatgctgtggtggtgcgggctgacacagatggcggcctcatcttccggctgctgaatgaaggccagaggctcttcagccatgagggcagcagcttccagatgttcagcagcgaggcctacggccagaaggacctgctcttcaaggacagcaccagcgagctggtgcccatcgccacccagacctatgaggcctggctgggccacgagtacctgcacgccatgaagggcctgctgtgtgaccccaaccggctgcccccctacctgcgctggtgtgtgctgagcaccccagagatccagaagtgtggggacatggctgtggccttccggcggcagaggctgaagccagagatccagtgtgtgtctgccaagagcccccagcactgcatggagcgcatccaggccgagcaggtggatgctgtgaccctgtctggagaggacatctacacagctgggaagacctacggcctggtgcctgctgctggggagcactacgcccctgaggacagcagcaacagctactacgtggtggccgtggtgcggcgggacagcagccacgccttcaccctggatgagctgcggggcaagaggagctgccacgccggcttcggcagccctgctggctgggatgtgcctgtgggcgccctgatccagaggggcttcatccggcccaaggactgtgatgtgctgacagctgtgtctgagttcttcaatgccagctgtgtgcctgtgaacaaccccaagaactaccccagcagcctgtgtgccctgtgtgtgggagatgagcagggcaggaacaagtgtgtgggcaacagccaggagcgctactacggctacagaggagccttccgctgcctggtggagaatgctggagatgtggcctttgtgcgccacaccaccgtgtttgacaacaccaacggccacaacagcgagccctgggccgctgagctgcggagtgaagattatgagctgctgtgccccaatggagcccgggcagaggtgtcccagtttgctgcctgcaacctggcccagatcccccctcatgctgtgatggtgcggccagacaccaacatcttcaccgtgtatggcctgctggacaaggcccaggacctgtttggagatgaccacaacaagaatggcttcaagatgtttgacagcagcaactaccacggccaggacctgctcttcaaggatgccaccgtgcgggctgtgcctgtgggggagaagaccacctaccggggctggctgggcctggactatgtggccgccctggagggcatgagcagccagcagtgcagcggggctgctgccccagcccctggggcccccctgctgcccctgctgctgcctgccctggccgcccggctgctgcccccagccctgtag

SEQ ID NO: 143824 - DNA, 909 bp, Artificial Sequence
  Description of Artificial Sequence: Synthetic coding sequence
atgaggggccccagcggggccctgtggctgctgctggccctgaggacagtgctgggcggcatggaggtgcgctggtgtgccaccagtgaccctgagcagcacaagtgtggcaacatgtctgaggccttccgggaggccggcatccagcccagcctgctgtgtgtgcggggcaccagcgctgaccactgtgtgcagctgattgctgcccaggaggctgatgccatcaccctggatggaggagccatctatgaagctgggaaggagcacggcctgaagcctgtggtgggggaggtgtatgaccaggaggtgggcaccagctactatgctgtggccgtggtgcggcgcagcagccacgtgaccatcgacaccctgaagggcgtgaagagctgccacacaggcatcaacagaacagtgggctggaatgtgcctgtgggctacctggtggagagcggccgcctgtctgtgatgggctgtgatgtgctgaaggctgtgtctgactactttggaggcagctgtgtgcctggggccggggagaccagctacagcgagagcctgtgccgcctgtgccgcggggacagcagcggggagggcgtgtgtgacaagagccccctggagcgctactatgactacagcggggccttccgctgcctggccgagggcgctggagatgtggcctttgtgaagcacagcacagtgctggagaacacagatgagagccccagccggcggcagacctggaccaggtctgaggaggaggagggagaatgtcctgcccacgaggaggcccggaggaccatgaggagcagcgctggccaggcctggaagtgggcccctgtgcaccggccccaggatgaaagtgacaagggggagtttgggaagagggccaagagccgggacatgctgggctag

SEQ ID NO: 143825 - DNA, 1395 bp, Artificial Sequence
  Description of Artificial Sequence: Synthetic coding sequence
atggacttccagcacaggcctgggggcaagacaggcagcggaggagtggccagcagcagcgagagcaacagagaccggcgggagcggctgcggcagctggccctggagaccatcgacatcaacaaggacccctacttcatgaagaaccacctgggcagctatgagtgcaagctgtgcctgaccctgcacaacaatgaaggcagctacctggcccacacccagggcaagaagcaccagaccaacctggcccggcgggccgccaaggaggccaaggaggccccagcccagcctgcccctgagaaggtgaaggtggaggtgaagaagtttgtgaagattggccggcccggctacaaggtgaccaagcagagggacagcgagatgggccagcagagcctgctcttccagattgactacccagaaattgctgagggcatcatgcccaggcaccgcttcatgtctgcctatgagcagagaattgagcccccagaccggcgctggcagtacctgctgatggctgctgagccctatgagaccatcgccttcaaggtgcccagccgggagattgacaaggccgagggcaagttctggacccactggaaccgggagaccaagcagttcttcctgcagttccacttcaagatggagaagcccccagccccacccagcctgcctgctggccccccaggagtgaagaggcctcctccacccctgatgaatggcctgccccccaggcctcccctgcctgagagcctgcccccacctcctcctgggggcctgcccctgccccccatgcccccaactggacctgcccccagcggccccccaggccccccccagctgcccccaccagcccctggggtgcaccccccagcccctgtggtgcaccccccagccagcggcgtgcaccccccagcccctggggtgcaccccccagcccctggggtgcaccccccagcccctggggtgcacccccccaccagcggcgtgcaccccccagcccctggggtgcaccccccagcccctggggtgcaccccccagcccctggggtgcaccccccagcccctggggtgcaccccccagcccctggggtgcaccccccaccttctgctggggtgcacccccaggcccctggggtgcaccctgctgccccagctgtgcacccccaggcccctggggtgcaccccccagcccctggcatgcacccccaggcccctggggtgcacccccagcccccaggagtgcaccccagcgcccctggggtgcacccccagcccccaggagtgcaccccagcaaccctggggtgcacccccccacccccatgccacccatgctgcggccccccctgcccagcgagggccctggcaacatccccccacctccacccaccaactag

SEQ ID NO: 143826 - DNA, 1437 bp, Artificial Sequence
  Description of Artificial Sequence: Synthetic coding sequence
atgctgggcagcctgggcctgtgggccctgctgcccacagctgtggaggccccacccaacagaaggacctgtgtgttctttgaggcccctggggtgcggggcagcaccaagaccctgggggagctgctggacacaggaacagagctgccccgggccatccgctgcctgtacagccgctgctgcttcggcatctggaacctgacccaggaccgggcccaggtggagatgcagggctgccgggacagtgatgagcccggctgtgagagcctgcactgtgaccccagcccccgggcccaccccagccctggcagcaccctcttcacctgcagctgtggcacagacttctgcaatgccaactacagccacctgcccccacctggcagccctggcaccccaggcagccagggcccccaggccgcccctggagagagcatctggatggccctggtgctgctgggcctcttcctgctgctgctgctgctgctgggcagcatcatcctggccctgctgcagaggaagaactacagagtgcggggggagcctgtgcctgagcccaggccagattctggccgggactggagcgtggagctgcaggagctgcctgagctgtgcttcagccaggtgatccgggagggcggccatgctgtggtgtgggccggccagctgcagggcaagctggtggccatcaaggccttccccccaagatctgtggcccagttccaggccgagcgggccctgtatgagctgcccggcctgcagcacgaccacatcgtgcgcttcatcacagccagccggggcggccctggccgcctgctgagcggccccctgctggtgctggagctgcaccccaagggcagcctgtgccactacctgacccagtacaccagtgactggggcagcagcctgaggatggccctgagcctggcccagggcctggccttcctgcacgaggagcgctggcagaatggccagtacaagccaggcatcgcccaccgggacctgagcagccagaatgtgctgatcagagaagatggcagctgtgccatcggggacctgggcctggccctggtgctgcccggcctgacccagcccccagcctggacccccacccagccccagggccctgctgccatcatggaggaccctgatggcctgcgggagctgctggaggactgctgggatgctgaccctgaggcccggctgacagcagaatgtgtgcagcagaggctggccgccctggcccacccccaggagagccaccccttccctgagagctgcccccggggctgcccccccctgtgcccagaggactgcaccagcatcccagcccccaccatcctgccctgccggccccagaggtctgcctgccacttctctgtgcagcagggcccctgcagcaggaacccccagcctgcctgcaccctgagccctgtgtag

SEQ ID NO: 143827 - DNA, 1437 bp, Artificial Sequence
  Description of Artificial Sequence: Synthetic coding sequence
atgctgggcagcctgggcctgtgggccctgctgcccacagctgtggaggccccacccaacagaaggacctgtgtgttctttgaggcccctggggtgcggggcagcaccaagaccctgggggagctgctggacacaggaacagagctgccccgggccatccgctgcctgtacagccgctgctgcttcggcatctggaacctgacccaggaccgggcccaggtggagatgcagggctgccgggacagtgatgagcccggctgtgagagcctgcactgtgaccccagcccccgggcccaccccagccctggcagcaccctcttcacctgcagctgtggcacagacttctgcaatgccaactacagccacctgcccccacctggcagccctggcaccccaggcagccagggcccccaggccgcccctggagagagcatctggatggccctggtgctgctgggcctcttcctgctgctgctgctgctgctgggcagcatcatcctggccctgctgcagaggaagaactacagagtgcggggggagcctgtgcctgagcccaggccagattctggccgggactggagcgtggagctgcaggagctgcctgagctgtgcttcagccaggtgatccgggagggcggccatgctgtggtgtgggccggccagctgcagggcaagctggtggccatcaaggccttccccccaagatctgtggcccagttccaggccgagcgggccctgtatgagctgcccggcctgcagcacgaccacatcgtgcgcttcatcacagccagccggggcggccctggccgcctgctgagcggccccctgctggtgctggagctgcaccccaagggcagcctgtgccactacctgacccagtacaccagtgactggggcagcagcctgaggatggccctgagcctggcccagggcctggccttcctgcacgaggagcgctggcagaatggccagtacaagccaggcatcgcccaccgggacctgagcagccagaatgtgctgatcagagaagatggcagctgtgccatcggggacctgggcctggccctggtgctgcccggcctgacccagcccccagcctggacccccacccagccccagggccctgctgccatcatggaggccggcacccagcgctacatggcccctgagctgctggacaagaccctggacctgcaggactggggcatggccctgcggcgggctgacatctacagcctggccctgctgctgtgggagatcctgagccgctgcccagacctgcggcctgctgtgcaccaccccagcaactggcccatgaggcagaactgggccatccccctgcccctgatgtcctatggcccctggcagtgccggcggggcggcgtgcccaccagccaccccccaggggccgccctgccccagaccctgatgggctag

SEQ ID NO: 143828 - DNA, 1722 bp, Artificial Sequence
  Description of Artificial Sequence: Synthetic coding sequence
atgctgggcagcctgggcctgtgggccctgctgcccacagctgtggaggccccacccaacagaaggacctgtgtgttctttgaggcccctggggtgcggggcagcaccaagaccctgggggagctgctggacacaggaacagagctgccccgggccatccgctgcctgtacagccgctgctgcttcggcatctggaacctgacccaggaccgggcccaggtggagatgcagggctgccgggacagtgatgagcccggctgtgagagcctgcactgtgaccccagcccccgggcccaccccagccctggcagcaccctcttcacctgcagctgtggcacagacttctgcaatgccaactacagccacctgcccccacctggcagccctggcaccccaggcagccagggcccccaggccgcccctggagagagcatctggatggccctggtgctgctgggcctcttcctgctgctgctgctgctgctgggcagcatcatcctggccctgctgcagaggaagaactacagagtgcggggggagcctgtgcctgagcccaggccagattctggccgggactggagcgtggagctgcaggagctgcctgagctgtgcttcagccaggtgatccgggagggcggccatgctgtggtgtgggccggccagctgcagggcaagctggtggccatcaaggccttccccccaagatctgtggcccagttccaggccgagcgggccctgtatgagctgcccggcctgcagcacgaccacatcgtgcgcttcatcacagccagccggggcggccctggccgcctgctgagcggccccctgctggtgctggagctgcaccccaagggcagcctgtgccactacctgacccagtacaccagtgactggggcagcagcctgaggatggccctgagcctggcccagggcctggccttcctgcacgaggagcgctggcagaatggccagtacaagccaggcatcgcccaccgggacctgagcagccagaatgtgctgatcagagaagatggcagctgtgccatcggggacctgggcctggccctggtgctgcccggcctgacccagcccccagcctggacccccacccagccccagggccctgctgccatcatggaggccggcacccagcgctacatggcccctgagctgctggacaagaccctggacctgcaggactggggcatggccctgcggcgggctgacatctacagcctggccctgctgctgtgggagatcctgagccgctgcccagacctgcggccagacagcagccccccacccttccagctggcctatgaggccgagctgggcaacacccccaccagtgatgagctgtgggccctggccgtgcaggagcggcggcggccctacatccccagcacctggcgctgctttgccacagatcctgatggcctgcgggagctgctggaggactgctgggatgctgaccctgaggcccggctgacagcagaatgtgtgcagcagaggctggccgccctggcccacccccaggagagccaccccttccctgagagctgcccccggggctgcccccccctgtgcccagaggactgcaccagcatcccagcccccaccatcctgccctgccggccccagaggtctgcctgccacttctctgtgcagcagggcccctgcagcaggaacccccagcctgcctgcaccctgagccctgtgtag

SEQ ID NO: 143829 - DNA, 1347 bp, Artificial Sequence
  Description of Artificial Sequence: Synthetic coding sequence
atgaagggcttcattgatgatgccaactacagcgtgggcctgctggatgagggcaccaacctgggcaatgtgattgacaactacgtgtatgagcacaccctgaccgggaagaatgccttctttgtgggggacctgggcaagatcgtgaagaagcacagccagtggcagaatgtggtggcccagatcaagcccttctacacagtgaagtgcaacagcgccccagctgtgctggagatcctggccgccctgggcactggatttgcctgcagcagcaagaatgagatggccctggtgcaggagctgggcgtgcccccagagaacatcatctacatcagcccctgcaagcaggtgtcccagatcaagtatgctgccaaggtgggcgtgaacatcctgacctgtgacaatgaaattgagctgaagaagatcgccaggaaccaccccaatgccaaggtgctgctgcacatcgccacagaggacaacattggaggagaggagggcaacatgaagtttggcaccaccctgaagaactgccgccacctgctggagtgtgccaaggagctggatgtgcagatcatcggcgtgaagttccacgtgagcagcgcctgcaaggagagccaggtgtatgtgcacgccctgagtgatgcccgctgtgtgtttgacatggccggggagatcggcttcaccatgaacatgctggacatcggcggcggcttcaccggcacagagttccagctggaggaggtgaaccacgtgatcagccccctgctggacatctacttccctgagggcagcggcgtgaagatcatcagcgagcccggcagctactacgtgtcctctgccttcaccctggccgtgaacatcatcgccaagaaggtggtggagaatgacaagttccccagcggcgtggagaagacaggcagtgatgagcccgccttcatgtactacatgaatgatggagtgtatggcagctttgccagcaagctgtctgaggacctgaacaccatccctgaggtgcacaagaagtacaaggaggatgagcccctcttcaccagcagcctgtggggccccagctgtgatgagctggaccagatcgtggagagctgcctgctgcctgagctgaatgtgggggactggctgatctttgacaacatgggcgctgacagcttccacgagcccagcgccttcaatgacttccagaggcctgccatctactacatgatgtccttcagtgactggtatgagatgcaggatgctggcatcaccagtgacagcatgatgaagaacttcttctttgtgcccagctgcatccagctgagccaggaggacagcttctctgctgaggcctag

SEQ ID NO: 143830 - DNA, 1347 bp, Artificial Sequence; identical to SEQ ID NO: 143829
  Description of Artificial Sequence: Synthetic coding sequence

SEQ ID NO: 143831 - DNA, 102 bp, Artificial Sequence
  Description of Artificial Sequence: Synthetic coding sequence
atgaagggcttcattgatgatgccaactacagcgtgggcctgctggatgagggcaccaacctgggcaatgtgattgacaactacgtgtatgagcacacctag

SEQ ID NO: 143832 - DNA, 294 bp, Artificial Sequence
  Description of Artificial Sequence: Synthetic coding sequence
atgaagggcttcattgatgatgccaactacagcgtgggcctgctggatgagggcaccaacctgggcaatgtgattgacaactacgtgtatgagcacaccctgaccgggaagaatgccttctttgtgggggacctgggcaagatcgtgaagaagcacagccagtggcagaatgtggtggcccagatcaagcccttctacacagtgaagtgcaacagcgccccagctgtgctggagatcctggccgccctgggcactggatttgcctgcagcagcaagaatgagatggccctgtag

SEQ ID NO: 143833 - DNA, 780 bp, Artificial Sequence
  Description of Artificial Sequence: Synthetic coding sequence
atgagaagagctgtggcctacatggccatcaagattgaggtgcagggccaccagagctttgccatccccagcggcaccttctggctgtggaggagcctgctgagccaggacaaggagcacccccgctacctgatccctgagctgtgcaagcagttctaccacctgggctgggtgactggaactggaggcggcatcagcctgaagcatggagatgagatctacatcgcccccagcggcgtgcagaaggagcgcatccagcctgaggacatgtttgtgtgtgacatcaatgagaaggacatcagcggccccagccccagcaagaagctgaagaagagccagtgcacccccctcttcatgaatgcctacaccatgagaggagctggagctgtgatccacacccacagcaaggctgctgtgatggccaccctgctcttccctggccgggagttcaagatcacccaccaggagatgatcaagggcatcaagaagtgcaccagcggcggctactaccgctatgatgacatgctggtggtgcccatcatcgagaacaccccagaggagaaggacctgaaggacaggatggcccacgccatgaatgagtacccagacagctgtgctgtgctggtgagaagacatggagtgtatgtgtggggcgagacctgggagaaggccaagaccatgtgtgaatgttatgactacctgtttgatattgctgtgtccatgaagaaggtgggcctggaccccagccagctgcctgtgggagaaaatggcatcgtgtag

SEQ ID NO: 143834 - DNA, 729 bp, Artificial Sequence
  Description of Artificial Sequence: Synthetic coding sequence
atgagcggctgtgatgcccgggagggggactgctgcagccgccgctgtggggcccaggacaaggagcacccccgctacctgatccctgagctgtgcaagcagttctaccacctgggctgggtgacaggcaccggcggcggcatcagcctgaagcatggagatgagatctacatcgcccccagcggcgtgcagaaggagcgcatccagcctgaggacatgtttgtgtgtgacatcaatgagaaggacatcagcggccccagccccagcaagaagctgaagaagagccagtgcacccccctcttcatgaatgcctacaccatgagaggagctggggccgtcatccacacccacagcaaggctgctgtgatggccaccctgctcttccctggccgggagttcaagatcacccaccaggagatgatcaagggcatcaagaagtgcaccagcggcggctactaccgctatgatgacatgctggtggtgcccatcatcgagaacaccccagaggagaaggacctgaaggacaggatggcccacgccatgaatgagtacccagacagctgtgctgtgctggtgagaagacatggagtgtatgtgtggggcgagacctgggagaaggccaagaccatgtgtgagtgctatgactacctgtttgatattgctgtgtccatgaagaaggtgggcctggaccccagccagctgcctgtgggggagaatggaattgtgtag

SEQ ID NO: 143835 - DNA, 234 bp, Artificial Sequence
  Description of Artificial Sequence: Synthetic coding sequence
atgaacctgcggctgtgtgtgcaggccctgctgctgctgtggctgagcctgacagctgtgtgtggcggcagcctgatgcccctgcctgatggaaatggcctggaggatggaaatgtgcgccacctggtgcagccccggggcagcagaaatggacctggcccctggcagggcggccgcaggaagttccggcggcagaggccccggctgagccacaagggccccatgcccttctag

SEQ ID NO: 143836 - DNA, 369 bp, Artificial Sequence
  Description of Artificial Sequence: Synthetic coding sequence
atgtctgccacctggtgcagccctgagggccagggcatgggccagggccctggccgggaggtgggcggcaacagcgctgccagcggccctgccagccccatccgggacccctgcctgtctgaggccggcctgaagggccccccatctgcccacccccggcggctgtgcctgctgcaccggctggtgtgcttcagcggcggcctgaccagcatccagctgagccccaggacctgctgcagccaccagtgggcccagctgttctccccagcctgcttcccccagtggagggcccctggctgcagcctggatgacagccgcagcctgacccgcatccggcctgtgcacctgcccggccccagcctggactag

SEQ ID NO: 143837 - DNA, 369 bp, Artificial Sequence; identical to SEQ ID NO: 143836
  Description of Artificial Sequence: Synthetic coding sequence

SEQ ID NO: 143838 - DNA, 303 bp, Artificial Sequence
  Description of Artificial Sequence: Synthetic coding sequence
atgaagctgctggccgccaccgtgctgctgctgaccatctgcagcctggagggcgccctggtgcggcggcaggccaaggagccctgtgtggagagcctggtgtcccagtacttccagacagtgacagattatggcaaggacctgatggagaaggtgaagagccctgagctgcaggccgaggccaagagctactttgagaagagcaaggagcagctgacccccctcatcaagaaggccggcacagagctggtgaacttcctgagctactttgtggagctgggcacccagcctgccacccagtag

SEQ ID NO: 143839 - DNA, 1191 bp, Artificial Sequence
  Description of Artificial Sequence: Synthetic coding sequence
atgttcctgaaggctgtggtgctgaccctggccctggtggccgtggccggggcccgggcagaggtgtctgctgaccaggtggccaccgtgatgtgggactacttcagccagctgagcaacaatgccaaggaggccgtggagcacctgcagaagtctgagctgacccagcagctgaatgccctcttccaggacaagctgggggaggtgaacacctacgccggggacctgcagaagaagctggtgccctttgccacagagctgcacgagcggctggccaaggacagcgagaagctgaaggaggagatcggcaaggagctggaggagctgcgggcccggctgctgccccacgccaatgaggtgtcccagaagatcggggacaacctgcgggagctgcagcagaggctggagccctatgctgaccagctgcggacccaggtgtccacccaggccgagcagctgcggcggcagctgaccccctatgcccagaggatggagcgggtgctgcgggagaatgctgacagcctgcaggccagcctgcggccccatgctgatgagctgaaggccaagattgaccagaatgtggaggagctgaagggccgcctgaccccctatgcagatgagttcaaggtgaagattgaccagacagtggaggagctgcggcgcagcctggccccctatgcccaggacacccaggagaagctgaaccaccagctggagggcctgaccttccagatgaagaagaatgctgaggagctgaaggcccgcatcagcgccagcgctgaggagctgcggcagaggctggcccccctggccgaggatgtgcggggcaacctgcggggcaacacagagggcctgcagaagagcctggccgagctgggcggccacctggaccagcaggtggaggagttcagaagaagagtggagccctacggggagaacttcaacaaggccctggtgcagcagatggagcagctgcggcagaagctgggcccccatgctggagatgtggagggccacctgtccttcctggagaaggacctgcgggacaaggtgaacagcttcttcagcaccttcaaggagaaggagagccaggacaagaccctgagcctgcctgagctggagcagcagcaggagcagcagcaggagcagcagcaggagcaggtgcagatgctggcccccctggagagctag

SEQ ID NO: 143840 - DNA, 1281 bp, Artificial Sequence
  Description of Artificial Sequence: Synthetic coding sequence
atggccatcgcccagctggccacagaatatgtgttcagtgacttcctgctgaaggagcccacagagcccaagttcaagggcctgcggctggagctggccgtggacaagatggtgacctgcatcgctgtgggcctgcccctgctgctgatcagcctggcctttgcccaggagatcagcatcggcacccagatcagctgcttcagccccagcagcttctcctggaggcaggccgcctttgtggacagctactgctgggccgctgtgcagcagaagaacagcctgcagagcgagagcggcaacctgcccctgtggctgcacaagttcttcccctacatcctgctgctgtttgccatcctgctgtacctgcccccactcttctggaggtttgctgctgccccccacatctgcagcgacctgaagttcatcatggaggagctggacaaggtgtacaacagagccatcaaggccgccaagagcgcccgggacctggacatgagagatggagcctgcagcgtgcctggggtgacagagaacctgggccagagcctgtgggaggtgtctgagagccacttcaagtaccccatcgtggagcagtacctgaagaccaagaagaacagcaacaacctgatcatcaagtacatcagctgccgcctgctgaccctcatcatcatcctgctggcctgcatctacctgggctactacttcagcctgagcagcctgagtgatgaatttgtgtgcagcatcaagagcggcatcctgagaaatgacagcacagtgcctgaccagttccagtgcaagctgattgctgtgggcatcttccagctgctgagcgtcatcaacctggtggtgtatgtgctgctggcccctgtggtggtgtacaccctgtttgtgcccttccggcagaagacagatgtgctgaaggtgtatgagatcctgcccacctttgatgtgctgcacttcaagtctgagggctacaatgacctgagcctgtacaacctcttcctggaggagaacatcagcgaggtgaagagctacaagtgcctgaaggtgctggagaacatcaagagcagcggccagggcatcgaccccatgctgctgctgaccaacctgggcatgatcaagatggatgtggtggatggcaagacccccatgtctgctgagatgagggaggagcagggcaaccagacagctgagctgcagggcatgaacatcgacagcgagaccaaggccaacaacggggagaagaatgcccggcagaggctgctggacagcagctgctag

SEQ ID NO: 143841 - DNA, 489 bp, Artificial Sequence
  Description of Artificial Sequence: Synthetic coding sequence
atggcctccatggctgctgtgctgacctgggccctggccctgctgagcgccttcagcgccacccaggccaggaagggcttctgggactacttcagccagaccagcggggacaagggccgggtggagcagatccaccagcagaagatggcccgggagcccgccaccctgaaggacagcctggagcaggacctgaacaacatgaacaagttcctggagaagctgcggcccctgagcggcagcgaggccccccggctgccccaggaccctgtgggcatgaggcggcagctgcaggaggagctggaggaggtgaaggcccggctgcagccctacatggccgaggcccacgagctggtgggctggaacctggagggcctgcggcagcagctgaagccctacaccatggacctgatggagcaggtggccctgcgggtgcaggagctgcaggagcagctgcgggtggtgggggaggacaccaaggcccagctgtag

SEQ ID NO: 143842 - DNA, 1101 bp, Artificial Sequence
  Description of Artificial Sequence: Synthetic coding sequence
atggcctccatggctgctgtgctgacctgggccctggccctgctgagcgccttcagcgccacccaggccaggaagggcttctgggactacttcagccagaccagcggggacaagggccgggtggagcagatccaccagcagaagatggcccgggagcccgccaccctgaaggacagcctggagcaggacctgaacaacatgaacaagttcctggagaagctgcggcccctgagcggcagcgaggccccccggctgccccaggaccctgtgggcatgaggcggcagctgcaggaggagctggaggaggtgaaggcccggctgcagccctacatggccgaggcccacgagctggtgggctggaacctggagggcctgcggcagcagctgaagccctacaccatggacctgatggagcaggtggccctgcgggtgcaggagctgcaggagcagctgcgggtggtgggggaggacaccaaggcccagctgctgggcggcgtggatgaggcctgggccctgctgcagggcctgcagagccgggtggtgcaccacacaggccgcttcaaggagctgttccacccctatgcagagagcctggtgtctggcatcggcagacatgtgcaggagctgcacaggtctgtggccccccacgccccagccagccctgcccggctgagccgctgtgtgcaggtgctgagcaggaagctgaccctgaaggccaaggccctgcacgcccgcatccagcagaacctggaccagctgcgggaggagctgagccgggcctttgctggcaccggcacagaggagggcgccggccctgacccccagatgctgtctgaggaggtgcggcagaggctgcaggccttccggcaggacacctacctgcagattgctgccttcacccgggccatcgaccaggagacagaggaggtgcagcagcagctggcccctcctcctcctggccacagcgcctttgcccctgagttccagcagacagattctgggaaggtgctgagcaagctgcaggcccggctggatgacctgtgggaggacatcacccacagcctgcatgaccagggccacagccacctgggggacccctag

SEQ ID NO: 143843 - DNA, 1074 bp, Artificial Sequence
  Description of Artificial Sequence: Synthetic coding sequence
atgaacccccagatccggaaccccatggagaggatgtacagagacaccttctatgacaactttgaaaatgagcccatcctgtatggccgcagctacacctggctgtgctatgaggtgaagatcaagaggggccgcagcaacctgctgtgggacaccggggtcttccggggccaggtgtacttcaagccccagtaccacgccgagatgtgcttcctgtcctggttctgtggcaaccagctgcctgcctacaagtgcttccagatcacctggtttgtgtcctggaccccctgcccagactgtgtggccaagctggccgagttcctgtctgagcaccccaacgtgaccctgaccatctctgctgcccggctgtactactactgggagcgggactaccgccgggccctgtgccgcctgagccaggccggggcccgggtgaccatcatggactatgaggagtttgcctactgctgggagaactttgtgtacaatgaaggccagcagttcatgccctggtacaagtttgatgagaactatgccttcctgcacaggaccctgaaggagatcctgcgctacctgatggaccctgacaccttcaccttcaacttcaacaatgaccccctggtgctgcggcggcggcagacctacctgtgctatgaggtggagcggctggacaatggcacctgggtgctgatggaccagcacatgggcttcctgtgcaatgagctggaccctgcccagatctacagagtgacctggttcatctcctggagcccctgcttctcctggggctgtgccggggaggtgcgggccttcctgcaggagaacacccacgtgcggctgcgcatctttgctgcccgcatctatgactatgaccccctgtacaaggaggccctgcagatgctgagagatgctggggcccaggtgtccatcatgacctatgatgaatttgagtactgctgggacacctttgtgtaccggcagggctgccccttccagccctgggatggcctggaggagcacagccaggccctgagcggccgcctgcgggccatcctgcagaaccagggcaactag

SEQ ID NO: 143844 - DNA, 306 bp, Artificial Sequence
  Description of Artificial Sequence: Synthetic coding sequence
atgaagccccacttcaggaacacagtggagaggatgtacagagacaccttctcctacaacttctacaaccggcccatcctgagcagaagaaacacagtgtggctgtgctatgaggtgaagaccaagggccccagccggccccggctggatgccaagatcttccggggccaggtgcccaggagcttcatccgggcccccttccaggtgctgagcagccccttcggccagtgtgcccctcctcatggaacagcccaggtgcagtggccaccccagctgacagctggccgggagcagggccggccctag

SEQ ID NO: 143845 - DNA, 381 bp, Artificial Sequence
  Description of Artificial Sequence: Synthetic coding sequence
atggccagcgccagcacccagcctgctgccctgtctgctgagcaggccaaggtggtgctggccgaggtgatccaggccttcagcgccccagaaaatgctgtgaggatggatgaggcccgggacaatgcctgcaatgacatgggcaagatgctgcagtttgtgctgcctgtggccacccagatccagcaggaggtgatcaaggcctacggcttcagctgtgatggagaaggagtgctgaagtttgcccggctggtgaagagctatgaggcccaggaccctgagatcgccagcctgagcggcaagctgaaggccctcttcctgccccccatgaccctgccccctcatggccctgctgctgggggctctgtggccgccagctag

SEQ ID NO: 143846 - DNA, 675 bp, Artificial Sequence
  Description of Artificial Sequence: Synthetic coding sequence
atggcccagaaggaggaggccgctgtggccacagaagctgccagccagaatggagaggacctggagaacctggatgatcctgagaagctgaaggagctgattgagctgcccccatttgaaattgtgactggagagcggctgcctgccaacttcttcaagttccagttcagaaatgtggagtacagcagtggaagaaacaagaccttcctgtgctacgtggtggaggcccagggcaaaggaggccaggtgcaggccagccggggctacctggaggatgagcacgccgccgcccatgctgaggaggccttcttcaacaccatcctgcctgcctttgatcctgccctgcgctacaacgtgacctggtacgtgagcagcagcccctgtgccgcctgtgccgaccgcatcatcaagaccctgagcaagaccaagaacctgcggctgctgatcctggtgggccgcctcttcatgtgggaggagcctgagatccaggccgccctgaagaagctgaaggaggccggctgcaagctgcgcatcatgaagccccaggactttgaatatgtgtggcagaactttgtggagcaggaggagggggagagcaaggccttccagccctgggaggacatccaggagaacttcctgtactatgaggagaagctggccgacatcctgaagtag

SEQ ID NO: 143847 - DNA, 393 bp, Artificial Sequence
  Description of Artificial Sequence: Synthetic coding sequence
atggcccagaaggaggaggccgctgtggccacagaagctgccagccagaatggagaggacctggagaacctggatgatcctgagaagctgaaggagctgattgagctgcccccatttgaaattgtgactggagagcggctgcctgccaacttcttcaagttccagttcagaaatgtggagtacagcagcggcaggaagctgagcagcacccccagctgccagcccagcacccagccctgtggcaccatgagccctggcatgtgccccccagcccctgtgcagagggtgctgacagccctgagcaagcccctggcccggcccaggacctgtgtgtgcagcttctggtgggtggacagcagctgtggccgcagcagaagaagccggctgctgtag

SEQ ID NO: 143848 - DNA, 600 bp, Artificial Sequence
  Description of Artificial Sequence: Synthetic coding sequence
atggaggccagccctgccagcggccccaggcacctgatggacccccacatcttcaccagcaacttcaacaacggcatcggccgccacaagacctacctgtgctatgaggtggagcggctggacaatggcacctctgtgaagatggaccagcaccggggcttcctgcacaaccaggccaagaacctgctgtgtggcttctacggcagacatgctgagctgcgcttcctggacctggtgcccagcctgcagctggaccctgcccagatctacagagtgacctggttcatctcctggagcccctgcttctcctggggctgtgccggggaggtgcgggccttcctgcaggagaacacccacgtgcggctgcgcatctttgctgcccgcatctatgactatgaccccctgtacaaggaggccctgcagatgctgagagatgctggggcccaggtgtccatcatgacctatgatgagttcaagcactgctgggacacctttgtggaccaccagggctgccccttccagccctgggatggcctggatgagcacagccaggccctgagcggccgcctgcgggccatcctgcagaaccagggcaactag

SEQ ID NO: 143849 - DNA, 600 bp, Artificial Sequence; identical to SEQ ID NO: 143848
  Description of Artificial Sequence: Synthetic coding sequence

SEQ ID NO: 143850 - DNA, 1149 bp, Artificial Sequence
  Description of Artificial Sequence: Synthetic coding sequence
atgaacccccagatccggaaccccatggagaggatgtacagagacaccttctatgacaactttgaaaatgagcccatcctgtatggccgcagctacacctggctgtgctatgaggtgaagatcaagaggggccgcagcaacctgctgtgggacaccggggtcttccggggccaggtgtacttcaagccccagtaccacgccgagatgtgcttcctgtcctggttctgtggcaaccagctgcctgcctacaagtgcttccagatcacctggtttgtgtcctggaccccctgcccagactgtgtggccaagctggccgagttcctgtctgagcaccccaacgtgaccctgaccatctctgctgcccggctgtactactactgggagcgggactaccgccgggccctgtgccgcctgagccaggccggggcccgggtgaccatcatggactatgaggagtttgcctactgctgggagaactttgtgtacaatgaaggccagcagttcatgccctggtacaagtttgatgagaactatgccttcctgcacaggaccctgaaggagatcctgcgctacctgatggaccctgacaccttcaccttcaacttcaacaatgaccccctggtgctgcggcggcggcagacctacctgtgctatgaggtggagcggctggacaatggcacctgggtgctgatggaccagcacatgggcttcctgtgcaatgaggccaagaacctgctgtgtggcttctacggcagacatgctgagctgcgcttcctggacctggtgcccagcctgcagctggaccctgcccagatctacagagtgacctggttcatctcctggagcccctgcttctcctggggctgtgccggggaggtgcgggccttcctgcaggagaacacccacgtgcggctgcgcatctttgctgcccgcatctatgactatgaccccctgtacaaggaggccctgcagatgctgagagatgctggggcccaggtgtccatcatgacctatgatgaatttgagtactgctgggacacctttgtgtaccggcagggctgccccttccagccctgggatggcctggaggagcacagccaggccctgagcggccgcctgcgggccatcctgcagaaccagggcaactag

SEQ ID NO: 143851 - DNA, 573 bp, Artificial Sequence
  Description of Artificial Sequence: Synthetic coding sequence
atgaacccccagatccggaaccccatgaaggccatgtacccaggcaccttctacttccagttcaagaacctgtgggaggccaatgacagaaatgagacctggctgtgcttcaccgtggagggcatcaagagaagatctgtggtgtcctggaagacaggagtcttcaggaaccaggtggacagcgagacccactgccacgccgagcgctgcttcctgtcctggttctgtgatgacatcctgagccccaacaccaagtaccaggtgacctggtacacctcctggagcccctgcccagactgtgccggggaggtggccgagttcctggcccggcacagcaatgtgaacctgaccatcttcaccgcccggctgtactacttccagtacccctgctaccaggagggcctgcggagcctgagccaggagggcgtggccgtggagatcatggactatgaggacttcaagtactgctgggagaactttgtgtacaatgacaatgagcccttcaagccctggaagggcctgaagaccaacttccggctgctgaagaggcggctgcgggagagcctgcagtag

SEQ ID NO: 143852 - DNA, 1122 bp, Artificial Sequence
  Description of Artificial Sequence: Synthetic coding sequence
atgaagccccacttcaggaacacagtggagaggatgtacagagacaccttctcctacaacttctacaaccggcccatcctgagcagaagaaacacagtgtggctgtgctatgaggtgaagaccaagggccccagccggccccggctggatgccaagatcttccggggccaggtgtacagccagcctgagcaccacgccgagatgtgcttcctgtcctggttctgtggcaaccagctgcctgcctacaagtgcttccagatcacctggtttgtgtcctggaccccctgcccagactgtgtggccaagctggccgagttcctggccgagcaccccaacgtgaccctgaccatctctgctgcccggctgtactactactgggagcgggactacagaagagccctgtgccgcctgagccaggccggggcccgggtgaagatcatggatgatgaggagtttgcctactgctgggagaactttgtgtacagcgagggccagcccttcatgccctggtacaagtttgatgacaactatgccttcctgcacaggaccctgaaggagatcctgaggaaccccatggaggccatgtacccccacatcttctacttccacttcaagaacctgaggaaggcctatggaagaaatgaatcctggctgtgcttcaccatggaggtggtgaagcaccacagccctgtgtcctggaagaggggcgtcttcaggaaccaggtggaccctgagacccactgccacgccgagcgctgcttcctgtcctggttctgtgatgacatcctgagccccaacaccaactatgaggtgacctggtacacctcctggagcccctgcccagaatgtgccggggaggtggccgagttcctggcccggcacagcaatgtgaacctgaccatcttcaccgcccggctgtactacttctgggacacagactaccaggagggcctgcggagcctgagccaggagggcgcctctgtggagatcatgggctacaaggacttcaagtactgctgggagaactttgtgtacaatgatgatgagcccttcaagccctggaagggcctgaagtacaacttcctgttcctggacagcaagctgcaggagatcctggagtag

SEQ ID NO: 143853 - DNA, 1155 bp, Artificial Sequence
  Description of Artificial Sequence: Synthetic coding sequence
atgaagccccacttcaggaacacagtggagaggatgtacagagacaccttctcctacaacttctacaaccggcccatcctgagcagaagaaacacagtgtggctgtgctatgaggtgaagaccaagggccccagcaggcctcccctggatgccaagatcttccggggccaggtgtacagcgagctgaagtaccaccctgagatgaggttcttccactggttcagcaagtggaggaagctgcaccgggaccaggagtatgaggtgacctggtacatctcctggagcccctgcaccaagtgcacccgggacatggccaccttcctggccgaggaccccaaggtgaccctgaccatctttgtggcccggctgtactacttctgggaccctgactaccaggaggccctgcggagcctgtgccagaagagagatggcccccgggccaccatgaagatcatgaactatgatgagttccagcactgctggagcaagtttgtgtacagccagcgggagctgtttgagccctggaacaacctgcccaagtactacatcctgctgcacatcatgctgggggagatcctgcggcacagcatggacccccccaccttcaccttcaacttcaacaatgagccctgggtgcggggcagacatgagacctacctgtgctatgaggtggagaggatgcacaatgacacctgggtgctgctgaaccagaggcggggcttcctgtgcaaccaggccccccacaagcacggcttcctggagggcagacatgctgagctgtgcttcctggatgtgatccccttctggaagctggacctggaccaggactacagagtgacctgcttcacctcctggagcccctgcttcagctgtgcccaggagatggccaagttcatcagcaagaacaagcacgtgtccctgtgcatcttcaccgcccgcatctatgatgaccagggccgctgccaggagggcctgcggaccctggccgaggccggggccaagatcagcatcatgacctacagcgagttcaagcactgctgggacacctttgtggaccaccagggctgccccttccagccctgggatggcctggatgagcacagccaggacctgagcggccgcctgcgggccatcctgcagaaccaggagaactag

SEQ ID NO: 143854 - DNA, 1155 bp, Artificial Sequence; identical to SEQ ID NO: 143853
  Description of Artificial Sequence: Synthetic coding sequence

SEQ ID NO: 143855 - DNA, 549 bp, Artificial Sequence
  Description of Artificial Sequence: Synthetic coding sequence
atggccctgctgacagctgagaccttccggctgcagttcaacaacaagaggcggctgcggcggccctactaccccaggaaggccctgctgtgctaccagctgaccccccagaatggcagcacccccacccggggctactttgagaacaagaagaagtgccacgccgagatctgcttcatcaatgagatcaagtccatgggcctggatgagacccagtgctaccaggtgacctgctacctgacctggagcccctgcagcagctgtgcctgggagctggtggacttcatcaaggcccatgaccacctgaacctgggcatctttgccagccggctgtactaccactggtgcaagccccagcagaagggcctgcggctgctgtgtggcagccaggtgcctgtggaggtgatgggcttccccaagtttgctgactgctgggagaactttgtggaccacgagaagcccctgtccttcaacccctacaagatgctggaggagctggacaagaacagccgggccatcaagaggcggctggagcgcatcaagagctag

SEQ ID NO: 143856 - DNA, 603 bp, Artificial Sequence
  Description of Artificial Sequence: Synthetic coding sequence
atggccctgctgacagctgagaccttccggctgcagttcaacaacaagaggcggctgcggcggccctactaccccaggaaggccctgctgtgctaccagctgaccccccagaatggcagcacccccacccggggctactttgagaacaagaagaagtgccacgccgagatctgcttcatcaatgagatcaagtccatgggcctggatgagacccagtgctaccaggtgacctgctacctgacctggagcccctgcagcagctgtgcctgggagctggtggacttcatcaaggcccatgaccacctgaacctgggcatctttgccagccggctgtactaccactggtgcaagccccagcagaagggcctgcggctgctgtgtggcagccaggtgcctgtggaggtgatgggcttccccaagtttgctgactgctgggagaactttgtggaccacgagaagcccctgtccttcaacccctacaagatgctggaggagctggacaagaacagccgggccatcaagaggcggctggagcgcatcaagatccctggggtgcgggcccagggccgctacatggacatcctgtgtgatgctgaggtgtag

SEQ ID NO: 143857 - DNA, 465 bp, Artificial Sequence
  Description of Artificial Sequence: Synthetic coding sequence
atggccctgctgacagctgagaccttccggctgcagttcaacaacaagaggcggctgcggcggccctactaccccaggaaggccctgctgtgctaccagctgaccccccagaatggcagcacccccacccggggctactttgagaacaagaagaagtgccacgccgagatctgcttcatcaatgagatcaagtccatgggcctggatgagacccagtgctaccaggtgacctgctacctgacctggagcccctgcagcagctgtgcctgggagctggtggacttcatcaaggcccatgaccacctgaacctgggcatctttgccagccggctgtactaccactggtgcaagccccagcagaagggcctgcggctgctgtgtggcagccaggtgcctgtggaggtgatgggcttccccaacagccggggcacctgtgccggcagcctgcacggctacatcgtgtag

SEQ ID NO: 143858 - DNA, 552 bp, Artificial Sequence
  Description of Artificial Sequence: Synthetic coding sequence
atggccctgctgacagctgagaccttccggctgcagttcaacaacaagaggcggctgcggcggccctactaccccaggaaggccctgctgtgctaccagctgaccccccagaatggcagcacccccacccggggctactttgagaacaagaagaagtgccacgccgagatctgcttcatcaatgagatcaagtccatgggcctggatgagacccagtgctaccaggtgacctgctacctgacctggagcccctgcagcagctgtgcctgggagctggtggacttcatcaaggcccatgaccacctgaacctgggcatctttgccagccggctgtactaccactggtgcaagccccagcagaagggcctgcggctgctgtgtggcagccaggtgcctgtggaggtgatgggcttccccaagtttgctgactgctgggagaactttgtggaccacgagaagcccctgtccttcaacccctacaagatgctggaggagctggacaagaacagccgggccatcaagaggcggctggagcgcatcaagcagagctag

SEQ ID NO: 143859 - DNA, 1104 bp, Artificial Sequence
  Description of Artificial Sequence: Synthetic coding sequence
atggagcccatctatgaggagtacctggccaaccacggcaccatcgtgaagccctactactggctgtccttcagcctggactgcagcaactgcccctaccacatcagaactggagaggaggcccgggtgtccctgacagagttctgccagatcttcggcttcccctacggcaccaccttcccccagaccaagcacctgaccttctatgagctgaagaccagcagcggcagcctggtgcagaagggccacgccagcagctgcaccggcaactacatccaccctgagagcatgctgtttgagatgaatggctacctggacagcgccatctacaacaatgacagcatccgccacatcatcctgtacagcaacaacagcccctgcaatgaggccaaccactgctgcatcagcaagatgtacaacttcctgatcacctacccaggcatcaccctgagcatctacttcagccagctgtaccacacagagatggacttccctgccagcgcctggaaccgggaggccctgcggagcctggccagcctgtggccccgggtggtgctgagccccatcagcggcggcatctggcacagcgtgctgcacagcttcatctctggagtgtctggcagccacgtgttccagcccatcctgaccggccgggccctggccgacagacacaatgcctatgagatcaatgccatcactggagtgaagccctacttcacagatgtgctgctgcagaccaagaggaaccccaacaccaaggcccaggaggccctggagagctaccccctgaacaatgccttccctggccagttcttccagatgcccagcggccagctgcagcccaacctgcccccagacctgcgggcccctgtggtgtttgtgctggtgcccctgcgggacctgccccccatgcacatgggccagaaccccaacaagcccaggaacatcgtgcgccacctgaacatgccccagatgtccttccaggagaccaaggacctgggccgcctgcccaccggccgctctgtggagatcgtggagatcacagagcagtttgccagcagcaaggaggctgatgagaagaagaagaagaagggcaagaagtag

SEQ ID NO: 143860 - DNA, 252 bp, Artificial Sequence
  Description of Artificial Sequence: Synthetic coding sequence
atgaggctcttcctgagcctgcctgtgctggtggtggtgctgagcatcgtgctggagggccctgccccagcccagggcaccccagatgtgagcagcgccctggacaagctgaaggagtttggaaacaccctggaggacaaggcccgggagctgatcagccgcatcaagcagagcgagctgagcgccaagatgagggagtggttcagcgagaccttccagaaggtgaaggagaagctgaagattgacagctag

SEQ ID NO: 143861 - DNA, 306 bp, Artificial Sequence
  Description of Artificial Sequence: Synthetic coding sequence
atgggcacccggctgctgcctgccctcttcctggtgctgctggtgctgggctttgaggtgcagggcacccagcagccccagcaggatgagatgcccagccccaccttcctgacccaggtgaaggagagcctgagcagctactgggagagcgccaagacagctgcccagaacctgtatgagaagacctacctgcctgctgtggatgagaagctgcgggacctgtacagcaagagcacagctgccatgagcacctacacaggcatcttcacagaccaggtgctgtctgtgctgaagggggaggagtag

SEQ ID NO: 143862 - DNA, 384 bp, Artificial Sequence
  Description of Artificial Sequence: Synthetic coding sequence
atgagcctgctgaggaaccggctgcaggccctgcctgccctgtgcctgtgtgtgctggtgctggcctgcatcggggcctgccagcctgaggcccaggagggcaccctgagccccccacccaagctgaagatgagccgctggagcctggtgcggggccgcatgaaggagctgctggagaccgtggtgaacagaacaagagatggctggcagtggttctggagccccagcaccttccggggcttcatgcagacctactatgatgaccacctgcgggacctgggccccctgaccaaggcctggttcctggagagcaaggacagcctgctgaagaagacccacagcctgtgcccccggctggtgtgtggggacaaggaccagggctag

SEQ ID NO: 143863 - DNA, 1101 bp, Artificial Sequence; identical to SEQ ID NO: 143842
  Description of Artificial Sequence: Synthetic coding sequence

SEQ ID NO: 143864 - DNA, 354 bp, Artificial Sequence
  Description of Artificial Sequence: Synthetic coding sequence
atgggcacctggggcgccccccacaggaccctgccctgcaggaacagaggagccatgcagccccgggtgctgctggtggtggccctgctggccctgctggccagcgcccgggccagcgaggccgaggatgccagcctgctgtccttcatgcagggctacatgaagcacgccaccaagacagccaaggatgccctgagctctgtgcaggagagccaggtggcccagcaggcccggggctgggtgacagatggcttcagcagcctgaaggactactggagcacagtgaaggacaagttcagcgagttctgggacctggaccctgaggtgcggcccaccagcgctgtggccgcctag

SEQ ID NO: 143865 - DNA, 168 bp, Artificial Sequence
  Description of Artificial Sequence: Synthetic coding sequence
atgcagccccgggtgctgctggtggtggccctgctggccctgctggccagcgcccgggccagcgaggccgaggatgccagcctgctgtccttcatgcagggctacatgaagcacgccaccaagacagccaaggatgccctgagctctgtgcaggagagccaggtgtag

SEQ ID NO: 143866 - DNA, 384 bp, Artificial Sequence; identical to SEQ ID NO: 143862
  Description of Artificial Sequence: Synthetic coding sequence

SEQ ID NO: 143867 - DNA, 384 bp, Artificial Sequence; identical to SEQ ID NO: 143862
  Description of Artificial Sequence: Synthetic coding sequence

SEQ ID NO: 143868 - DNA, 570 bp, Artificial Sequence
  Description of Artificial Sequence: Synthetic coding sequence
atggtgatgctgctgctgctgctgagcgccctggccggcctgtttggagctgctgagggccaggccttccacctgggcaaatgtcccaacccccctgtgcaggagaactttgatgtgaacaagtacctgggccgctggtatgaaattgagaagatccccaccacctttgaaaatggccgctgcatccaggccaactacagcctgatggagaatggcaagatcaaggtgctgaaccaggagctgcgggcagatggcaccgtgaaccagatcgagggggaggccacccctgtgaacctgacagagcccgccaagctggaggtgaagttctcctggttcatgcccagcgccccctactggatcctggccacagattatgagaactatgccctggtgtacagctgcacctgcatcatccagctgttccacgtggactttgcctggatcctggccaggaaccccaacctgcccccagagaccgtggacagcctgaagaacatcctgaccagcaacaacattgatgtgaagaagatgacagtgacagaccaggtgaactgccccaagctgtcctag

SEQ ID NO: 143869 - DNA, 450 bp, Artificial Sequence
  Description of Artificial Sequence: Synthetic coding sequence
atggtgatgctgctgctgctgctgagcgccctggccggcctgtttggagctgctgagggccaggccttccacctgggcaaatgtcccaacccccctgtgcaggagaactttgatgtgaacaagtacctgggccgctggtatgaaattgagaagatccccaccacctttgaaaatggccgctgcatccaggccaactacagcctgatggagaatggcaagatcaaggtgctgaaccaggagctgcgggcagatggcaccgtgaaccagatcgagggggaggccacccctgtgaacctgacagagcccgccaagctggaggtgaagttctcctggttcatgcccagcgccccctactggatcctggccacagattatgagaactatgccctggtgtacagctgcacctgcatcatccagctgttccacgtggactttgcctggatcctgtag

SEQ ID NO: 143870 - DNA, 954 bp, Artificial Sequence
  Description of Artificial Sequence: Synthetic coding sequence
atgaaggtgctgtgggccgccctgctggtgaccttcctggccggctgccaggccaaggtggagcaggccgtggagacagagcctgagcctgagctgcggcagcagacagagtggcagagcggccagcgctgggagctggccctgggccgcttctgggactacctgcgctgggtgcagaccctgtctgagcaggtgcaggaggagctgctgagcagccaggtgacccaggagctgcgggccctgatggatgagaccatgaaggagctgaaggcctacaagtctgagctggaggagcagctgacccctgtggccgaggagacccgggcccggctgagcaaggagctgcaggccgcccaggcccggctgggcgctgacatggaggatgtgtgtggccgcctggtgcagtacagaggagaggtgcaggccatgctgggccagagcacagaggagctgcgggtgcggctggccagccacctgaggaagctgaggaagaggctgctgagagatgctgatgacctgcagaagaggctggccgtgtaccaggccggggcccgggagggcgctgagcggggcctgagcgccatccgggagcggctgggccccctggtggagcagggccgggtgcgggccgccaccgtgggcagcctggccggccagcccctgcaggagcgggcccaggcctggggcgagcggctgcgggccaggatggaggagatgggcagcaggacccgggaccggctggatgaggtgaaggagcaggtggccgaggtgcgggccaagctggaggagcaggcccagcagatccggctgcaggccgaggccttccaggcccggctgaagtcctggtttgagcccctggtggaggacatgcagaggcagtgggccggcctggtggagaaggtgcaggccgctgtgggcaccagcgctgcccctgtgcccagcgacaaccactag

SEQ ID NO: 143871 - DNA, 660 bp, Artificial Sequence
  Description of Artificial Sequence: Synthetic coding sequence
atgaaggtgctgtgggccgccctgctggtgaccttcctggccggctgccaggccaaggtggagcaggccgtggagacagagcctgagcctgagctgcggcagcagacagagtggcagagcggccagcgctgggagctggccctgggccgcttctgggactacctgcgctgggtgcagaccctgtctgagcaggtgcaggaggagctgctgagcagccaggtgacccaggagctgcgggccctgatggatgagaccatgaaggagctgaaggcctacaagtctgagctggaggagcagctgacccctgtggccgaggagacccgggcccggctgagcaaggagctgcaggccgcccaggcccggctgggcgctgacatggaggatgtgtgtggccgcctggtgcagtacagaggagaggtgcaggccatgctgggccagagcacagaggagctgcgggtgcggctggccagccacctgaggaagctgaggaagaggctgctgagagatgctgatgacctgcagaagaggctggccgtgtaccaggccggggcccgggagggcgctgagcggggcctgagcgccatccgggagcggctgggccccctggtggagcagggccgggtgcgggccgccaccgtgggcagcctggccggccagtag

SEQ ID NO: 143872 - DNA, 867 bp, Artificial Sequence
  Description of Artificial Sequence: Synthetic coding sequence
gaggtgaaggatgtgctgccccaggagcctgtgcgctctgctgtgggcggcaccggcatgagcagcggggccagcaggaagtcctgggaccccggcaacccctggcccccagactggcccatcaccggcaggaagatgaaggtgctgtgggccgccctgctggtgaccttcctggccggctgccaggccaaggtggagcaggccgtggagacagagcctgagcctgagctgcggcagcagacagagtggcagagcggccagcgctgggagctggccctgggccgcttctgggactacctgcgctgggtgcagaccctgtctgagcaggtgcaggaggagctgctgagcagccaggtgacccaggagctgcgggccctgatggatgagaccatgaaggagctgaaggcctacaagtctgagctggaggagcagctgacccctgtggccgaggagacccgggcccggctgagcaaggagctgcaggccgcccaggcccggctgggcgctgacatggaggatgtgtgtggccgcctggtgcagtacagaggagaggtgcaggccatgctgggccagagcacagaggagctgcgggtgcggctggccagccacctgaggaagctgaggaagaggctgctgagagatgctgatgacctgcagaagaggctggccgtgtaccaggccggggcccgggagggcgctgagcggggcctgagcgccatccgggagcggctgggccccctggtggagcagggccgggtgcgggccgccaccgtgggcagcctggccggccagcccctgcaggagcgggcccaggcctggggcgagcggctgcgggccaggatggaggagatgggcagcaggacatag

SEQ ID NO: 143873 - DNA, 651 bp, Artificial Sequence
  Description of Artificial Sequence: Synthetic coding sequence
atgaaggtgctgtgggccgccctgctggtgaccttcctggccggctgccaggccaaggtggagcaggccgtggagacagagcctgagcctgagctgcggcagcagacagagtggcagagcggccagcgctgggagctggccctgggccgcttctgggactacctgcgctgggtgcagaccctgtctgagcaggtgcaggaggagctgctgagcagccaggtgacccaggagctgcgggccctgatggatgagaccatgaaggagctgaaggcctacaagtctgagctggaggagcagctgacccctgtggccgaggagacccgggcccggctgagcaaggagctgcaggccgcccaggcccggctgggcgctgacatggaggatgtgtgtggccgcctggtgcagtacagaggagaggtgcaggccatgctgggccagagcacagaggagctgcgggtgcggctggccagccacctgaggaagctgaggaagaggctgctgagagatgctgatgacctgcagaagaggctggccgtgtaccaggccggggcccgggagggcgctgagcggggcctgagcgccatccgggagcggctgggccccctggtggagcagggccgggtgcgggccgccaccgtgggcagcctgtag

SEQ ID NO: 143874 - DNA, 10593 bp, Artificial Sequence
  Description of Artificial Sequence: Synthetic coding sequence
atggccaaggaggaggatgaggagaagaaggccaagaagggcaagaagggcaagaaggcccctgagcctgagaagcccaagaggagcctgaagggcaccagccgcctcttcatgggcttccgggacaggacccccaagatcagcaagaagggccagttccgcagcgccagcgccttcttctggggcctgcacacaggcccccagaagaccaagaggaagaggaaggccaggacagtgctgaagagcaccagcaagctgatgacccagatgaggatgggcaagaagaagagggccatgaagggcaagaagcccagcttcatggtgatccgcttccctggccggcggggctacggccgcctgcggccccgggcccggagcctgagcaaggccagcacagccatcaactggctgaccaagaagttcctgctgaagaaggccgaggagagcggcagcgagcaggccaccgtggatgcctggctgcagaggagcagcagcaggatgggcagcaggaagctgcccttccccagcggggctgagatcctgcggcctgggggccgcctgcggcgcttccccaggagccgcagcatctatgccagcggggagcccctgggcttcctgccctttgaagatgaggcccccttccaccacagcggcagcaggaagagcctgtatggcctggagggcttccaggacctgggggagtactatgactaccacagagatggagatgactactatgaccggcagagcctgcacagatatgaggagcaggagccctacctggccggcctgggcccctacagccctgcctggccaccctacggggaccactactacggctacccacctgaggacccctatgactactaccacccagactactatggaggcccctttgatcctggctacacctacggctacggctatgatgattatgagcccccctatgccccacccagcggctacagcagcccctacagctaccatgatggctatgaaggagaggcccacccctacggctactacctggacccctatgccccctatgatgccccctacccaccctatgacctgccctaccacaccccctatgatgtgccctactttgacccctacggcgtgcactacacagtgccctatgcagagggcgtgtatggaggaggagatgaggccatctacccacctgaggtgccctacttctacccagaggagagcgccagcgcctttgtgtacccctgggtgcccccacccatccccagcccccacaacccctatgcccacgccatggatgacattgctgagctggaggagccagaagatgctggggtggagcggcagggcaccagcttccggctgcccagcgctgccttctttgagcagcagggcatggacaagccagcccggagcaagctgagcctcatcaggaagttccgcctcttcccccggccccaggtgaagctgtttgggaaggagaagctggaggtgcccctgccccccagcctggacatccccctgcccctgggagatgctgatgaggaggaggatgaggaggagctgccccctgtgtctgctgtgccctacggccaccccttctggggcttcctgaccccccggcagaggaacctgcagagggccctgagcgcctttggagcccaccggggcctgggctttggacctgagtttggccggcctgtgcccaggcctgccaccagcctggcccgcttcctgaagaagaccctgtctgagaagaagcccatcgcccggctgcggggcagccagaaggcccgggccggcggccctgctgtgcgggaggccgcctacaagcgcttcggctacaagctggccggcatggaccctgagaagccaggcacccccatcgtgctgcggcgggcccagccccgggcccggagcagcaatgatgcccggcggcccccagccccccagcctgcccccaggaccctgagccactggagcgccctgctgagcccccctgtgccccccaggcctcccagcagcggccccccaccagccccacccctgagccctgccctgagcggcctgcccaggcctgccagcccctacggcagcctgcggcggcaccccccaccctgggccgccccagcccacgtgcccccagccccccaggcctcctggtgggcctttgtggagcccccagctgtgtccccagaggtgcccccagacctgctggccttccctggcccccggcccagcttccggggcagcagaagaagaggagctgccttcggcttccctggggccagcccccgggccagcagaagaagagcctggagccccctggccagcccccagcccagcctgcggagcagccctggcctgggctactgcagccccctggccccacccagcccccagctgagcctgaggacaggccccttccagccccccttcctgcccccagcccggcggcccaggagcctgcaggagagccctgcccccaggagagctgctggccgcctgggccccccaggcagccccctgcccggcagcccccggccccccagcccccccctgggcctgtgccacagcccccggcgcagcagcctgaacctgcccagccggctgccccacacctggaggcggctgtctgagccccccaccagggctgtgaagccccaggtgcggctgcccttccaccggccccccagggctggggcctggagggcccccctggagcaccgggagagcccccgggagcctgaggacagcgagaccccctggacagtgccccccctggcccccagctgggatgtggacatgccacccacccagaggcctcccagcccctggccaggaggagctggcagccggcggggcttcagccggcccccacctgtgcctgagaaccccttcctgcagctgctgggccctgtgcccagccccaccctgcagccagaagatcctgctgctgacatgaccagggtcttcctgggccgccaccacgagcccggccctggccagctgaccaagtctgctggccccaccccagagaagccagaggaggaggccaccctgggggacccccagctgcctgctgagaccaagccacccaccccagccccacccaaggatgtgaccccacccaaggacatcaccccacccaaggatgtgctgcctgagcagaagaccctgcggcccagcctgagctaccccctggccgcctgtgaccagacccgggccacctggccaccctggcaccgctggggcaccctgccccaggccgccgcccccctggcccccatccgggcccctgagcccctgcccaagggcggggagcggcggcaggccgcccctggccgctttgctgtggtgatgccccgggtgcagaagctgagcagcttccagagggtgggccctgccaccctgaagccccaggtgcagcccatccaggaccccaagccccgggcctgcagcctgcgctggagctgcctgtggctgcgggcagatgcctacggcccctggccccgggtgcacacccacccccagagctgccacctgggccctggagctgcctgcctgagcctgcggggctcctgggaggaggtgggccccccatcctggaggaacaagatgcacagcatccggaacctgcccagcatgaggttccgggagcagcacggagaagatggagtggaggacatgacccagctggaggacctgcaggagaccaccgtgctgagcaacctgaagatccgctttgagaggaacctgatctacacctacatcggcagcatcctggtgtctgtgaacccctaccagatgtttggcatctacggccctgagcaggtgcagcagtacaacggccgggccctgggggagaaccccccccacctgtttgctgtggccaacctggcctttgccaagatgctggatgccaagcagaaccagtgcatcatcatcagcggggagagcggcagcggcaagacagaggccaccaagctgatcctgcgctacctggccgccatgaaccagaagcgggaggtgatgcagcagatcaagatcctggaggccacccccctgctggagagctttggaaatgccaagacagtgagaaatgacaacagcagcagatttgggaagtttgtggagatcttcctggagggcggcgtcatcagcggggccatcaccagccagtacctgctggagaagagcagaattgtgttccaggccaagaatgaaagaaactaccacatcttctatgagctgctggccggcctgcctgcccagctgcggcaggccttcagcctgcaggaggccgagacctactactacctgaaccagggcggcaactgtgaaattgctgggaagagtgatgctgatgacttccggcggctgctggccgccatggaggtgctgggcttcagcagcgaggaccaggacagcatcttccgcatcctggccagcatcctgcacctgggcaatgtgtactttgagaagtatgaaacagatgcccaggaggtggcctctgtggtgtctgcccgggagatccaggccgtggccgagctgctgcagatcagccctgagggcctgcagaaggccatcaccttcaaggtgacagagaccatgagggagaagatcttcacccccctgactgtggagagcgctgtggatgccagagatgccatcgccaaggtgctgtatgccctgctcttctcctggctgatcaccagggtgaatgccctggtgagcccccggcaggacaccctgagcatcgccatcctggacatctacggctttgaggacctgtccttcaacagctttgagcagctgtgcatcaactatgccaatgaaaacctgcagtacctgttcaacaagatcgtgttccaggaggagcaggaggagtacatccgggagcagattgactggcaggagatcacctttgctgacaaccagccctgcatcaacctgatcagcctgaagccctacggcatcctgcgcatcctggatgaccagtgctgcttcccccaggccacagaccacaccttcctgcagaagtgccactaccaccacggggccaaccccctgtacagcaagcccaagatgcccctgcctgagttcaccatcaagcactacgccggcaaggtgacctaccaggtgcacaagttcctggacaagaaccacgaccaggtgcggcaggatgtgctggacctgtttgtgcgcagcaggaccagggtggtggcccacctgttcagcagccacgccccccaggccgccccccagaggctgggcaagagcagctctgtgacccggctgtacaaggcccacacagtggccgccaagttccagcagagcctgctggacctggtggagaagatggagcgctgcaaccccctcttcatgcgctgcctgaagcccaaccacaagaaggagcccggcctgtttgagccagatgtggtgatggcccagctgcgctacagcggcgtgctggagaccgtgcgcatcaggaaggagggcttccctgtgcggctgcccttccagggcttcatcgaccgctactgctgcctggtggccctgaagcatgacctgcctgccaacggggacatgtgtgtgtctgtgctgagccggctgtgcaaggtgatgcccaacatgtacagagtgggcgtgtccaagctgttcctgaaggagcacctgtaccagctgctggagagcatgagggagcacgtgctgaacctggccgccctgaccctgcagcgctgcctgcggggcttcttcatcaagaggcgcttccgcagcctgcggcacaagatcatcctgctgcagagccgggcccggggctacctggcccggcagcgctaccagcagatgagaagaagcctggtgaagttccgcagcctggtgcacgcctacgtgtccagaagacgctacctgaagctgcgggcagagtggcgctgccaggtggagggcgccctgctgtgggagcaggaggagctgagcaagcgggaggtggtggccgtgggccacctggaggtgcctgctgagctggccggcctgctgcaggccgtggccggcctgggcctggcccaggtgccccaggtggcccctgtgaggaccccccggctgcaggccgagccccgggtgaccctgcccctggacatcaacaactaccccatggccaagtttgtgcagtgccacttcaaggagcccgccttcggcatgctgactgtgcccctgcggacccccctgacccagctgcctgctgagcaccacgccgaggccgtgtccatcttcaagctgatcctgcgcttcatgggagacccccacctgcacggggcccgggagaacatctttggaaactacatcgtgcagaagggcctggccgtgcctgagctgagagatgagatcctggcccagctggccaaccaggtgtggcacaaccacaatgcccacaatgctgagcggggctggctgctgctggccgcctgcctgagcggctttgcccccagcccctgcttcaacaagtacctgctgaagtttgtgtctgactatggaagaaatggcttccaggccgtgtgccagcaccggctgatgcaggccatgggccgggcccagcagcagggcagcggggccgcccggaccctgccccccacccagctggagtggacagccacctatgagaaggcctccatggccctggatgtgggctgcttcaacggggaccagttcagctgccctgtgcacagctggagcactggagaggaggtggccggggacatcctgcggcaccggggcctggctgatggctggaggggctggacagtggccatgaagaatggagtgcagtgggccgagctggccggccatgactatgtgctggacctggtgtctgacctggagctgctgcgggacttcccccggcagaagagctacttcatcgtgggcacagagggccctgctgccagcagaggaggccccaaggtggtgtttggaaacagctgggacagtgatgaggacatgagcacccggccccagccccaggagcacatgcccaaggtgctggacagtgatggctacagcagccacaaccaggacggcaccaatggagaaacagaggcccagaggggcacagccacccaccaggagagtgacagcctgggggagcctgctgtgccccacaagggcctggactgctacctggacagcctgtttgatcctgtgctgtcctatggagatgctgacctggagaagcccacagccatcgcctacaggatgaagggcggcggccagcccggcggcggcagcagcagcggcacagaggacaccccaagaagacctcctgagcccaagcccatccctggcctggatgccagcaccctggccctgcagcaggccttcatccacaagcaggccgtgctgctggcccgggagatgaccctgcaggccacagccctgcagcagcagcccctgtctgctgccctgcggagcctgcctgctgagaagcccccagcccctgaggcccagcccacctctgtgggcactggacctccagccaagcctgtgctgctgcgggccacccccaagcccctggccccagcccccctggccaaggccccccggctgcccatcaagcctgtggccgcccctgtgctggcccaggaccaggccagccctgagaccaccagccccagccctgagctggtgcgctacagcaccctgaacagcgagcacttcccccagcccacccagcagatcaagaacatcgtgcggcagtaccagcagcccttccggggcggccggcctgaggccctgaggaaggatggcggcaaggtgttcatgaagaggccagacccccatgaggaggccctgatgatcctgaagggccagatgacccacctggccgccgcccctggcacccaggtgtcccgggaggccgtggccctggtgaagcctgtgaccagcgccccccggcccagcatggcccccaccagcgccctgcccagccgcagcctggagcccccagaggagctgacccagacccggctgcacaggctcatcaaccccaacttctacggctaccaggatgccccctggaagatcttcctgaggaaggaggtgttctaccccaaggacagctacagccaccctgtgcagctggacctgctcttccggcagatcctgcatgacaccctgtctgaggcctgcctgcgcatcagtgaagatgagcggctgaggatgaaggccctgtttgcccagaaccagctggacacccagaagcccctggtgacagagagcgtgaagagagctgtggtgtccacagcccgggacacctgggaggtgtacttcagccgcatcttccctgccaccggctctgtgggcactggagtgcagctgctggccgtgagccacgtgggcatcaagctgctgaggatggtgaagggcggccaggaggccggcggccagctgcgggtgctgcgggcctacagctttgctgacatcctgtttgtgaccatgcccagccagaacatgctggagttcaacctggccagcgagaaggtgatcctcttcagcgcccgggcccaccaggtgaagaccctggtggatgacttcatcctggagctgaagaaggacagcgactatgtggtggccgtgaggaacttcctgcctgaagatcctgccctgctggccttccacaagggggacatcatccacctgcagcccctggagcccccccgggtgggctacagcgctggctgtgtggtgcggaggaaggtggtgtacctggaggagctgcggcggcggggccctgactttggctggaggtttggcaccatccacggccgggtgggccgcttccccagcgagctggtgcagcctgctgctgccccagacttcctgcagctgcccacagagcccggccggggccgggctgctgctgtggccgctgctgtggccagcgctgctgctgcccaggaggtgggcagaagaagagagggcccccctgtgcgggcccggtctgctgaccacggggaggatgccctggccctgcccccctacaccatgctggagtttgcccagaagtacttccgggacccccagaggcggccccaggacggcctgcggctgaagagcaaggagccccgggagagcaggaccctggaggacatgctgtgcttcaccaagacccccctgcaggagagcctcatcgagctgagtgacagcagcctgagcaagatggccacagacatgttcctggccgtgatgaggttcatgggagatgcccccctgaagggccagagcgacctggatgtgctgtgcaacctgctgaagctgtgtggggaccacgaggtgatgagagatgagtgctactgccaggtggtgaagcagatcacagacaacaccagcagcaagcaggacagctgccagaggggctggaggctgctgtacatcgtgacagcctaccacagctgcagcgaggtgctgcacccccacctgacccgcttcctgcaggatgtgtccaggaccccaggcctgcccttccagggcatcgccaaggcctgtgagcagaacctgcagaagaccctgcgctttggaggccgcctggagctgcccagcagcattgagctgcgggccatgctggccggccgcagcagcaagaggcagctgttcctgctgcccggcggcctggagcggcacctgaagatcaagacctgcaccgtggccctggatgtggtggaggagatctgtgccgagatggccctgaccaggcctgaggccttcaatgaatatgtgatctttgtggtgaccaacagaggccagcacgtgtgccccctgagcagaagagcctacatcctggatgtggccagcgagatggagcaggtggatggcggctacatgctgtggttccggcgggtgctgtgggaccagcccctgaagtttgaaaatgagctgtatgtgaccatgcactacaaccaggtgctgcctgactacctgaagggcctcttcagctctgtgcctgccagccggcccagcgagcagctgctgcagcaggtgtccaagctggccagcctgcagcaccgggccaaggaccacttctacctgcccagcgtgcgggaggtgcaggagtacatcccagcccagctgtaccgcaccacagctggcagcacctggctgaacctggtgtcccagcaccggcagcagacccaggccctgagcccccaccaggcccgggcccagttcctgggcctgctgagcgccctgcccatgtttggcagcagcttcttcttcatccagagctgcagcaacattgctgtgcctgccccctgcatcctggccatcaaccacaacggcctgaacttcctgagcacagagacccatgagctgatggtgaagttccccctgaaggagatccagagcaccaggacccagaggcccacagccaacagcagctacccctacgtggagatcgccctgggagatgtggccgcccagaggaccctgcagctgcagctggagcagggcctggagctgtgccgggtggtggccgtgcacgtggagaacctgctgagcgcccacgagaagaggctgaccctgcccccatctgagatcaccctgctgtag

SEQ ID NO: 143875 - DNA, 840 bp, Artificial Sequence
  Description of Artificial Sequence: Synthetic coding sequence
atgttccgggccccctgccaccggctgcgggcccggggcaccaggaaggcccgggccggggcctggaggggctgcaccttcccctgcctgggcaagggcatggagaggcctgctgcccgggagccccacggcccagatgccctgcggcgcttccagggcctgctgctggaccggcggggccgcctgcacggccaggtgctgcggctgcgggaggtggcccggcggctggagcggctgcggcggcgcagcctggtggccaacgtggccggcagcagcctgagcgccaccggggccctggccgccatcgtgggcctgagcctgagccctgtgaccctgggcaccagcctgctggtgtctgctgtgggcctgggcgtggccacagctgggggcgctgtgaccatcaccagtgacctgagcctcatcttctgcaacagccgggagctgcggcgggtgcaggagattgctgccacctgccaggaccagatgagggagatcctgagctgcctggagttcttctgccgctggcagggctgtggggaccggcagctgctgcagtgtggcagaaatgccagcatcgccctgtacaacagcgtgtacttcatcgtgttcttcggcagccggggcttcctgatccccaggagagctgagggggacaccaaggtgtcccaggccgtgctgaaggccaagatccagaagctggccgagagcctggagagctgcacaggagccctggatgagctgtctgagcagctggagagccgggtgcagctgtgcaccaagagcagccggggccatgacctgaagatctctgctgaccagagagctggcctcttcttctag

SEQ ID NO: 143876 - DNA, 747 bp, Artificial Sequence
  Description of Artificial Sequence: Synthetic coding sequence
atgggcatggagaggcctgctgcccgggagccccacggcccagatgccctgcggcgcttccagggcctgctgctggacagaagaggccgcctgcacggccaggtgctgcggctgcgggaggtggcccggcggctggagcggctgcggcggcgcagcctggtggccaacgtggccggcagcagcctgagcgccactggagccctggccgccatcgtgggcctgagcctgagccctgtgaccctgggcaccagcctgctggtgtctgctgtgggcctgggcgtggccacagctggaggagctgtgaccatcaccagtgacctgagcctcatcttctgcaacagccgggagctgcggcgggtgcaggagattgctgccacctgccaggaccagatgagggagatcctgagctgcctggagttcttctgccgctggcagggctgtggggaccggcagctgctgcagtgtggcagaaatgccagcatcgccctgtacaacagcgtgtacttcatcgtgttcttcggcagccggggcttcctgatcccccggcgggcagagggggacaccaaggtgtcccaggccgtgctgaaggccaagatccagaagctggccgagagcctggagagctgcaccggggccctggatgagctgtctgagcagctggagagccgggtgcagctgtgcaccaagagcagccggggccatgacctgaagatctctgctgaccagagagctggcctcttcttctag

SEQ ID NO: 143877 - DNA, 1245 bp, Artificial Sequence
  Description of Artificial Sequence: Synthetic coding sequence
atgaggttcaagagccacacagtggagctgcggcggccctgcagcgacatggagggcgccgccctgctgcgggtgtctgtgctgtgcatctggatgtctgccctcttcctgggcgtgggcgtgcgggcagaggaggccggggcccgggtgcagcagaatgtgcccagcggcacagacaccggggacccccagagcaagcccctgggggactgggccgccggcaccatggaccctgagagcagcatcttcattgaagatgccatcaagtacttcaaggagaaggtgtccacccagaacctgctgctgctgctgacagacaatgaggcctggaatggatttgtggccgctgctgagctgcccagaaatgaagcagatgagctgaggaaggccctggacaacctggcccggcagatgatcatgaaggacaagaactggcatgacaagggccagcagtacagaaactggttcctgaaggagttcccccggctgaagtctgagctggaggacaacatccggcggctgcgggccctggctgatggagtgcagaaggtgcacaagggcaccaccatcgccaacgtggtgtctggcagcctgagcatcagcagcggcatcctgaccctggtgggcatgggcctggcccccttcacagagggcggcagcctggtgctgctggagcccggcatggagctgggcatcacagctgccctgaccggcatcaccagcagcaccatggactatggcaagaagtggtggacccaggcccaggcccatgacctggtgatcaagagcctggacaagctgaaggaggtgcgggagttcctgggggagaacatcagcaacttcctgagcctggccggcaacacctaccagctgacccggggcatcggcaaggacatccgggccctgcggcgggcccgggccaacctgcagagcgtgccccacgccagcgccagccggccccgggtgacagagcccatctctgctgagagcggggagcaggtggagcgggtgaatgagcccagcatcctggagatgagccggggcgtgaagctgacagatgtggcccctgtgtccttcttcctggtgctggatgtggtgtacctggtgtatgagagcaagcacctgcacgagggcgccaagtcagaaacagctgaggagctgaagaaggtggcccaggagctggaggagaagctgaacatcctgaacaacaactacaagatcctgcaggccgaccaggagctgtag

SEQ ID NO: 143878 - DNA, 834 bp, Artificial Sequence
  Description of Artificial Sequence: Synthetic coding sequence
atgatcatgaaggacaagaactggcatgacaagggccagcagtacagaaactggttcctgaaggagttcccccggctgaagtctgagctggaggacaacatccggcggctgcgggccctggctgatggagtgcagaaggtgcacaagggcaccaccatcgccaacgtggtgtctggcagcctgagcatcagcagcggcatcctgaccctggtgggcatgggcctggcccccttcacagaaggaggcagcctggtgctgctggagcccggcatggagctgggcatcacagctgccctgaccggcatcaccagcagcaccatggactatggcaagaagtggtggacccaggcccaggcccatgacctggtgatcaagagcctggacaagctgaaggaggtgcgggagttcctgggggagaacatcagcaacttcctgagcctggccggcaacacctaccagctgacccggggcatcggcaaggacatccgggccctgcggcgggcccgggccaacctgcagagcgtgccccacgccagcgccagccggccccgggtgacagagcccatctctgctgagagcggggagcaggtggagcgggtgaatgagcccagcatcctggagatgagcagaggagtgaagctgacagatgtggcccctgtgtccttcttcctggtgctggatgtggtgtacctggtgtatgagagcaagcacctgcatgaaggagccaagtcagaaacagctgaggagctgaagaaggtggcccaggagctggaggagaagctgaacatcctgaacaacaactacaagatcctgcaggccgaccaggagctgtag

SEQ ID NO: 143879 - DNA, 1197 bp, Artificial Sequence
  Description of Artificial Sequence: Synthetic coding sequence
atggagggcgccgccctgctgcgggtgtctgtgctgtgcatctggatgtctgccctcttcctgggcgtgggcgtgcgggcagaggaggccggggcccgggtgcagcagaatgtgcccagcggcacagacaccggggacccccagagcaagcccctgggggactgggccgccggcaccatggaccctgagagcagcatcttcattgaagatgccatcaagtacttcaaggagaaggtgtccacccagaacctgctgctgctgctgacagacaatgaggcctggaatggatttgtggccgctgctgagctgcccagaaatgaagcagatgagctgaggaaggccctggacaacctggcccggcagatgatcatgaaggacaagaactggcatgacaagggccagcagtacagaaactggttcctgaaggagttcccccggctgaagtctgagctggaggacaacatccggcggctgcgggccctggctgatggagtgcagaaggtgcacaagggcaccaccatcgccaacgtggtgtctggcagcctgagcatcagcagcggcatcctgaccctggtgggcatgggcctggcccccttcacagagggcggcagcctggtgctgctggagcccggcatggagctgggcatcacagctgccctgaccggcatcaccagcagcaccatggactatggcaagaagtggtggacccaggcccaggcccatgacctggtgatcaagagcctggacaagctgaaggaggtgcgggagttcctgggggagaacatcagcaacttcctgagcctggccggcaacacctaccagctgacccggggcatcggcaaggacatccgggccctgcggcgggcccgggccaacctgcagagcgtgccccacgccagcgccagccggccccgggtgacagagcccatctctgctgagagcggggagcaggtggagcgggtgaatgagcccagcatcctggagatgagccggggcgtgaagctgacagatgtggcccctgtgtccttcttcctggtgctggatgtggtgtacctggtgtatgagagcaagcacctgcacgagggcgccaagtcagaaacagctgaggagctgaagaaggtggcccaggagctggaggagaagctgaacatcctgaacaacaactacaagatcctgcaggccgaccaggagctgtag

SEQ ID NO: 143880 - DNA, 1197 bp, Artificial Sequence; identical to SEQ ID NO: 143879
  Description of Artificial Sequence: Synthetic coding sequence

SEQ ID NO: 143881 - DNA, 1197 bp, Artificial Sequence; identical to SEQ ID NO: 143879
  Description of Artificial Sequence: Synthetic coding sequence

SEQ ID NO: 143882 - DNA, 1197 bp, Artificial Sequence; identical to SEQ ID NO: 143879
  Description of Artificial Sequence: Synthetic coding sequence

SEQ ID NO: 143883 - DNA, 1143 bp, Artificial Sequence
  Description of Artificial Sequence: Synthetic coding sequence
atggagggcgccgccctgctgcgggtgtctgtgctgtgcatctgggtgcagcagaatgtgcccagcggcacagacaccggggacccccagagcaagcccctgggggactgggccgccggcaccatggaccctgagagcagcatcttcattgaagatgccatcaagtacttcaaggagaaggtgtccacccagaacctgctgctgctgctgacagacaatgaggcctggaatggatttgtggccgctgctgagctgcccagaaatgaagcagatgagctgaggaaggccctggacaacctggcccggcagatgatcatgaaggacaagaactggcatgacaagggccagcagtacagaaactggttcctgaaggagttcccccggctgaagtctgagctggaggacaacatccggcggctgcgggccctggctgatggagtgcagaaggtgcacaagggcaccaccatcgccaacgtggtgtctggcagcctgagcatcagcagcggcatcctgaccctggtgggcatgggcctggcccccttcacagagggcggcagcctggtgctgctggagcccggcatggagctgggcatcacagctgccctgaccggcatcaccagcagcaccatggactatggcaagaagtggtggacccaggcccaggcccatgacctggtgatcaagagcctggacaagctgaaggaggtgcgggagttcctgggggagaacatcagcaacttcctgagcctggccggcaacacctaccagctgacccggggcatcggcaaggacatccgggccctgcggcgggcccgggccaacctgcagagcgtgccccacgccagcgccagccggccccgggtgacagagcccatctctgctgagagcggggagcaggtggagcgggtgaatgagcccagcatcctggagatgagccggggcgtgaagctgacagatgtggcccctgtgtccttcttcctggtgctggatgtggtgtacctggtgtatgagagcaagcacctgcacgagggcgccaagtcagaaacagctgaggagctgaagaaggtggcccaggagctggaggagaagctgaacatcctgaacaacaactacaagatcctgcaggccgaccaggagctgtag

SEQ ID NO: 143884 - DNA, 483 bp, Artificial Sequence
  Description of Artificial Sequence: Synthetic coding sequence
atggagggcgccgccctgctgcgggtgtctgtgctgtgcatctggatgtctgccctcttcctgggcgtgggcgtgcgggcagaggaggccggggcccgggtgcagcagaatgtgcccagcggcacagacaccggggacccccagagcaagcccctgggggactgggccgccggcaccatggaccctgagagcagcatcttcattgaagatgccatcaagtacttcaaggagaaggtgtccacccagaacctgctgctgctgctgacagacaatgaggcctggaatggatttgtggccgctgctgagctgcccagaaatgaagcagatgagctgaggaaggccctggacaacctggcccggcagatgatcatgaaggacaagaactggcatgacaagggccagcagtacagaaactggttcctgaaggagttcccccggctgaagtctgagctggaggacaacatccggcggctgcgggcctag

SEQ ID NO: 143885 - DNA, 426 bp, Artificial Sequence
  Description of Artificial Sequence: Synthetic coding sequence
atggagggcgccgccctgctgcgggtgtctgtgctgtgcatctggatgtctgccctcttcctgggcgtgggcgtgcgggcagaggaggccggggcccgggtgcagcagaatgtgcccagcggcacagacaccggggacccccagagcaagcccctgggggactgggccgccggcaccatggaccccggccctgctggcagcagaggagacagcggggagccctgcaccctgcggcctgcctgccggggccagaggcagcacggcggggccagccgcatctctgctgagggccctgcccccatgcccaggaggaggacccccagcacagcccacctgcgggtgcccaagaccagcagaagaaacctgctgtgcatgagagctgtgtccctgctgaggatgcccctgagcatcagcaggaagaagtag

SEQ ID NO: 143886 - DNA, 357 bp, Artificial Sequence
  Description of Artificial Sequence: Synthetic coding sequence
atgaggttcaagagccacacagtggagctgcggagcaccctgagccagcccctcttcagctgcagcagaagaagaccctgcagcgacatggagggcgccgccctgctgcgggtgtctgtgctgtgcatctggatgtctgccctcttcctgggcgtgggcgtgcgggcagaggaggccggggcccgggtgcagcagaatgtgcccagcggcacagacacaggagacccccagagcaagcccctgggggactgggccgccggcaccatggaccctgagagcagcatcttcattgaagatgccatcaagtacttcaaggagaaggtgtccacccagaacctgctgctgctgctgacctag

SEQ ID NO: 143887 - DNA, 426 bp, Artificial Sequence; identical to SEQ ID NO: 143885
  Description of Artificial Sequence: Synthetic coding sequence

SEQ ID NO: 143888 - DNA, 1014 bp, Artificial Sequence
  Description of Artificial Sequence: Synthetic coding sequence
atgaaccctgagagcagcatcttcatcgaggactacctgaagtacttccaggaccaggtgtcccgggagaacctgctgcagctgctgacagatgatgaggcctggaatggatttgtggccgctgctgagctgcccagagatgaagcagatgagctgaggaaggccctgaacaagctggccagccacatggtgatgaaggacaagaacagacatgacaaggaccagcagcaccggcagtggttcctgaaggagttcccccggctgaagcgggagctggaggaccacatcaggaagctgcgggccctggccgaggaggtggagcaggtgcaccggggcaccaccatcgccaacgtggtgagcaacagcgtgggcaccaccagcggcatcctgaccctgctgggcctgggcctggcccccttcacagagggcatcagctttgtgctgctggacaccggcatgggcctgggcgctgctgctgctgtggccggcatcacctgcagcgtggtggagctggtgaacaagctgcgggcccgggcccaggccaggaacctggaccagagcggcaccaacgtggccaaggtgatgaaggagtttgtgggcggcaacaccccaaatgtgctgaccctggtggacaactggtaccaggtgacccagggcatcggcaggaacatccgggccatccggcgggcccgggccaacccccagctgggcgcctatgcccccccaccccacatcatcggccgcatctctgctgagggcggggagcaggtggagcgggtggtggagggccctgcccaggccatgagccggggcaccatgattgtgggcgccgccactggaggcatcctgctgctgctggatgtggtgtccctggcctatgagagcaagcacctgctggagggcgccaagtctgagagcgctgaggagctgaagaagagggcccaggagctggagggcaagctgaacttcctgaccaagatccacgagatgctgcagcccggccaggaccagtag

SEQ ID NO: 143889 - DNA, 1014 bp, Artificial Sequence; identical to SEQ ID NO: 143888
  Description of Artificial Sequence: Synthetic coding sequence

SEQ ID NO: 143890 - DNA, 1350 bp, Artificial Sequence
  Description of Artificial Sequence: Synthetic coding sequence
atgcacagctggacctgggacccccacagcagcgagcagctggacctggcccagagcctgtctgaggaggaccccctgagcagcctgcggggcagcatccagccccagcccccagctgaggccccagacaagggcggcagccaggccaacaatgaccccggcggctgggaccccggctgcagcagcagccaggtgctgggccgcacccggggcccctgcctgggcgtgcgggtgcgggaggaggaggccggcaccagggtgaaggagaacctgcctgtgtggacagtgactggagagctgcagggcaagcccctgggcaacccagctgctggcaccatgaaccctgagagcagcatcttcatcgaggactacctgaagtacttccaggaccaggtgtcccgggagaacctgctgcagctgctgacagatgatgaggcctggaatggatttgtggccgctgctgagctgcccagagatgaagcagatgagctgaggaaggccctgaacaagctggccagccacatggtgatgaaggacaagaacagacatgacaaggaccagcagcaccggcagtggttcctgaaggagttcccccggctgaagcgggagctggaggaccacatcaggaagctgcgggccctggccgaggaggtggagcaggtgcaccggggcaccaccatcgccaacgtggtgagcaacagcgtgggcaccaccagcggcatcctgaccctgctgggcctgggcctggcccccttcacagagggcatcagctttgtgctgctggacaccggcatgggcctgggcgctgctgctgctgtggccggcatcacctgcagcgtggtggagctggtgaacaagctgcgggcccgggcccaggccaggaacctggaccagagcggcaccaacgtggccaaggtgatgaaggagtttgtgggcggcaacaccccaaatgtgctgaccctggtggacaactggtaccaggtgacccagggcatcggcaggaacatccgggccatccggcgggcccgggccaacccccagctgggcgcctatgcccccccaccccacatcatcggccgcatctctgctgagggcggggagcaggtggagcgggtggtggagggccctgcccaggccatgagccggggcaccatgattgtgggcgccgccactggaggcatcctgctgctgctggatgtggtgtccctggcctatgagagcaagcacctgctggagggcgccaagtctgagagcgctgaggagctgaagaagagggcccaggagctggagggcaagctgaacttcctgaccaagatccacgagatgctgcagcccggccaggaccagtag

SEQ ID NO: 143891 - DNA, 225 bp, Artificial Sequence
  Description of Artificial Sequence: Synthetic coding sequence
atgaaccctgagagcagcatcttcatcgaggactacctgaagtacttccaggaccaggtgtcccgggagaacctgctgcagctgctgacagatgatgaggcctggaatggatttgtggccgctgctgagctgcccagagatgaagcagatgagctgaggaaggccctgaacaagctggccagccacatggtgatgaaggacaagaacagacatgacaaggactag

SEQ ID NO: 143892 - DNA, 387 bp, Artificial Sequence
  Description of Artificial Sequence: Synthetic coding sequence
atgaaccctgagagcagcatcttcatcgaggactacctgaagtacttccaggaccaggtgtcccgggagaacctgctgcagctgctgacagatgatgaggcctggaatggatttgtggccgctgctgagctgcccagagatgaagcagatgagctgaggaaggccctgaacaagctggccagccacatggtgatgaaggacaagaacagacatgacaaggaccagcagcaccggcagtggttcctgaaggagttcccccggctgaagcgggagctggaggaccacatcaggaagctgcgggccctggccgaggaggtggagcaggtgcaccggggcaccaccatcgccaacgtggtgagcaacagcgtgggcaccaccagcggctag

SEQ ID NO: 143893 - DNA, 1209 bp, Artificial Sequence
  Description of Artificial Sequence: Synthetic coding sequence
atgggcctgggccagggctggggctgggaggccagctgctttgcctgcctgatccgcagctgctgccaggtggtgaccttcaccttccccttcggcttccagggcatcagccagagcctggagaatgtgtctggctactatgcagatgcccggctggaggtgggcagcacccagctgaggacagctggcagctgcagccacagcttcaagaggagcttcctggagaagaagcgcttcacagaggaggccaccaagtacttccgggagcgggtgtcccctgtgcacctgcagatcctgctgaccaacaatgaggcctggaagagatttgtgacagctgctgagctgcccagagatgaagcagatgccctgtatgaggccctgaagaagctgcggacctacgccgccattgaagatgaatatgtgcagcagaaggatgagcagttccgggagtggttcctgaaggagttcccccaggtgaagaggaagatccaggagagcattgagaagctgcgggccctggccaatggaattgaggaggtgcaccggggctgcaccatcagcaatgtggtgagcagcagcactggagctgccagcggcatcatgagcctggccggcctggtgctggcccccttcaccgctggcaccagcctggccctgacagctgctggggtgggcctgggcgccgccagcgctgtgacaggcatcaccaccagcatcgtggagcacagctacaccagcagcgctgaggccgaggccagccggctgacagccaccagcattgaccggctgaaggtgttcaaggaggtgatgagggacatcacccccaacctgctgagcctgctgaacaactactatgaggccacccagaccatcggcagcgagatccgggccatccggcaggcccgggcccgggcccggctgcctgtgaccacctggaggatctctgctggcagcggcggccaggccgagaggaccatcgccggcaccaccagggctgtgtccagaggagcccgcatcctgagcgccaccaccagcggcatcttcctggccctggatgtggtgaacctggtgtatgagagcaagcacctgcacgagggcgccaagagcgccagcgctgaggagctgcggcggcaggcccaggagctggaggagaacctgatggagctgacccagatctaccagaggctgaacccctgccacacccactag

SEQ ID NO: 143894 - DNA, 609 bp, Artificial Sequence
  Description of Artificial Sequence: Synthetic coding sequence
atgagcctggccggcctggtgctggcccccttcaccgctggcaccagcctggccctgacagctgctggggtgggcctgggcgccgccagcgctgtgacaggcatcaccaccagcatcgtggagcacagctacaccagcagcgctgaggccgaggccagccggctgacagccaccagcattgaccggctgaaggtgttcaaggaggtgatgagggacatcacccccaacctgctgagcctgctgaacaactactatgaggccacccagaccatcggcagcgagatccgggccatccggcaggcccgggcccgggcccggctgcctgtgaccacctggaggatctctgctggcagcggcggccaggccgagaggaccatcgccggcaccaccagggctgtgtccagaggagcccgcatcctgagcgccaccaccagcggcatcttcctggccctggatgtggtgaacctggtgtatgagagcaagcacctgcacgagggcgccaagagcgccagcgctgaggagctgcggcggcaggcccaggagctggaggagaacctgatggagctgacccagatctaccagaggctgaacccctgccacacccactag

SEQ ID NO: 143895 - DNA, 609 bp, Artificial Sequence; identical to SEQ ID NO: 143894
  Description of Artificial Sequence: Synthetic coding sequence

SEQ ID NO: 143896 - DNA, 996 bp, Artificial Sequence
  Description of Artificial Sequence: Synthetic coding sequence
atggattctgagaagaagcgcttcacagaggaggccaccaagtacttccgggagcgggtgtcccctgtgcacctgcagatcctgctgaccaacaatgaggcctggaagagatttgtgacagctgctgagctgcccagagatgaagcagatgccctgtatgaggccctgaagaagctgcggacctatgctgccattgaagatgaatatgtgcagcagaaggatgagcagttccgggagtggttcctgaaggagttcccccaggtgaagaggaagatccaggagagcattgagaagctgcgggccctggccaacggcatcgaggaggtgcaccggggctgcaccatcagcaatgtggtgagcagcagcactggagctgccagcggcatcatgagcctggccggcctggtgctggcccccttcaccgctggcaccagcctggccctgacagctgctggggtgggcctgggcgccgccagcgctgtgacaggcatcaccaccagcatcgtggagcacagctacaccagcagcgctgaggccgaggccagccggctgacagccaccagcattgaccggctgaaggtgttcaaggaggtgatgagggacatcacccccaacctgctgagcctgctgaacaactactatgaggccacccagaccatcggcagcgagatccgggccatccggcaggcccgggcccgggcccggctgcctgtgaccacctggaggatctctgctggcagcggcggccaggccgagaggaccatcgccggcaccaccagggctgtgtccagaggagcccgcatcctgagcgccaccaccagcggcatcttcctggccctggatgtggtgaacctggtgtatgagagcaagcacctgcatgaaggagccaagagcgccagcgctgaggagctgcggcggcaggcccaggagctggaggagaacctgatggagctgacccagatctaccagaggctgaacccctgccacacccactag

SEQ ID NO: 143897 - DNA, 609 bp, Artificial Sequence; identical to SEQ ID NO: 143894
  Description of Artificial Sequence: Synthetic coding sequence

SEQ ID NO: 143898 - DNA, 324 bp, Artificial Sequence
  Description of Artificial Sequence: Synthetic coding sequence
atgggctcctgggtgcagctgatcacctctgtgggcaccagcggcctcttcctgggcgtgcgggtgcgggaggagggcgccggcatgcgctgcagcaagaccatccaggccggccagtggctggacagcagcaagggccccctgggccccagccccccacctgtgcccacagctggctacagcagcagcttctgtgtgcactacgtgaacctgctgcccggggtgctggtgctgtctgtgaccagccagtacccccacctgtccatggccctgtgccagctggccgcccatgactggccccggctgagctgtgtgtgtgtgtag

SEQ ID NO: 143899 - DNA, 1044 bp, Artificial Sequence
  Description of Artificial Sequence: Synthetic coding sequence
atgggctcctgggtgcagctgatcacctctgtgggcgtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtggccgagctgccccgggaggaggctgatgccctgtatgaggccctgaagaacctgaccccctacgtggccatcgaggacaaggacatgcagcagaaggagcagcagttccgggagtggttcctgaagttcccccagatccgctggaagatccaggagagcattgagcggctgcgggtgattgccaatgaaattgagaaggtgcaccggggctgcgtcatcgccaacgtggtgtctggcagcacaggcatcctgagcgtcatcggcgtgatgctggcccccttcaccgctggcctgagcctgagcatcacagctgctggggtgggcctgggcatcgccagcgccacagctggcatcgccagcagcatcgtggagaacacctacaccaggtctgctgagctgacagccagccggctgacagccaccagcacagaccagctggaggccctgcgggacatcctgcgggacatcacccccaacgtgctgagctttgccctggactttgatgaggccaccaagatgattgccaatgatgtgcacaccctgcggcgcagcaaggccaccgtgggccggcccctcatcgcctggaggtatgtgcccatcaacgtggtggagaccctgcggaccaggggggcccccacccgcatcgtgaggaaggtggccaggaacctgggcaaggccaccagcggcgtgctggtggtgctggatgtggtgaacctggtgcaggacagcctggacctgcacaagggggccaagtctgagagcgctgagagcctgcggcagtgggcccaggagctggaggagaacctgaatgagctgacccacatccaccagagcctgaaggccggctag

SEQ ID NO: 143900 - DNA, 1053 bp, Artificial Sequence
  Description of Artificial Sequence: Synthetic coding sequence
atggagggcgccgccctgctgaagatctttgtggtgtgcatctgggtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtggccgagctgccccgggaggaggctgatgccctgtatgaggccctgaagaacctgaccccctacgtggccatcgaggacaaggacatgcagcagaaggagcagcagttccgggagtggttcctgaagttcccccagatccgctggaagatccaggagagcattgaaaggctgcgggtcatcgccaatgaaattgagaaggtgcaccggggctgtgtgattgccaacgtggtgtctggcagcacaggcatcctgtctgtgattggagtgatgctggcccccttcaccgctggcctgagcctgagcatcacagctgctggggtgggcctgggcatcgccagcgccacagctggcatcgccagcagcatcgtggagaacacctacaccaggtctgctgagctgacagccagccggctgacagccaccagcacagaccagctggaggccctgcgggacatcctgcgggacatcaccccaaatgtgctgagctttgccctggactttgatgaggccaccaagatgattgccaatgatgtgcacaccctgcggcgcagcaaggccaccgtgggccggcccctgattgcctggaggtatgtgcccatcaacgtggtggagaccctgcggaccaggggggcccccaccagaattgtgaggaaggtggccaggaacctgggcaaggccaccagcggcgtgctggtggtgctggatgtggtgaacctggtgcaggacagcctggacctgcacaagggggccaagtctgagagcgctgagagcctgcggcagtgggcccaggagctggaggagaacctgaatgagctgacccacatccaccagagcctgaaggccggctag

SEQ ID NO: 143901 - DNA, 393 bp, Artificial Sequence
  Description of Artificial Sequence: Synthetic coding sequence
atggagggcgccgccctgctgaagatctttgtggtgtgcatctgggtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtggccgagctgccccgggaggaggctgatgccctgtatgaggccctgaagaacctgaccccctacgtggccatcgaggacaaggacatgcagcagaaggagcagcagttccgggagtggttcctgaaggtgagcagcaaccagatggaggacagcggcgtgcacaggaaggccagctgccactgcaagtag

SEQ ID NO: 143902 - DNA, 384 bp, Artificial Sequence
  Description of Artificial Sequence: Synthetic coding sequence
atgggctcctgggtgcagctgatcacctctgtgggcgtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtggccgagctgccccgggaggaggctgatgccctgtatgaggccctgaagaacctgaccccctacgtggccatcgaggacaaggacatgcagcagaaggagcagcagttccgggagtggttcctgaaggtgagcagcaaccagatggaggacagcggcgtgcacaggaaggccagctgccactgcaagtag

SEQ ID NO: 143903 - DNA, 198 bp, Artificial Sequence
  Description of Artificial Sequence: Synthetic coding sequence
atgggctcctgggtgcagctgatcacctctgtgggcgtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtgtag

SEQ ID NO: 143904 - DNA, 384 bp, Artificial Sequence; identical to SEQ ID NO: 143902
  Description of Artificial Sequence: Synthetic coding sequence

SEQ ID NO: 143905 - DNA, 183 bp, Artificial Sequence
  Description of Artificial Sequence: Synthetic coding sequence
atgggctcctgggtgcagctgatcacctctgtgggcgtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagtag

SEQ ID NO: 143906 - DNA, 219 bp, Artificial Sequence
  Description of Artificial Sequence: Synthetic coding sequence
atgggctcctgggtgcagctgatcacctctgtgggcgtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtggccgagctgccccgggaggagtag

SEQ ID NO: 143907 - DNA, 213 bp, Artificial Sequence
  Description of Artificial Sequence: Synthetic coding sequence
atgggctcctgggtgcagctgatcacctctgtgggcgtgcagcagaaccaccctggctggacagtggccggccagttccaggagaagaagcgcttcacagaggaggtgattgagtacttccagaagaaggtgtcccctgtgcacctgaagatcctgctgaccagtgatgaggcctggaagagatttgtgcgggtggccgagctgcccaggtag

SEQ ID NO: 143908 - DNA, 1302 bp, Artificial Sequence
  Description of Artificial Sequence: Synthetic coding sequence
atgccctgtgggaagcagggcaacctgcaggtgcccggcagcaaggtgctgcccggcctgggggagggctgcaaggagatgtggctgaggaaggtgatctacggcggggaggtgtggggcaagagccctgagcctgagttccccagcctggtgaacctgtgccagagctggaagatcaacaacctgatgagcacagtgcacagtgatgaagctggcatgctgagctacttcctgtttgaggagctgatgagatgtgacaaggacagcatgccagatggcaacctgtctgaggaggagaagctgttcctgagctacttccccctgcacaagtttgagctggagcagaacatcaaggagctgaacaccctggccgaccaggtggacaccacccatgagctgctgaccaagaccagcctggtggccagcagcagcggggctgtgtctggagtgatgaacatcctgggcctggccctggcccctgtgacagctgggggcagcctgatgctgagcgccaccggcaccggcctgggcgctgctgctgccatcaccaacatcgtgaccaacgtgctggagaacagaagcaacagcgctgcccgggacaaggccagccggctgggccccctgaccaccagccatgaggcctttggaggcatcaactggagcgagattgaagctgctggcttctgtgtgaacaagtgtgtgaaggccatccagggcatcaaggacctgcacgcctaccagatggccaagagcaacagcggcttcatggccatggtgaagaactttgtggccaagaggcacatccccttctggacagcccggggcgtgcagagggcctttgagggcaccaccctggccatgaccaatggagcctgggtgatgggcgctgctggagctggcttcctgctgatgaaggacatgagcagcttcctgcagagctggaagcacctggaggatggagccaggacagaaacagctgaggagctgcgggccctggccaagaagctggagcaggagctggaccggctgacccagcaccaccgccacctgccccagaaggccagccagacctgcagcagcagccggggccgggctgtgcggggcagccgggtggtgaagccagagggcagccgcagccccctgccctggcctgtggtggagcaccagccccggctgggccctggggtggccctgcggacccccaagaggacagtgtctgcccccaggatgctgggccaccagcctgcccccccagccccagccaggaagggccggcaggcccctggccgccaccggcagtag

SEQ ID NO: 143909 - DNA, 1032 bp, Artificial Sequence
  Description of Artificial Sequence: Synthetic coding sequence
atggacaaccaggccgagcgggagagcgaggccggcgtgggcctgcagagagatgaagatgatgcccccctgtgtgaagatgtggagctgcaggatggagacctgagccctgaggagaagatcttcctgcgggagttcccccggctgaaggaggacctgaagggcaacatcgacaagctgcgggccctggctgatgacatcgacaagacccacaagaagttcaccaaggccaacatggtggccaccagcacagctgtgatcagcggcgtgatgagcctgctgggcctggccctggccccagccaccggcggcggcagcctgctgctgagcacagctggccagggcctggccacagctgctggggtgaccagcatcgtgtctggcaccctggagaggagcaagaacaaggaggcccaggcccgggcagaggacatcctgcccacctatgaccaggaggacagagaagatgaggaggagaaggctgactatgtgacagctgctgggaagatcatctacaacctgaggaacaccctgaagtatgccaagaagaatgtgcgggccttctggaagctgcgggccaacccccggctggccaatgccaccaagaggctgctgaccaccggccaggtgagcagccgcagccgggtgcaggtgcagaaggcctttgctggcaccaccctggccatgaccaagaatgcccgggtgctgggcggcgtgatgtctgccttcagcctgggctatgacctggccaccctgagcaaggagtggaagcacctgaaggagggcgcccggaccaagtttgctgaggagctgcgggccaaggccctggagctggagaggaagctgacagagctgacccagctgtacaagagcctgcagcagaaggtgcgcagccgggcccggggcgtgggcaaggacctgaccggcacctgtgaaacagaggcctactggaaggagctgcgggagcacgtgtggatgtggctgtggctgtgtgtgtgcctgtgtgtgtgtgtgtatgtgcagttcacctag

SEQ ID NO: 143910 - DNA, 540 bp, Artificial Sequence
  Description of Artificial Sequence: Synthetic coding sequence
atgttcaaggtgatccagaggtctgtgggccctgccagcctgagcctgctgaccttcaaggtgtatgctgcccccaagaaggacagcccccccaagaacagcgtgaaggtggatgagctgagcctgtacagcgtgcctgagggccagagcaaatatgtggaggaggcccggagccagctggaggagagcatcagccagctgcggcactactgtgagccctacaccacctggtgccagacagccatgaccatcagcaagatgcacctgctcttcttcccccggctgggcgtcatcggctttgctggcctcatcggcctgctgctggcccggggcagcaagatcaagaagctggtgtacccacctggcttcatgggcctggccgccagcctgtactacccccagcaggccatcgtgtttgcccaggtgtctggagagcggctgtatgactggggcctgcggggctacatcgtgattgaggacctgtggaaggagaacttccagaagccaggaaatgtgaagaacagccctggcaccaagtag

SEQ ID NO: 143911 - DNA, 597 bp, Artificial Sequence
  Description of Artificial Sequence: Synthetic coding sequence
atgttcaaggtgatccagaggtctgtgggccctgccagcctgagcctgctgaccttcaaggtgtatgctgcccccaagaaggacagcccccccaagaacagcgtgaaggtggatgagctgagcctgtacagcgtgcctgagggccagagcaaatatgtggaggaggcccggagccagctggaggagagcatcagccagctgcggcactactgtgagccctacaccacctggtgccaggagacctacagccagaccaagcccaagatgcagagcctggtgcagtggggcctggacagctatgactacctgcagaatgcccctcctggcttcttcccccggctgggcgtgattggatttgctggcctgattggcctgctgctggcccggggcagcaagatcaagaagctggtgtacccacctggcttcatgggcctggccgccagcctgtactacccccagcaggccatcgtgtttgcccaggtgtctggagagcggctgtatgactggggcctgcggggctacatcgtgattgaggacctgtggaaggagaacttccagaagccaggaaatgtgaagaacagccctggcaccaagtag

SEQ ID NO: 143912 - DNA, 537 bp, Artificial Sequence
  Description of Artificial Sequence: Synthetic coding sequence
gtgtatgctgcccccaagaaggacagcccccccaagaacagcgtgaaggtggatgagctgagcctgtacagcgtgcctgagggccagagcaaatatgtggaggaggcccggagccagctggaggagagcatcagccagctgcggcactactgtgagccctacaccacctggtgccaggagacctacagccagaccaagcccaagatgcagagcctggtgcagtggggcctggacagctatgactacctgcagaatgcccctcctggcttcttcccccggctgggcgtgattggatttgctggcctgattggcctgctgctggcccggggcagcaagatcaagaagctggtgtacccacctggcttcatgggcctggccgccagcctgtactacccccagcaggccatcgtgtttgcccaggtgtctggagagcggctgtatgactggggcctgcggggctacatcgtgattgaggacctgtggaaggagaacttccagaagccaggaaatgtgaagaacagccctggcaccaagtag

SEQ ID NO: 143913 - DNA, 1332 bp, Artificial Sequence
  Description of Artificial Sequence: Synthetic coding sequence
atggaccggctgggccccttcagcaatgaccccagcgacaagccaccctgccggggctgcagcagctacctgatggagccctacatcaagtgtgctgaatgtggccccccacccttcttcctgtgcctgcagtgcttcacccggggctttgagtacaagaagcaccagagcgaccacacctatgagatcatgaccagtgacttccctgtgctggaccccagctggacagcccaggaggagatggccctgctggaggccgtgatggactgtggcttcggcaactggcaggatgtggccaaccagatgtgcaccaagaccaaggaggagtgtgagaagcactacatgaagcacttcatcaacaaccccctgtttgccagcaccctgctgaacctgaagcaggccgaggaggccaagacagctgacacagccatccccttccacagcacagatgaccccccccggcccacctttgacagcctgctgagccgggacatggccggctacatgcctgcccgggctgacttcatcgaggagtttgacaactatgcagagtgggacctgcgggacatcgactttgtggaggatgacagcgacatcctgcacgccctgaagatggctgtggtggacatctaccacagccggctgaaggagcggcagaggaggaagaagatcatccgggaccacggcctcatcaacctgaggaagttccagctgatggagcggcgctaccccaaggaggtgcaggacctgtatgagaccatgagaagatttgcccgcatcgtgggccctgtggagcatgacaagttcatcgagagccacgccctggagtttgagctgcggcgggagatcaagaggctgcaggagtacagaacagctggcatcaccaacttctgcagcgcccggacctatgaccacctgaagaagacccgggaggaggagcggctgaagaggaccatgctgtctgaggtgctgcagtacatccaggacagcagcgcctgccagcagtggctgcggcggcaggccgacattgattctggcctgagccccagcatccccatggccagcaacagcggcagaagaagtgccccacccctgaacctgaccggcctgcctggaacagagaagctgaatgagaaggagaaggagctgtgccagatggtgcggctggtgcctggggcctacctggagtacaagagcgccctgctgaatgaatgcaacaagcagggcggcctgcggctggcccaggcccgggccctgatcaagattgatgtgaacaagaccaggaagatctatgacttcctgatccgggagggctacatcaccaagggctag

SEQ ID NO: 143914 - DNA, 978 bp, Artificial Sequence
  Description of Artificial Sequence: Synthetic coding sequence
atggtgccccgggaggcccctgagagcgcccagtgcctgtgccccagcctgaccatccccaatgccaaggatgtgctgaggaagaggcacaagaggaggagccggcagcaccagcgcttcatggccaggaaggccctgctgcaggagcagggcctgctgtccatgcctcctgagcccggcagcagccccctgcccaccccatttggagctgccacagccacagaggccgccagcagcggcaagcagtgcctgcgggccggcagcggcagcgccccctgcagcagaagacctgcccctgggaaggccagcggccccctgcccagcaaatgtgtggccatcgactgtgagatggtgggcaccggcccccggggccgggtgtctgagctggcccgctgcagcatcgtgtcctaccacggcaatgtgctgtatgacaagtacatccggcctgagatgcccatcgctgactaccgcacccgctggagcggcatcacccggcagcacatgaggaaggctgtgcccttccaggtggcccagaaggagatcctgaagctgctgaagggcaaggtggtggtgggccacgccctgcacaatgacttccaggccctgaagtatgtgcaccccaggagccagacccgggacaccacctacgtgcccaacttcctgtctgagcccggcctgcacacccgggcccgggtgtccctgaaggacctggccctgcagctgctgcacaagaagatccaggtgggccagcacggccacagctctgtggaggatgccaccacagccatggagctgtaccgcctggtggaggtgcagtgggagcagcaggaggcccggagcctgtggacctgcccagaggaccgggagccagacagcagcacagacatggagcagtacatggaggaccagtactggccagatgacctggcccacggcagcagaggaggagcccgggaggcccaggacagaagaaattag

SEQ ID NO: 143915 - DNA, 984 bp, Artificial Sequence
  Description of Artificial Sequence: Synthetic coding sequence
atggtgccccgggaggcccctgagagcgcccagtgcctgtgccccagcctgaccatccccaatgccaaggatgtgctgaggaagaggcacaagaggaggagccggcagcaccagcgcttcatggccaggaaggccctgctgcaggagcagggcctgctgtccatgcctcctgagcccggcagcagccccctgcccaccccatttggagctgccacagccacagaggccgccagcagcggcaagcagtgcctgcgggccggcagcggcagcgccccctgcagcagaagacctgcccctgggaaggccagcggccccctgcccagcaaatgtgtggccatcgactgtgagatggtgggcaccggcccccggggccgggtgtctgagctggcccgctgcagcatcgtgtcctaccacggcaatgtgctgtatgacaagtacatccggcctgagatgcccatcgctgactaccgcacccgctggagcggcatcacccggcagcacatgaggaaggctgtgcccttccaggtggcccagaaggagatcctgaagctgctgaagggcaaggtggtggtgggccacgccctgcacaatgacttccaggccctgaagtatgtgcaccccaggagccagacccgggacaccacctacgtgcccaacttcctgtctgagcccggcctgcacacccgggcccgggtgtccctgaaggacctggccctgcagctgctgcacaagaagatccaggtgggccagcacggccacagctctgtggaggatgccaccacagccatggagctgtaccgcctggtggaggtgcagtgggagcagcaggaggcccggagcctgtggacctgcccagaggaccgggagccagacagcagcacagacatggagcagtacatggaggaccagagcacccagtactgggccctgaagcagaagtctgagaagcaggacagcggcctgaacagcggggcctttgtgtag

SEQ ID NO: 143916 - DNA, 1515 bp, Artificial Sequence
  Description of Artificial Sequence: Synthetic coding sequence
atgcccaccgtggaggagctgtacagaaattatggcatcctggctgatgccacagagcaggtgggccagcacaaggatgcctaccaggtgatcctggatggagtgaagggcggcaccaaggagaagaggctggccgcccagttcatccccaagttcttcaagcacttccctgagctggccgacagcgccatcaatgcccagctggacctgtgtgaagatgaagatgtgtccatccggcggcaggccatcaaggagctgccccagtttgccactggagagaacctgccccgggtggccgacatcctgacccagctgctgcagacagatgattctgctgagttcaacctggtgaacaatgccctgctgagcatcttcaagatggatgccaagggcaccctgggcggcctcttcagccagatcctgcagggcgaggacatcgtgcgggagcgggccatcaagttcctgagcaccaagctgaagaccctgcctgatgaggtgctgaccaaggaggtggaggagctgatcctgacagagagcaagaaggtgctggaggatgtgactggagaggagtttgtgctcttcatgaagatcctgagcggcctgaagagcctgcagacagtgtctggccggcagcagctggtggagctggtggccgagcaggccgacctggagcagaccttcaaccccagcgaccctgactgtgtggaccggctgctgcagtgcacccggcaggccgtgcccctcttcagcaagaatgtgcacagcaccaggtttgtgacctacttctgtgagcaggtgctgcccaacctgggcaccctgaccacccctgtggagggcctggacatccagctggaggtgctgaagctgctggccgagatgagcagcttctgtggggacatggagaagctggagaccaacctgaggaagctgtttgacaagctgctggagtacatgcccctgcccccagaggaggccgagaatggagaaaatgctggaaatgaggagcccaagctgcagttctcctatgtggagtgcctgctgtacagcttccaccagctgggcaggaagctgcctgacttcctgacagccaagctgaatgctgagaagctgaaggacttcaagatccggctgcagtactttgcccggggcctgcaggtgtacatccggcagctgcggctggccctgcagggcaagacaggagaggccctgaagacagaggagaacaagatcaaggtggtggccctgaagatcaccaacaacatcaacgtgctgatcaaggacctcttccacatcccccccagctacaagagcacagtgaccctgtcctggaagcctgtgcagaaggtggagatcggccagaagagggccagcgaggacaccaccagcggcagcccccccaagaagagcagcgctggccccaagagagatgcccggcagatctacaaccccccatctgggaagtacagcagcaacctgggcaacttcaactatgaaagaagcctgcagggcaagtag

SEQ ID NO: 143917 - DNA, 1353 bp, Artificial Sequence
  Description of Artificial Sequence: Synthetic coding sequence
atgcccaccgtggaggagctgtacagaaattatggcatcctggctgatgccacagagcaggtgggccagatccggcggcaggccatcaaggagctgccccagtttgccactggagagaacctgccccgggtggccgacatcctgacccagctgctgcagacagatgattctgctgagttcaacctggtgaacaatgccctgctgagcatcttcaagatggatgccaagggcaccctgggcggcctcttcagccagatcctgcagggcgaggacatcgtgcgggagcgggccatcaagttcctgagcaccaagctgaagaccctgcctgatgaggtgctgaccaaggaggtggaggagctgatcctgacagagagcaagaaggtgctggaggatgtgactggagaggagtttgtgctcttcatgaagatcctgagcggcctgaagagcctgcagacagtgtctggccggcagcagctggtggagctggtggccgagcaggccgacctggagcagaccttcaaccccagcgaccctgactgtgtggaccggctgctgcagtgcacccggcaggccgtgcccctcttcagcaagaatgtgcacagcaccaggtttgtgacctacttctgtgagcaggtgctgcccaacctgggcaccctgaccacccctgtggagggcctggacatccagctggaggtgctgaagctgctggccgagatgagcagcttctgtggggacatggagaagctggagaccaacctgaggaagctgtttgacaagctgctggagtacatgcccctgcccccagaggaggccgagaatggagaaaatgctggaaatgaggagcccaagctgcagttctcctatgtggagtgcctgctgtacagcttccaccagctgggcaggaagctgcctgacttcctgacagccaagctgaatgctgagaagctgaaggacttcaagatccggctgcagtactttgcccggggcctgcaggtgtacatccggcagctgcggctggccctgcagggcaagacaggagaggccctgaagacagaggagaacaagatcaaggtggtggccctgaagatcaccaacaacatcaacgtgctgatcaaggacctcttccacatcccccccagctacaagagcacagtgaccctgtcctggaagcctgtgcagaaggtggagatcggccagaagagggccagcgaggacaccaccagcggcagcccccccaagaagagcagcgctggccccaagagagatgcccggcagatctacaaccccccatctgggaagtacagcagcaacctgggcaacttcaactatgaaagaagcctgcagggcaagtag

SEQ ID NO: 143918 - DNA, 1575 bp, Artificial Sequence
  Description of Artificial Sequence: Synthetic coding sequence
atgcccaccgtggaggagctgtacagaaattatggcatcctggctgatgccacagagcaggtgggccagcacaaggatgcctaccaggtgatcctggatggagtgaagggcggcaccaaggagaagaggctggccgcccagttcatccccaagttcttcaagcacttccctgagctggccgacagcgccatcaatgcccagctggacctgtgtgaagatgaagatgtgtccatccggcggcaggccatcaaggagctgccccagtttgccactggagagaacctgccccgggtggccgacatcctgacccagctgctgcagacagatgattctgctgagttcaacctggtgaacaatgccctgctgagcatcttcaagatggatgccaagggcaccctgggcggcctcttcagccagatcctgcagggcgaggacatcgtgcgggagcgggccatcaagttcctgagcaccaagctgaagaccctgcctgatgaggtgctgaccaaggaggtggaggagctgatcctgacagagagcaagaaggtgctggaggatgtgactggagaggagtttgtgctcttcatgaagatcctgagcggcctgaagagcctgcagacagtgtctggccggcagcagctggtggagctggtggccgagcaggccgacctggagcagaccttcaaccccagcgaccctgactgtgtggaccggctgctgcagtgcacccggcaggccgtgcccctcttcagcaagaatgtgcacagcaccaggtttgtgacctacttctgtgagcaggtgctgcccaacctgggcaccctgaccacccctgtggagggcctggacatccagctggaggtgctgaagctgctggccgagatgagcagcttctgtggggacatggagaagctggagaccaacctgaggaagctgtttgacaagctgctggagtacatgcccctgcccccagaggaggccgagaatggagaaaatgctggaaatgaggagcccaagctgcagttctcctatgtggagtgcctgctgtacagcttccaccagctgggcaggaagctgcctgacttcctgacagccaagctgaatgctgagaagctgaaggacttcaagatccggctgcagtactttgcccggggcctgcaggtgtacatccggcagctgcggctggccctgcagggcaagacaggagaggccctgaagacagaggagaacaagatcaaggtggtggccctgaagatcaccaacaacatcaacgtgctgatcaaggacctcttccacatcccccccagctacaagagcacagtgaccctgtcctggaagcctgtgcagaaggtggagatcggccagaagagggccagcgaggacaccaccagcggcagcccccccaagaagagcagcgctggccccaagagagatgcccggcagatctacaaccccccatctgggaagtacagcagcaacctgggcaacttcaactatgagcagagaggagccttccggggcagccggggcggccggggctggggcacccggggcaacagaagccggggccgcctgtactag

SEQ ID NO: 143919 - DNA, 1533 bp, Artificial Sequence
  Description of Artificial Sequence: Synthetic coding sequence
atgcccaccgtggaggagctgtacagaaattatggcatcctggctgatgccacagagcaggtgggccagcacaaggatgcctaccaggtgatcctggatggagtgaagggcggcaccaaggagaagaggctggccgcccagttcatccccaagttcttcaagcacttccctgagctggccgacagcgccatcaatgcccagctggacctgtgtgaagatgaagatgtgtccatccggcggcaggccatcaaggagctgccccagtttgccactggagagaacctgccccgggtggccgacatcctgacccagctgctgcagacagatgattctgctgagttcaacctggtgaacaatgccctgctgagcatcttcaagatggatgccaagggcaccctgggcggcctcttcagccagatcctgcagggcgaggacatcgtgcgggagcgggccatcaagttcctgagcaccaagctgaagaccctgcctgatgaggtgctgaccaaggaggtggaggagctgatcctgacagagagcaagaaggtgctggaggatgtgactggagaggagtttgtgctcttcatgaagatcctgagcggcctgaagagcctgcagacagtgtctggccggcagcagctggtggagctggtggccgagcaggccgacctggagcagaccttcaaccccagcgaccctgactgtgtggaccggctgctgcagtgcacccggcaggccgtgcccctcttcagcaagaatgtgcacagcaccaggtttgtgacctacttctgtgagcaggtgctgcccaacctgggcaccctgaccacccctgtggagggcctggacatccagctggaggtgctgaagctgctggccgagatgagcagcttctgtggggacatggagaagctggagaccaacctgaggaagctgtttgacaagctgctggagtacatgcccctgcccccagaggaggccgagaatggagaaaatgctggaaatgaggagcccaagctgcagttctcctatgtggagtgcctgctgtacagcttccaccagctgggcaggaagctgcctgacttcctgacagccaagctgaatgctgagaagctgaaggacttcaagatccggctgcagtactttgcccggggcctgcaggtgtacatccggcagctgcggctggccctgcagggcaagacaggagaggccctgaagacagaggagaacaagatcaaggtggtggccctgaagatcaccaacaacatcaacgtgctgatcaaggacctcttccacatcccccccagctacaagagcacagtgaccctgtcctggaagcctgtgcagaaggtggagatcggccagaagagggccagcgaggacaccaccagcggcagcccccccaagaagagcagcgctggccccaagagagatgcccggcagatctacaaccccccatctgggaagtacagcagcaacctgggcaacttcaactatggagagcgcttccggctgggcaccaggaacatgagggactag

SEQ ID NO: 143920 - DNA, 1089 bp, Artificial Sequence
  Description of Artificial Sequence: Synthetic coding sequence
atgcaggccgagcggggggcccggggcggccggggcagaagacctggccggggccggcctggaggagacagacacagcgagaggcctggagctgctgctgctgtggcccggggcggcggcggcggcggcggcggagatggcggcggccggcggggccggggccggggccggggcttccggggggcccggggcggccggggcggcggcggggccccccggggcagccggcgggagcccggcggctggggcgctggggccagcgcccctgtggaggatgacagtgatgctgagacctatggagaggagaatgatgagcagggcaactacagcaagaggaagatcgtgagcaactgggaccgctaccaggacatcgagaaggaggtgaacaatgaaagtggagagagccagaggggcacagacttctctgtgctgctgagcagcgctggggacagcttcagccagttccgctttgctgaggagaaggagtgggacagcgaggccagctgccccaagcagaacagcgccttctacgtggacagcgagctgctggtgcgggccctgcaggagctgcccctgtgcctgcggctgaatgtggccgctgagctggtgcagggcaccgtgcccctggaggtgccccaggtgaagcccaagaggacagatgatggcaagggcctgggcatgcagctgaagggccccctgggccctgggggccggggccccatctttgagctgaagtctgtggccgccggctgccctgtgctgctgggcaaggacaaccccagccctggccccagccgggacagccagaagcccaccagccccctgcagagcgctggggaccacctggaggaggagctggacctgctgctgaacctggatgcccccatcaaggagggggacaacatcctgcctgaccagaccagccaggacctgaagagcaaagaagatggagaggtggtgcaggaggaggaggtgtgtgccaagcccagcgtgacagaggagaagaacatggagcctgagcagcccagcaccagcaagaatgtgacagaggaggagctggaggactggctggacagcatgatctcctag

SEQ ID NO: 143921 - DNA, 4125 bp, Artificial Sequence
  Description of Artificial Sequence: Synthetic coding sequence
atgagcagcagcttcttcaaccccagctttgccttcagcagccactttgatcctgatggagcccccctgtctgagctgtcctggcccagcagcctggccgtggtggccgtgtccttcagcggcctgtttgctgtgattgtgctgatgctggcctgcctgtgctgcaagaagggcggcatcggcttcaaggagtttgaaaatgcagaaggagatgaatatgctgctgacctggcccagggcagccctgccacagctgcccagaatggaccagatgtgtatgtgctgcccctgacagaggtgtccctgcccatggccaagcagcccggccgctctgtgcagctgctgaagagcacagatgtgggccgccacagcctgctgtacctgaaggagatcggccggggctggtttgggaaggtgttcctgggggaggtgaacagcggcatcagcagcgcccaggtggtggtgaaggagctgcaggccagcgcctctgtgcaggagcagatgcagttcctggaggaggtgcagccctaccgggccctgaagcacagcaacctgctgcagtgcctggcccagtgtgccgaggtgaccccctacctgctggtgatggagttctgccccctgggggacctgaagggctacctgcggagctgccgggtggccgagagcatggccccagaccccaggaccctgcagaggatggcctgtgaggtggcctgtggggtgctgcacctgcacaggaacaactttgtgcacagcgacctggccctgaggaactgcctgctgacagctgacctgactgtgaagattggagactatggcctggcccactgcaagtaccgggaggactactttgtgacagctgaccagctgtgggtgcccctgcgctggatcgcccctgagctggtggatgaggtgcacagcaacctgctggtggtggaccagaccaagtctggaaatgtgtggagcctgggcgtgaccatctgggagctgtttgagctgggcacccagccctacccccagcacagcgaccagcaggtgctggcctacacagtgcgggagcagcagctgaagctgcccaagccccagctgcagctgaccctgagtgaccgctggtatgaggtgatgcagttctgctggctgcagcctgagcagaggcccacagctgaggaggtgcacctgctgctgagctacctgtgtgccaagggggccacagaggccgaggaggagtttgagcggcgctggaggagcctgcggcctgggggcggcggcgtgggccctggccctggagctgctggccccatgctgggcggcgtggtggagctggccgccgccagcagcttccccctgctggagcagtttgctggagatggcttccacgcagatggagatgatgtgctgactgtgacagagaccagccggggcctgaactttgagtacaagtgggaggccggcagaggagctgaggccttccctgccaccctgagccctggccgcacagcccggctgcaggagctgtgtgccccagatggagcccctcctggggtggtgcctgtgctgagcgcccacagccccagcctgggcagcgagtacttcatccggctggaggaggccgccccagctgctggccatgaccctgactgtgccggctgtgcccccagccccccagccacagctgaccaggatgatgacagtgatggcagcacagctgccagcctggccatggagcccctgctgggccacggcccccctgtggatgtgccctggggccgcggggaccactacccccggcgcagcctggcccgggaccccctgtgccccagccgcagccccagccccagcgctggccccctgagcctggccgagggcggcgcagaagatgctgactggggcgtggccgccttctgcccagccttctttgaggaccccctgggcaccagccccctgggcagcagcggggccccacccctgcccctgactggagaagatgagctggaggaggtgggcgcccggcgggccgcccagaggggccactggaggagcaatgtgtctgccaacaacaacagcggcagccgctgcccagagagctgggaccctgtgtctgctgggggccatgctgagggctgccccagccccaagcagaccccccgggccagccctgagcccggctacccaggagagcccctgctgggcctgcaggccgccagcgcccaggagcccggctgctgccccggcctgccccacctgtgcagcgcccagggcctggccccagccccctgcctggtgacccccagctggacagaaacagccagcagtggaggagaccacccccaggccgagcccaagctggccacagaggccgagggcaccaccggcccccggctgcccctgcccagcgtgcccagccccagccaggagggcgcccccctgcccagcgaggaggccagcgccccagatgccccagatgccctgcctgacagccccaccccagccactggaggagaggtgtctgccatcaagctggccagcgccctgaatggcagcagcagcagccctgaggtggaggcccccagcagtgaagatgaggacacagctgaggccaccagcggcatcttcacagacaccagcagtgatggcctgcaggcccggcggccagatgtggtgcctgccttccgcagcctgcagaagcaggtgggcaccccagacagcctggacagcctggacatccccagcagcgccagtgatggcggctatgaggtgttcagccccagcgccaccggccccagcggcggccagccccgggccctggacagcggctatgacacagagaactatgagagccctgagtttgtgctgaaggaggcccaggagggctgtgagccccaggcctttgctgagctggccagcgagggggagggccctggccctgagacccggctgagcaccagcctgagcggcctgaatgagaagaacccctacagagattctgcctacttcagtgacctggaggccgaggccgaggccaccagcggccctgagaagaagtgtggcggggaccgggcccctggccctgagctgggcctgcccagcacaggccagcccagcgagcaggtgtgcctgcggcctggggtgtctggagaggcccagggcagcggccctggagaggtgctgccccccctgctgcagctggagggcagcagccctgagcccagcacctgccccagcggcctggtgcctgagcccccagagccccagggccctgccaaggtgcggcccggccccagccccagctgcagccagttcttcctgctgacccctgtgcccctgcggtctgagggcaacagcagcgagttccagggccccccaggcctgctgagcggccctgccccccagaagaggatgggcggccctggcaccccccgggcccccctgcggctggccctgcccggcctgcctgctgccctggagggccggcctgaggaggaggaggaggacagcgaggacagtgatgaaagtgatgaggagctgcgctgctacagcgtgcaggagcccagtgaagattctgaggaggaggccccagctgtgcctgtggtggtggccgagagccagagcgccaggaacctgcggagcctgctgaagatgcccagcctgctgtctgagaccttctgtgaggacctggagaggaagaagaaggctgtgtccttctttgatgatgtgacagtgtacctgtttgaccaggagagccccacccgggagctgggggagcccttccctggggccaaggagagcccccccaccttcctgcggggcagccctggcagccccagcgcccccaaccggccccagcaggctgatggcagccccaacggcagcacagctgaggagggcggcggctttgcctgggatgatgacttccccctgatgacagccaaggccgcctttgccatggccctggaccctgctgccccagccccagctgcccccacccccaccccagcccccttcagccgcttcaccgtgtccccagcccccaccagccgcttcagcatcacccacgtgtctgacagtgatgctgagagcaagaggggccctgaggccggggccggcggggagagcaaggaggcctag

SEQ ID NO: 143922 - DNA, 2640 bp, Artificial Sequence
  Description of Artificial Sequence: Synthetic coding sequence
atgagcagcagcttcttcaaccccagctttgccttcagcagccactttgatcctgatggagcccccctgtctgagctgtcctggcccagcagcctggccgtggtggccgtgtccttcagcggcctgtttgctgtgattgtgctgatgctggcctgcctgtgctgcaagaagggcggcatcggcttcaaggagtttgaaaatgcagaaggagatgaatatgctgctgacctggcccagggcagccctgccacagctgcccagaatggaccagatgtgtatgtgctgcccctgacagaggtgtccctgcccatggccaagcagcccggccgctctgtgcagctgctgaagagcacagatgtgggccgccacagcctgctgtacctgaaggagatcggccggggctggtttgggaaggtgttcctgggggaggtgaacagcggcatcagcagcgcccaggtggtggtgaaggagctgcaggccagcgcctctgtgcaggagcagatgcagttcctggaggaggtgcagccctaccgggccctgaagcacagcaacctgctgcagtgcctggcccagtgtgccgaggtgaccccctacctgctggtgatggagttctgccccctgggggacctgaagggctacctgcggagctgccgggtggccgagagcatggccccagaccccaggaccctgcagaggatggcctgtgaggtggcctgtggggtgctgcacctgcacaggaacaactttgtgcacagcgacctggccctgaggaactgcctgctgacagctgacctgactgtgaagattggagactatggcctggcccactgcaagtaccgggaggactactttgtgacagctgaccagctgtgggtgcccctgcgctggatcgcccctgagctggtggatgaggtgcacagcaacctgctggtggtggaccagaccaagtctggaaatgtgtggagcctgggcgtgaccatctgggagctgtttgagctgggcacccagccctacccccagcacagcgaccagcaggtgctggcctacacagtgcgggagcagcagctgaagctgcccaagccccagctgcagctgaccctgagtgaccgctggtatgaggtgatgcagttctgctggctgcagcctgagcagaggcccacagctgaggaggtgcacctgctgctgagctacctgtgtgccaagggggccacagaggccgaggaggagtttgagcggcgctggaggagcctgcggcctgggggcggcggcgtgggccctggccctggagctgctggccccatgctgggcggcgtggtggagctggccgccgccagcagcttccccctgctggagcagtttgctggagatggcttccacgcagatggagatgatgtgctgacagagctgtgtgccccagatggagcccctcctggggtggtgcctgtgctgagcgcccacagccccagcctgggcagcgagtacttcatccggctggaggaggccgccccagctgctggccatgaccctgactgtgccggctgtgcccccagccccccagccacagctgaccaggatgatgacagtgatggcagcacagctgccagcctggccatggagcccctgctgggccacggcccccctgtggatgtgccctggggccgcggggaccactacccccggcgcagcctggcccgggaccccctgtgccccagccgcagccccagccccagcgctggccccctgagcctggccgagggcggcgcagaagatgctgactggggcgtggccgccttctgcccagccttctttgaggaccccctgggcaccagccccctgggcagcagcggggccccacccctgcccctgactggagaagatgagctggaggaggtgggcgcccggcgggccgcccagaggggccactggaggagcaatgtgtctgccaacaacaacagcggcagccgctgcccagagagctgggaccctgtgtctgctgggggccatgctgagggctgccccagccccaagcagaccccccgggccagccctgagcccggctacccaggagagcccctgctgggcctgcaggccgccagcgcccaggagcccggctgctgccccggcctgccccacctgtgcagcgcccagggcctggccccagccccctgcctggtgacccccagctggacagaaacagccagcagtggaggagaccacccccaggccgagcccaagctggccacagaggccgagggcaccaccggcccccggctgcccctgcccagcgtgcccagccccagccaggagggcgcccccctgcccagcgaggaggccagcgccccagatgccccagatgccctgcctgacagccccaccccagccactggaggagaggtgtctgccatcaagctggccagcgccctgaatggcagcagcagcagccctgaggtggaggcccccagcagtgaagatgaggacacagctgaggccaccagcggcatcttcacagacaccagcagtgatggcctgcaggcccggcggccagatgtggtgcctgccttccgcagcctgcagaagcagtggccccagcgggaggagagcctgccccggctgtgcctgctgctgcggccccggggctag

SEQ ID NO: 143923 - DNA, 3984 bp, Artificial Sequence
  Description of Artificial Sequence: Synthetic coding sequence
tgacaccaggtgaaggtgcagggctgctggggccgctggcgctggcaggagtttgaaaatgcagaaggagatgaatatgctgctgacctggcccagggcagccctgccacagctgcccagaatggaccagatgtgtatgtgctgcccctgacagaggtgtccctgcccatggccaagcagcccggccgctctgtgcagctgctgaagagcacagatgtgggccgccacagcctgctgtacctgaaggagatcggccggggctggtttgggaaggtgttcctgggggaggtgaacagcggcatcagcagcgcccaggtggtggtgaaggagctgcaggccagcgcctctgtgcaggagcagatgcagttcctggaggaggtgcagccctaccgggccctgaagcacagcaacctgctgcagtgcctggcccagtgtgccgaggtgaccccctacctgctggtgatggagttctgccccctgggggacctgaagggctacctgcggagctgccgggtggccgagagcatggccccagaccccaggaccctgcagaggatggcctgtgaggtggcctgtggggtgctgcacctgcacaggaacaactttgtgcacagcgacctggccctgaggaactgcctgctgacagctgacctgactgtgaagatcggggactatggcctggcccactgcaagtaccgggaggactactttgtgacagctgaccagctgtgggtgcccctgcgctggatcgcccctgagctggtggatgaggtgcacagcaacctgctggtggtggaccagaccaagtctggaaatgtgtggagcctgggcgtgaccatctgggagctgtttgagctgggcacccagccctacccccagcacagcgaccagcaggtgctggcctacacagtgcgggagcagcagctgaagctgcccaagccccagctgcagctgaccctgagtgaccgctggtatgaggtgatgcagttctgctggctgcagcctgagcagaggcccacagctgaggaggtgcacctgctgctgagctacctgtgtgccaagggggccacagaagctgaggaggagtttgaaagacgctggaggagcctgcggcctgggggcggcggcgtgggccctggccctggagctgctggccccatgctgggcggcgtggtggagctggccgccgccagcagcttccccctgctggagcagtttgctggagatggcttccacgcagatggagatgatgtgctgactgtgacagagaccagccggggcctgaactttgagtacaagtgggaggccggccgcggggctgaggccttccctgccaccctgagccctggccgcacagcccggctgcaggagctgtgtgccccagatggagcccctcctggggtggtgcctgtgctgagcgcccacagccccagcctgggcagcgagtacttcatccggctggaggaggccgccccagctgctggccatgaccctgactgtgccggctgtgcccccagccccccagccacagctgaccaggatgatgacagtgatggcagcacagctgccagcctggccatggagcccctgctgggccacggcccccctgtggatgtgccctggggccgcggggaccactaccccaggaggagcctggcccgggaccccctgtgccccagccgcagccccagccccagcgctggccccctgagcctggccgagggcggcgcagaagatgctgactggggcgtggccgccttctgcccagccttctttgaggaccccctgggcaccagccccctgggcagcagcggggccccacccctgcccctgaccggggaggatgagctggaggaggtgggcgccaggagagctgcccagaggggccactggaggagcaatgtgtctgccaacaacaacagcggcagccgctgcccagagagctgggaccctgtgtctgctgggggccacgccgagggctgccccagccccaagcagaccccccgggccagccctgagcccggctacccaggagagcccctgctgggcctgcaggccgccagcgcccaggagcccggctgctgccccggcctgccccacctgtgcagcgcccagggcctggccccagccccctgcctggtgacccccagctggacagaaacagccagcagcggcggggaccacccccaggccgagcccaagctggccacagaagctgagggcaccaccggcccccggctgcccctgcccagcgtgcccagccccagccaggagggcgcccccctgcccagcgaggaggccagcgccccagatgccccagatgccctgcctgacagccccaccccagccaccggcggggaggtgtctgccatcaagctggccagcgccctgaatggcagcagcagcagccctgaggtggaggcccccagcagtgaagatgaggacacagctgaggccaccagcggcatcttcacagacaccagcagtgatggcctgcaggcccggcggccagatgtggtgcctgccttccgcagcctgcagaagcaggtgggcaccccagacagcctggacagcctggacatccccagcagcgccagtgatggcggctatgaggtgttcagccccagcgccaccggccccagcggcggccagccccgggccctggacagcggctatgacacagaaaattatgagagccctgagtttgtgctgaaggaggcccaggagggctgtgagccccaggcctttgctgagctggccagcgagggggagggccctggccctgagacccggctgagcaccagcctgagcggcctgaatgagaagaacccctacagagacagcgcctacttcagtgacctggaggccgaggccgaggccaccagcggccctgagaagaagtgtggcggggaccgggcccctggccctgagctgggcctgcccagcacaggccagcccagcgagcaggtgtgcctgcggcctggggtgtctggagaggcccagggcagcggccctggagaggtgctgccccccctgctgcagctggagggcagcagccctgagcccagcacctgccccagcggcctggtgcctgagcccccagagccccagggccctgccaaggtgcggcccggccccagccccagctgcagccagttcttcctgctgacccctgtgcccctgcggtctgagggcaacagcagcgagttccagggccccccaggcctgctgagcggccctgccccccagaagaggatgggcggccctggcaccccccgggcccccctgcggctggccctgcccggcctgcctgctgccctggagggccggcctgaggaggaggaggaggacagtgaagattctgatgaaagtgatgaggagctgcgctgctacagcgtgcaggagcccagcgaggacagcgaggaggaggccccagctgtgcctgtggtggtggccgagagccagagcgccaggaacctgcggagcctgctgaagatgcccagcctgctgtctgagaccttctgtgaggacctggagaggaagaagaaggctgtgtccttctttgatgatgtgacagtgtacctgtttgaccaggagagccccacccgggagctgggggagcccttccctggggccaaggagagcccccccaccttcctgcggggcagccctggcagccccagcgcccccaaccggccccagcaggctgatggcagccccaacggcagcacagctgaggagggcggcggctttgcctgggatgatgacttccccctgatgacagccaaggccgcctttgccatggccctggaccctgctgccccagccccagctgcccccacccccaccccagcccccttcagccgcttcaccgtgtccccagcccccaccagccgcttcagcatcacccacgtgtctgacagtgatgctgagagcaagaggggccctgaggccggggccggcggggagagcaaggaggcctag

SEQ ID NO: 143924 - DNA, 417 bp, Artificial Sequence
  Description of Artificial Sequence: Synthetic coding sequence
atggaggaggaggccgagacagaggagcagcagcgcttctcctaccagcagaggctgaaggctgctgtgcactacacagtgggctgcctgtgtgaggaggtggccctggacaaggagatgcagttcagcaagcagaccatcgccgccatcagcgagctgaccttccggcagtgtgaaaattttgccaaggacctggagatgtttgcccggcatgccaagaggaccaccatcaacacagaagatgtgaagctgctggcccggcgcagcaacagcctgctgaagtacatcacagacaagtctgaggagatcgcccagatcaacctggagaggaaggcccagaagaagaagaagtcagaagatggcagcaagaacagccggcagcctgctgaggccggcgtggtggagagtgaaaattag

SEQ ID NO: 143925 - DNA, 495 bp, Artificial Sequence
  Description of Artificial Sequence: Synthetic coding sequence
atggaggaggaggccgagacagaggagcagcagcgcttctcctaccagcagaggctgaaggctgctgtgcactacacagtgggctgcctgtgtgaggaggtggccctggacaaggagatgcagttcagcaagcagaccatcgccgccatcagcgagctgaccttccggcagtgtgaaaattttgccaaggacctggagatgtttgcccggcatgccaagaggaccaccatcaacacagaagatgtgaagctgctggcccggcgcagcaacagcctgcacatgcaggaggccgccggcatcaggaagagcagcctgctgaccttcctggcctggtggtttgagtggaccagccaggccagcgctggccccctgattggagaggaggcccgggaggtggcccggcggcaggagggcgccccaccccagcagagcgcccggcgggacaggatgccctgcaggaacttcttctggaagaccttcagcagctgcaagtag

SEQ ID NO: 143926 - DNA, 234 bp, Artificial Sequence
  Description of Artificial Sequence: Synthetic coding sequence
atggaggaggaggccgagacagaggagcagcagcgcttctcctaccagcagaggctgaaggctgctgtgcactacacagtgggctgcctgtgtgaggaggtggccctggacaaggagatgcagttcagcaagcagaccatcgccgccatcagcgagctgaccttccggcagtgtgaaaattttgccaaggacctggagatgtttgccagcatctgcaggaagaggcaggagtag

SEQ ID NO: 143927 - DNA, 921 bp, Artificial Sequence
  Description of Artificial Sequence: Synthetic coding sequence
atgagcaatgtgaacctgtctgtgtctgacttctggagggtgatgatgagggtgtgctggctggtgcggcaggacagccgccaccagaggatccggctgccccacctggaggccgtggtgattggccggggccctgagaccaagatcacagacaagaagtgcagccggcagcaggtgcagctgaaggccgagtgcaacaagggctacgtgaaggtgaagcaggtgggcgtgaaccccaccagcattgacagcgtggtgattggcaaggaccaggaggtgaagctgcagcccggccaggtgctgcacatggtgaatgagctgtacccctacatcgtggagtttgaggaggaggccaagaaccctggcctggagacccacaggaagaggaagaggagcggcaacagcgacagcattgaaagagatgctgcccaggaggccgaggccggcaccggcctggagcccggcagcaacagcggccagtgcagcgtgcccctgaagaagggcaaggatgcccccatcaagaaggagagcctgggccactggagccagggcctgaagatctccatgcaggaccccaagatgcaggtgtacaaggatgagcaggtggtggtgatcaaggacaagtaccccaaggcccgctaccactggctggtgctgccctggaccagcatcagcagcctgaaggctgtggcccgggagcacctggagctgctgaagcacatgcacacagtgggggagaaggtgattgtggactttgctggcagcagcaagctgcgcttccggctgggctaccacgccatccccagcatgagccacgtgcacctgcacgtgatcagccaggactttgacagcccctgcctgaagaacaagaagcactggaacagcttcaacacagagtacttcctggagagccaggagtag

SEQ ID NO: 143928 - DNA, 1014 bp, Artificial Sequence
  Description of Artificial Sequence: Synthetic coding sequence
atgagcaatgtgaacctgtctgtgtctgacttctggagggtgatgatgagggtgtgctggctggtgcggcaggacagccgccaccagaggatccggctgccccacctggaggccgtggtgattggccggggccctgagaccaagatcacagacaagaagtgcagccggcagcaggtgcagctgaaggccgagtgcaacaagggctacgtgaaggtgaagcaggtgggcgtgaaccccaccagcattgacagcgtggtgattggcaaggaccaggaggtgaagctgcagcccggccaggtgctgcacatggtgaatgagctgtacccctacatcgtggagtttgaggaggaggccaagaaccctggcctggagacccacaggaagaggaagaggagcggcaacagcgacagcattgaaagagatgctgcccaggaggccgaggccggcaccggcctggagcccggcagcaacagcggccagtgcagcgtgcccctgaagaagggcaaggatgcccccatcaagaagaaggtgtacaaggatgagcaggtggtggtgatcaaggacaagtaccccaaggcccgctaccactggctggtgctgccctggaccagcatcagcagcctgaaggctgtggcccgggagcacctggagctgctgaagcacatgcacacagtgggggagaaggtgattgtggactttgctggcagcagcaagctgcgcttccggctgggctaccacgccatccccagcatgagccacgtgcacctgcacgtgatcagccaggactttgacagcccctgcctgaagaacaagaagcactggaacagcttcaacacagagtacttcctggagagccaggccgtgattgagatggtgcaggaggccggccgggtgacagtgagagatggcatgcctgagctgctgaagctgcccctgcgctgccacgagtgccagcagctgctgcccagcatcccccagctgaaggagcacctgaggaagcactggacccagtag

SEQ ID NO: 143929 - DNA, 1029 bp, Artificial Sequence
  Description of Artificial Sequence: Synthetic coding sequence
atgatgagggtgtgctggctggtgcggcaggacagccgccaccagaggatccggctgccccacctggaggccgtggtgattggccggggccctgagaccaagatcacagacaagaagtgcagccggcagcaggtgcagctgaaggccgagtgcaacaagggctacgtgaaggtgaagcaggtgggcgtgaaccccaccagcattgacagcgtggtgattggcaaggaccaggaggtgaagctgcagcccggccaggtgctgcacatggtgaatgagctgtacccctacatcgtggagtttgaggaggaggccaagaaccctggcctggagacccacaggaagaggaagaggagcggcaacagcgacagcattgaaagagatgctgcccaggaggccgaggccggcaccggcctggagcccggcagcaacagcggccagtgcagcgtgcccctgaagaagggcaaggatgcccccatcaagaaggagagcctgggccactggagccagggcctgaagatctccatgcaggaccccaagatgcaggtgtacaaggatgagcaggtggtggtgatcaaggacaagtaccccaaggcccgctaccactggctggtgctgccctggaccagcatcagcagcctgaaggctgtggcccgggagcacctggagctgctgaagcacatgcacacagtgggggagaaggtgattgtggactttgctggcagcagcaagctgcgcttccggctgggctaccacgccatccccagcatgagccacgtgcacctgcacgtgatcagccaggactttgacagcccctgcctgaagaacaagaagcactggaacagcttcaacacagagtacttcctggagagccaggccgtcatcgagatggtgcaggaggccggccgggtgacagtgagagatggcatgcctgagctgctgaagctgcccctgcgctgccacgagtgccagcagctgctgcccagcatcccccagctgaaggagcacctgaggaagcactggacccagtag

SEQ ID NO: 143930 - DNA, 1071 bp, Artificial Sequence
  Description of Artificial Sequence: Synthetic coding sequence
atgagcaatgtgaacctgtctgtgtctgacttctggagggtgatgatgagggtgtgctggctggtgcggcaggacagccgccaccagaggatccggctgccccacctggaggccgtggtgattggccggggccctgagaccaagatcacagacaagaagtgcagccggcagcaggtgcagctgaaggccgagtgcaacaagggctacgtgaaggtgaagcaggtgggcgtgaaccccaccagcattgacagcgtggtgattggcaaggaccaggaggtgaagctgcagcccggccaggtgctgcacatggtgaatgagctgtacccctacatcgtggagtttgaggaggaggccaagaaccctggcctggagacccacaggaagaggaagaggagcggcaacagcgacagcattgaaagagatgctgcccaggaggccgaggccggcaccggcctggagcccggcagcaacagcggccagtgcagcgtgcccctgaagaagggcaaggatgcccccatcaagaaggagagcctgggccactggagccagggcctgaagatctccatgcaggaccccaagatgcaggtgtacaaggatgagcaggtggtggtgatcaaggacaagtaccccaaggcccgctaccactggctggtgctgccctggaccagcatcagcagcctgaaggctgtggcccgggagcacctggagctgctgaagcacatgcacacagtgggggagaaggtgattgtggactttgctggcagcagcaagctgcgcttccggctgggctaccacgccatccccagcatgagccacgtgcacctgcacgtgatcagccaggactttgacagcccctgcctgaagaacaagaagcactggaacagcttcaacacagagtacttcctggagagccaggccgtcatcgagatggtgcaggaggccggccgggtgacagtgagagatggcatgcctgagctgctgaagctgcccctgcgctgccacgagtgccagcagctgctgcccagcatcccccagctgaaggagcacctgaggaagcactggacccagtag

SEQ ID NO: 143931 - DNA, 921 bp, Artificial Sequence; identical to SEQ ID NO: 143927
  Description of Artificial Sequence: Synthetic coding sequence

SEQ ID NO: 143932 - DNA, 855 bp, Artificial Sequence
  Description of Artificial Sequence: Synthetic coding sequence
atgagcaatgtgaacctgtctgtgtctgacttctggagggtgatgatgagggtgtgctggctggtgcggcaggacagccgccaccagaggatccggctgccccacctggaggccgtggtgattggccggggccctgagaccaagatcacagacaagaagtgcagccggcagcaggtgcagctgaaggccgagtgcaacaagggctacgtgaaggtgaagcaggtgggcgtgaaccccaccagcattgacagcgtggtgattggcaaggaccaggaggtgaagctgcagcccggccaggtgctgcacatggagagcctgggccactggagccagggcctgaagatctccatgcaggaccccaagatgcaggtgtacaaggatgagcaggtggtggtgatcaaggacaagtaccccaaggcccgctaccactggctggtgctgccctggaccagcatcagcagcctgaaggctgtggcccgggagcacctggagctgctgaagcacatgcacacagtgggggagaaggtgattgtggactttgctggcagcagcaagctgcgcttccggctgggctaccacgccatccccagcatgagccacgtgcacctgcacgtgatcagccaggactttgacagcccctgcctgaagaacaagaagcactggaacagcttcaacacagagtacttcctggagagccaggccgtcatcgagatggtgcaggaggccggccgggtgacagtgagagatggcatgcctgagctgctgaagctgcccctgcgctgccacgagtgccagcagctgctgcccagcatcccccagctgaaggagcacctgaggaagcactggacccagtag

SEQ ID NO: 143933 - DNA, 579 bp, Artificial Sequence
  Description of Artificial Sequence: Synthetic coding sequence
atgatgagggtgtgctggctggtgcggcaggacagccgccaccagaggatccggctgccccacctggaggccgtggtgattggccggggccctgagaccaagatcacagacaagaagtgcagccggcagcaggtgcagctgaaggccgagtgcaacaagggctacgtgaaggtgaagcaggtgggcgtgaaccccaccagcattgacagcgtggtgattggcaaggaccaggaggtgaagctgcagcccggccaggtgctgcacatggtgaatgagctgtacccctacatcgtggagtttgaggaggaggccaagaaccctggcctggagacccacaggaagaggaagaggagcggcaacagcgacagcattgaaagagatgctgcccaggaggccgaggccggcaccggcctggagcccggcagcaacagcggccagtgcagcgtgcccctgaagaagggcaaggatgcccccatcaagaaggagagcctgggccactggagccagggcctgaagatctccatgcaggaccccaagatgcagccctgcaccagcagctgtgaccagcccggcttctag

SEQ ID NO: 143934 - DNA, 1029 bp, Artificial Sequence; identical to SEQ ID NO: 143929
  Description of Artificial Sequence: Synthetic coding sequence

SEQ ID NO: 143935 - DNA, 909 bp, Artificial Sequence
  Description of Artificial Sequence: Synthetic coding sequence
atgagcaatgtgaacctgtctgtgtctgacttctggagggtgatgatgagggtgtgctggctggtgcggcaggacagccgccaccagaggatccggctgccccacctggaggccgtggtgattggccggggccctgagaccaagatcacagacaagaagtgcagccggcagcaggagtttgaggaggaggccaagaaccctggcctggagacccacaggaagaggaagaggagcggcaacagcgacagcattgaaagagatgctgcccaggaggccgaggccggcaccggcctggagcccggcagcaacagcggccagtgcagcgtgcccctgaagaagggcaaggatgcccccatcaagaaggagagcctgggccactggagccagggcctgaagatctccatgcaggaccccaagatgcaggtgtacaaggatgagcaggtggtggtgatcaaggacaagtaccccaaggcccgctaccactggctggtgctgccctggaccagcatcagcagcctgaaggctgtggcccgggagcacctggagctgctgaagcacatgcacacagtgggggagaaggtgattgtggactttgctggcagcagcaagctgcgcttccggctgggctaccacgccatccccagcatgagccacgtgcacctgcacgtgatcagccaggactttgacagcccctgcctgaagaacaagaagcactggaacagcttcaacacagagtacttcctggagagccaggccgtcatcgagatggtgcaggaggccggccgggtgacagtgagagatggcatgcctgagctgctgaagctgcccctgcgctgccacgagtgccagcagctgctgcccagcatcccccagctgaaggagcacctgaggaagcactggacccagtag

SEQ ID NO: 143936 - DNA, 1029 bp, Artificial Sequence; identical to SEQ ID NO: 143929
  Description of Artificial Sequence: Synthetic coding sequence

SEQ ID NO: 143937 - DNA, 687 bp, Artificial Sequence
  Description of Artificial Sequence: Synthetic coding sequence
atgtacatcatcgcccagtgtgtgggcgccatcgtggccacagccatcctgagcggcatcaccagcagcctgactggaaacagcctgggcagaaatgacctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggcagcgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgctccttcctgggcaccaagatctaccagttcacccacagcctggaggtggtggaggaggtgaaggagcgggaccccccagccagccggcccagcgagcatgatggccgctgtgccaggaagagccccctggcccccaagctgctgacagacagccctgcccaggtgcccggcatcctgccctag

SEQ ID NO: 143938 - DNA, 810 bp, Artificial Sequence
  Description of Artificial Sequence: Synthetic coding sequence
atggccagcgagttcaagaagaagctgttctggagggctgtggtggccgagttcctggccaccaccctgtttgtgttcatcagcatcggcagcgccctgggcttcaagtaccctgtgggcaacaaccagacagctgtgcaggacaacgtgaaggtgtccctggccttcggcctgagcatcgccaccctggcccagagcgtgggccacatcagcggggcccacctgaacccagctgtgaccctgggcctgctgctgagctgccagatcagcatcttccgggccctgatgtacatcatcgcccagtgtgtgggcgccatcgtggccacagccatcctgagcggcatcaccagcagcctgaccggcaacagcctgggcagaaatgacctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggatctgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 143939 - DNA, 657 bp, Artificial Sequence
  Description of Artificial Sequence: Synthetic coding sequence
atgttctggaccttcggctatgaagctgtgtccccagctggccccagccacctgtttgccagcctgctgctgggcgtgctgctgaccatcaccttcatgcctggggcccggcccctgcccctggtgctggtgccccagaacaccctggcctggatgcagctggatgccaaggccccagcccacccccggcccctgcagctgctgggccgggtgggccctggcagccggcagctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggcagcgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 143940 - DNA, 465 bp, Artificial Sequence
  Description of Artificial Sequence: Synthetic coding sequence
atgcagagcggcatgggctggaatgtgctggacttctggctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggcagcgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 143941 - DNA, 765 bp, Artificial Sequence
  Description of Artificial Sequence: Synthetic coding sequence
atggccagcgagttcaagaagaagctgttctggagggctgtggtggccgagttcctggccaccaccctgtttgtgttcatcagcatcggcagcgccctgggcttcaagtaccctgtgggcaacaaccagacagctgtgcaggacaacgtgaaggtgtccctggccttcggcctgagcatcgccaccctggcccagagcgtgggccacatcagcggggcccacctgaacccagctgtgaccctgggcctgctgctgagctgccagatcagcatcgtggccacagccatcctgagcggcatcaccagcagcctgactggaaacagcctgggcagaaatgacctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggcagcgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 143942 - DNA, 990 bp, Artificial Sequence
  Description of Artificial Sequence: Synthetic coding sequence
atgtgccaggtgggctgcttcctgaagaccccccgcttccccatctgggtggtgtgcagcgagagccacttcagcatcctcttcagcctgcagcccggcctgctgcgggactggaggacagagcggctgtttgacctgtactactatgatggcctggccaaccagcaggagcagatccggctgaccatcgacaccacccagaccatcagcgaggacacagacaatgacctggtgccccccctggagctgtgcatccgcaccaacatcggcagcgccctgggcttcaagtaccctgtgggcaacaaccagacagctgtgcaggacaacgtgaaggtgtccctggccttcggcctgagcatcgccaccctggcccagagcgtgggccacatcagcggggcccacctgaacccagctgtgaccctgggcctgctgctgagctgccagatcagcatcttccgggccctgatgtacatcatcgcccagtgtgtgggcgccatcgtggccacagccatcctgagcggcatcaccagcagcctgaccggcaacagcctgggcagaaatgacctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggatctgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 143943 - DNA, 561 bp, Artificial Sequence
  Description of Artificial Sequence: Synthetic coding sequence
atgcctggggcccggcccctgcccctggtgctggtgccccagaacaccctggcctggatgcagctggatgccaaggccccagcccacccccggcccctgcagctgctgggccgggtgggccctggcagccggcagctggctgatggagtgaacagcggccagggcctgggcatcgagatcatcggcaccctgcagctggtgctgtgtgtgctggccaccacagacagaagaagaagagacctgggcggcagcgcccccctggccatcggcctgtctgtggccctgggccacctgctggccatcgactacacaggctgcggcatcaacccagcccggagctttggcagcgctgtgatcacccacaacttcagcaaccactggatcttctgggtgggccccttcatcggcggggccctggccgtgctgatctatgacttcatcctggcccccaggagcagtgacctgacagacagagtgaaggtgtggaccagcggccaggtggaggagtatgacctggatgctgatgacatcaacagccgggtggagatgaagcccaagtag

SEQ ID NO: 143944 - DNA, 816 bp, Artificial Sequence
  Description of Artificial Sequence: Synthetic coding sequence
atgagccccctgctgggcctgcggtctgagctgcaggacacctgcaccagcctgggcctgatgctgtctgtggtgctgctgatgggcctggcccgggtggtggcccggcagcagctgcacaggcctgtggcccacgcctttgtgctggagttcctggccaccttccagctgtgctgctgcacccatgagctgcagctgctgtctgagcagcacccagcccaccccacctggaccctgaccctggtgtacttcttcagcctggtgcacggcctgaccctggtgggcaccagcagcaacccctgtggggtgatgatgcagatgatgctgggcggcatgagccctgagaccggggctgtgcggctgctggcccagctggtgtctgccctgtgcagccgctactgcaccagcgccctgtggagcctgggcctgacccagtaccacgtgtctgagaggagctttgcctgcaagaaccccatccgggtggacctgctgaaggccgtcatcacagaagctgtgtgcagcttcctgttccacagcgccctgctgcacttccaggaggtgaggaccaagctgcgcatccacctgctggccgccctgatcaccttcctggtgtatgctgggggcagcctgactggagctgtgttcaacccagccctggccctgagcctgcacttcatgtgctttgatgaggccttcccccagttcttcatcgtgtactggctggcccccagcctgggcatcctgctgatgatcctgatgttctccttcttcctgccctggctgcacaacaaccacaccatcaacaagaaggagtag

SEQ ID NO: 143945 - DNA, 888 bp, Artificial Sequence
  Description of Artificial Sequence: Synthetic coding sequence
atggccggcctgaatgtgtccctgtccttcttctttgccacctttgccctgtgtgaggccgcccggcgggccagcaaggccctgctgcctgtgggcgcctatgaggtgtttgcccgggaggccatgaggaccctggtggagctgggcccctgggccggggactttggaccagacctgctgctgaccctgctcttcctgctcttcctggcccatggagtgaccctggatggagccagcgccaaccccaccgtgtccctgcaggagttcctgatggccgagcagagcctgcccggcaccctgctgaagctggccgcccagggcctgggcatgcaggccgcctgcaccctgatgaggctgtgctgggcctgggagctgagtgacctgcacctgctgcagagcctgatggcccagagctgcagcagcgccctgcggacctctgtgccccatggagccctggtggaggccgcctgtgccttctgcttccacctgaccctgctgcacctgcggcacagccccccagcctacagcggccctgctgtggccctgctggtgacagtgacagcctacacagctggccccttcaccagcgccttcttcaacccagccctggccgcctctgtgacctttgcctgcagcggccacaccctgctggagtatgtgcaggtgtactggctgggccccctgaccggcatggtgctggccgtgctgctgcaccagggccgcctgccccacctgttccagaggaacctcttctacggccagaagaacaagtaccgggccccccggggcaagccagccccagccagcggggacacccagaccccagccaagggcagctctgtgcgggagcccggccgctctggagtggagggcccccacagcagctag

SEQ ID NO: 143946 - DNA, 798 bp, Artificial Sequence
  Description of Artificial Sequence: Synthetic coding sequence
aaccagcctgccccagccctgagcccccaggtgtcctgccgccacagcagcagcggcggccctggccgctggcaggagttcctgatggccgagcagagcctgcccggcaccctgctgaagctggccgcccagggcctgggcatgcaggccgcctgcaccctgatgaggctgtgctgggcctgggagctgagtgacctgcacctgctgcagagcctgatggcccagagctgcagcagcgccctgcggacctctgtgccccatggagccctggtggaggccgcctgtgccttctgcttccacctgaccctgctgcacctgcggcacagccccccagcctacagcggccctgctgtggccctgctggtgacagtgacagcctacacagctggccccttcaccagcgccttcttcaacccagccctggccgcctctgtgacctttgcctgcagcggccacaccctgctggagtatgtgcaggtgtactggctgggccccctgacagaggagcagcacggggaggtgatggagccccccctgggccccaggtctggggacagcggcccctggctgcagaggccccgctggagcccccacctgctgctgcacctgctgagtgacacccggctgcacctgacagaggtgcctgagggccagctgggcagctatggcatcctggaggccttcttctccttctgctggctgtacaccggggaggtgtctggggccatgccccagccccccctgggcggcaaggaccgctcctggggcagcctgcggcacctggccctgcgctggtag

SEQ ID NO: 143947 - DNA, 924 bp, Artificial Sequence
  Description of Artificial Sequence: Synthetic coding sequence
atggccggcctgaatgtgtccctgtccttcttctttgccacctttgccctgtgtgaggccgcccggcgggccagcaaggccctgctgcctgtgggcgcctatgaggtgtttgcccgggaggccgtgggcgctgtgcagctgggcccctgctgcctggagatgaggaccctggtggagctgggcccctgggccggggactttggaccagacctgctgctgaccctgctcttcctgctcttcctggcccatggagtgaccctggatggagccagcgccaaccccaccgtgtccctgcaggagttcctgatggccgagcagagcctgcccggcaccctgctgaagctggccgcccagggcctgggcatgcaggccgcctgcaccctgatgaggctgtgctgggcctgggagctgagtgacctgcacctgctgcagagcctgatggcccagagctgcagcagcgccctgcggacctctgtgccccatggagccctggtggaggccgcctgtgccttctgcttccacctgaccctgctgcacctgcggcacagccccccagcctacagcggccctgctgtggccctgctggtgacagtgacagcctacacagctggccccttcaccagcgccttcttcaacccagccctggccgcctctgtgacctttgcctgcagcggccacaccctgctggagtatgtgcaggtgtactggctgggccccctgaccggcatggtgctggccgtgctgctgcaccagggccgcctgccccacctgttccagaggaacctcttctacggccagaagaacaagtaccgggccccccggggcaagccagccccagccagcggggacacccagaccccagccaagggcagctctgtgcgggagcccggccgctctggagtggagggcccccacagcagctag

SEQ ID NO: 143948 - DNA, 816 bp, Artificial Sequence
  Description of Artificial Sequence: Synthetic coding sequence
atgtgggagctgcggagcatcgccttcagcagagctgtgtttgctgagttcctggccaccctgctgtttgtgttcttcggcctgggcagcgccctgaactggccccaggccctgcccagcgtgctgcagatcgccatggccttcggcctgggcatcggcaccctggtgcaggccctgggccacatcagcggggcccacatcaacccagctgtgacagtggcctgcctggtgggctgccacgtgtctgtgctgcgggccgccttctacgtggccgcccagctgctgggcgctgtggccggggccgccctgctgcacgagatcaccccagctgacatccggggggacctggccgtgaatgccctgagcaacagcaccacagctggccaggccgtgacagtggagctgttcctgaccctgcagctggtgctgtgcatctttgccagcacagatgagaggagaggagaaaatcctggcaccccagccctgagcatcggcttctctgtggccctgggccacctgctgggcatccactacacaggctgcagcatgaacccagcccggagcctggccccagctgtggtgacaggcaagtttgatgaccactgggtgttctggattggccccctggtgggcgccatcctgggcagcctgctgtacaactacgtgctcttccccccagccaagagcctgtctgagcggctggccgtgctgaagggcctggagccagacacagactgggaggagcgggaggtgagaagacggcagagcgtggagctgcacagcccccagagcctgccccggggcaccaaggcctag

SEQ ID NO: 143949 - DNA, 879 bp, Artificial Sequence
  Description of Artificial Sequence: Synthetic coding sequence
atgggccggcagaaggagctggtgagccgctgtggggagatgctgcacatccgctaccgcctgctgcggcaggccctggccgagtgcctgggcaccctcatcctggtgatgtttggctgcggctctgtggcccaggtggtgctgagccggggcacccatggaggcttcctgaccatcaacctggcctttggatttgctgtgaccctgggcatcctgattgctggccaggtgtctggggcccacctgaacccagctgtgacctttgccatgtgcttcctggcccgggagccctggatcaagctgcccatctacaccctggcccagaccctgggcgccttcctgggcgccggcatcgtgtttggcctgtactatgatgccatctggcactttgctgacaaccagctgtttgtgtctggccccaatggaacagctggcatctttgccacctaccccagcggccacctggacatgatcaatggcttctttgaccagttcatcggcacagccagcctcatcgtgtgtgtgctggccatcgtggacccctacaacaaccctgtgccccggggcctggaggccttcaccgtgggcctggtggtgctggtgattggcacctccatgggcttcaacagcggctatgctgtgaacccagcccgggactttggccccaggctcttcaccgccctggccggctggggcagcgctgtgttcaccaccggccagcactggtggtgggtgcccatcgtgagccccctgctgggcagcattgctggggtgtttgtgtaccagctgatgattggctgccacctggagcagcccccacccagcaatgaggaggagaatgtgaagctggcccacgtgaagcacaaggagcagatctag

SEQ ID NO: 143950 - DNA, 840 bp, Artificial Sequence
  Description of Artificial Sequence: Synthetic coding sequence
atgggccggcagaaggagctggtgagccgctgtggggagatgctgcacatccgctaccgcctgctgcggcaggccctggccgagtgcctgggcaccctcatcctggtgatgtttggctgcggctctgtggcccaggtggtgctgagccggggcacccatggaggcttcctgaccatcaacctggcctttggatttgctgtgaccctgggcatcctgattgctggccaggtgtctggggcccacctgaacccagctgtgacctttgccatgtgcttcctggcccgggagccctggatcaagctgcccatctacaccctggcccagaccctgggcgccttcctgggcgccggcatcgtgtttggcctgtactatgatgccatctggcactttgctgacaaccagctgtttgtgtctggccccaatggaacagctggcatctttgccacctaccccagcggccacctggacatgatcaatggcttctttgaccaggacaggcctgccctggtggtgggcgcccaccgggtgcccaccccaggcctgcactgcggctgcctgcgggtgcctgcagatgaccggctgcccccaggggccgcccccaccctgcagagaggaagagaatgtgaggccggcccctgtgaggcccagggcgctgacctgagcggccagggcagccccctgcgctgccccggcctggagcaccccctgactgtgcagggccccctgcccaggagccccctgcatgacccccccttccaggccaaggagctgcccatctacccccaccccaccacagcccccagcggcttccccctggacctggcccagatcgccccctag

SEQ ID NO: 143951 - DNA, 972 bp, Artificial Sequence
  Description of Artificial Sequence: Synthetic coding sequence
atgtctgaccggcccacagcccggcgctggggcaaatgtggccccctgtgcacccgggagaacatcatggtggccttcaagggcgtgtggacccaggccttctggaaggctgtgacagctgagttcctggccatgctgatctttgtgctgctgagcctgggcagcaccatcaactggggcggcacagagaagcccctgcctgtggacatggtgctgatcagcctgtgcttcggcctgagcatcgccaccatggtgcagtgcttcggccacatcagcggcggccacatcaacccagctgtgacagtggccatggtgtgcaccaggaagatcagcatcgccaagtctgtgttctacatcgccgcccagtgcctgggcgccatcatcggggccggcatcctgtacctggtgaccccacccagcgtggtgggcggcctgggcgtgaccatggtgcacggcaacctgacagctggccacggcctgctggtggagctgatcatcaccttccagctggtgttcaccatctttgccagctgtgacagcaagaggacagatgtgacaggcagcatcgccctggccatcggcttctctgtggccatcggccacctgtttgccatcaactacaccggggcctccatgaacccagcccggagctttggacctgctgtgatcatgggcaactgggagaaccactggatctactgggtgggccccatcattggagctgtgctggccggcggcctgtatgaatatgtgttctgcccagatgtggagttcaagaggcgcttcaaggaggccttcagcaaggccgcccagcagaccaagggcagctacatggaggtggaggacaacagaagccaggtggagacagatgacctgatcctgaagccaggagtggtgcacgtgattgatgtggacagaggagaggagaagaagggcaaggaccagagcggggaggtgctgagctctgtgtag

SEQ ID NO: 143952 - DNA, 660 bp, Artificial Sequence
  Description of Artificial Sequence: Synthetic coding sequence
tgcaccctggccggggagggcatgtctgaccggcccacagcccggcgctggggcaaatgtggccccctgtgcacccgggagaacatcatggtggccttcaagggcgtgtggacccaggccttctggaaggctgtgacagctgagttcctggccatgctgatctttgtgctgctgagcctgggcagcaccatcaactggggcggcacagagaagcccctgcctgtggacatggtgctgatcagcctgtgcttcggcctgagcatcgccaccatggtgcagtgcttcggccacatcagcggcggccacatcaacccagctgtgacagtggccatggtgtgcaccaggaagatcagcatcgccaagagcgtcttctacatcgccgcccagtgtgtgggccccatcattggagctgtgctggccggcggcctgtatgaatatgtgttctgcccagatgtggagttcaagaggcgcttcaaggaggccttcagcaaggccgcccagcagaccaagggcagctacatggaggtggaggacaacagaagccaggtggagacagatgacctgatcctgaagccaggagtggtgcacgtgattgatgtggacagaggagaggagaagaagggcaaggaccagagcggggaggtgctgagctctgtgtag

SEQ ID NO: 143953 - DNA, 912 bp, Artificial Sequence
  Description of Artificial Sequence: Synthetic coding sequence
atgtctgaccggcccacagcccggcgctggggcaaatgtggccccctgtgcacccgggagaacatcatggtggccttcaagggcgtgtggacccaggccttctggaaggctgtgacagctgagttcctggccatgctgatctttgtgctgctgagcctgggcagcaccatcaactggggcggcacagagaagcccctgcctgtggacatggtgctgatcagcctgtgcttcggcctgagcatcgccaccatggtgtgcaccaggaagatcagcatcgccaagtctgtgttctacatcgccgcccagtgcctgggcgccatcatcggggccggcatcctgtacctggtgaccccacccagcgtggtgggcggcctgggcgtgaccatggtgcacggcaacctgacagctggccacggcctgctggtggagctgatcatcaccttccagctggtgttcaccatctttgccagctgtgacagcaagaggacagatgtgacaggcagcatcgccctggccatcggcttctctgtggccatcggccacctgtttgccatcaactacaccggggcctccatgaacccagcccggagctttggacctgctgtgatcatgggcaactgggagaaccactggatctactgggtgggccccatcattggagctgtgctggccggcggcctgtatgaatatgtgttctgcccagatgtggagttcaagaggcgcttcaaggaggccttcagcaaggccgcccagcagaccaagggcagctacatggaggtggaggacaacagaagccaggtggagacagatgacctgatcctgaagccaggagtggtgcacgtgattgatgtggacagaggagaggagaagaagggcaaggaccagagcggggaggtgctgagctctgtgtag

SEQ ID NO: 143954 - DNA, 849 bp, Artificial Sequence
  Description of Artificial Sequence: Synthetic coding sequence
atggatgctgtggagcccggcggccggggctgggcctccatgctggcctgccgcctgtggaaggccatcagccgggccctgtttgctgagttcctggccaccggcctgtatgtgttcttcggcgtgggctctgtgatgcgctggcccacagccctgcccagcgtgctgcagatcgccatcaccttcaacctggtgacagccatggctgtgcaggtgacctggaaggccagcggggcccacgccaacccagctgtgaccctggccttcctggtgggcagccacatcagcctgcccagggctgtggcctacgtggccgcccagctggtgggcgccaccgtgggcgccgccctgctgtatggagtgatgcctggggacatccgggagaccctgggcatcaacgtggtgaggaacagcgtgtccacaggccaggccgtggccgtggagctgctgctgaccctgcagctggtgctgtgtgtgtttgccagcacagacagccggcagaccagcggcagccctgccaccatgattggcatctctgtggccctgggccacctgattggcatccacttcaccggctgcagcatgaacccagcccggagctttggacctgccatcatcatcggcaagttcaccgtgcactgggtgttctgggtgggccccctgatgggcgccctgctggccagcctcatctacaactttgtgctcttcccagacaccaagaccctggcccagaggctggccatcctgaccggcaccgtggaggtgggcactggagctggagctggagctgagcccctgaagaaggagagccagcccggcagcggggctgtggagatggagagcgtgtag

SEQ ID NO: 143955 - DNA, 1029 bp, Artificial Sequence
  Description of Artificial Sequence: Synthetic coding sequence
atggtgcaggccagcggccaccggcgcagcacccggggcagcaagatggtgtcctggagcgtcatcgccaagatccaggagatcctgcagaggaagatggtgcgggagttcctggccgagttcatgagcacctacgtgatgatggtgtttggcctgggctctgtggcccacatggtgctgaacaagaagtatggcagctacctgggcgtgaacctgggcttcggcttcggcgtgaccatgggcgtgcacgtggccggccgcatcagcggggcccacatgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgactggacctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcctggaacagaggccctggtgattggcatcctggtggtgatcattggagtgtccctgggcatgaacacaggctacgccatcaaccccagccgggacctgcccccacgcatcttcaccttcatcgccggctggggcaagcaggtgttcagcaatggagagaactggtggtgggtgcctgtggtggcccccctgctgggcgcctacctgggcggcatcatctacctggtgttcatcggcagcaccatcccccgggagcccctgaagctggaggacagcgtggcctatgaggaccacggcatcaccgtgctgcccaagatgggcagccatgagcccaccatcagccccctgacccctgtgtctgtgtccccagccaacagaagctctgtgcacccagccccacccctgcacgagagcatggccctggagcacttctag

SEQ ID NO: 143956 - DNA, 651 bp, Artificial Sequence
  Description of Artificial Sequence: Synthetic coding sequence
atggtgctgaacaagaagtatggcagctacctgggcgtgaacctgggctttggatttggagtgaccatgggcgtgcacgtggccggccgcatcagcggggcccacatgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgacaggccctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcccggcacagaggccctggtgattggcatcctggtggtgatcatcggcgtgtccctgggcatgaacacaggctacgccatcaaccccagccgggacctgcccccacgcatcttcaccttcatcgccggctggggcaagcaggtgttccgctggcaccacctgcccggcctgcactggctgcaccaccccactggagcccctgagatcggcggcttctgtggggtgtag

SEQ ID NO: 143957 - DNA, 582 bp, Artificial Sequence
  Description of Artificial Sequence: Synthetic coding sequence
atgggctgggccaccttcacagaccagggcgaggagggcctggagcccagcggcccctggaagaccagccacacccgggcccacatgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgactggacctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcctggaacagaggccctggtgattggcatcctggtggtgatcattggagtgtccctgggcatgaacacaggctacgccatcaaccccagccgggacctgcccccacgcatcttcaccttcatcgccggctggggcaagcaggtgttccgctactgcccctgccccggccccttcctgtag

SEQ ID NO: 143958 - DNA, 771 bp, Artificial Sequence
  Description of Artificial Sequence: Synthetic coding sequence
atgggcagcggccactgcctgcggagcacccggggcagcaagatggtgtcctggagcgtgattgccaagatccaggagatcctgcagaggaagatggtgcgggagttcctggccgagttcatgagcacctacgtgatgatggtgtttggcctgggctctgtggcccacatggtgctgaacaagaagtatggcagctacctgggcgtgaacctgggctttggatttggagtgaccatgggcgtgcacgtggccggccgcatcagcggggcccacatgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgacaggccctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcccggcacagaggccctggtgattggcatcctggtggtgatcatcggcgtgtccctgggcatgaacacaggctacgccatcaaccccagccgggacctgcccccacgcatcttcaccttcatcgccggctggggcaagcaggtgttccgctactgcccctgccccggccccttcctgtag

SEQ ID NO: 143959 - DNA, 1026 bp, Artificial Sequence
  Description of Artificial Sequence: Synthetic coding sequence
atgggcagcggccactgcctgcggagcacccggggcagcaagatggtgtcctggagcgtgattgccaagatccaggagatcctgcagaggaagatggtgcgggagttcctggccgagttcatgagcacctacgtgatgatggtgtttggcctgggctctgtggcccacatggtgctgaacaagaagtatggcagctacctgggcgtgaacctgggctttggatttggagtgaccatgggcgtgcacgtggccggccgcatcagcggggcccacatgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgacaggccctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcccggcacagaggccctggtgattggcatcctggtggtgatcatcggcgtgtccctgggcatgaacacaggctacgccatcaaccccagccgggacctgcccccacgcatcttcaccttcatcgccggctggggcaagcaggtgttcagcaatggagagaactggtggtgggtgcctgtggtggcccccctgctgggcgcctacctgggcggcatcatctacctggtgttcatcggcagcaccatcccccgggagcccctgaagctggaggacagcgtggcctatgaagatcatggcatcaccgtgctgcccaagatgggcagccatgagcccaccatcagccccctgacccctgtgtctgtgtccccagccaacagaagctctgtgcacccagccccacccctgcacgagagcatggccctggagcacttctag

SEQ ID NO: 143960 - DNA, 513 bp, Artificial Sequence
  Description of Artificial Sequence: Synthetic coding sequence
atgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgactggacctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcctggaacagaggccctggtgattggcatcctggtggtgatcattggagtgtccctgggcatgaacacaggctacgccatcaaccccagccgggacctgcccccacgcatcttcaccttcatcgccggctggggcaagcaggtgttcagcaatggagagaactggtggtgggtgcctgtggtggcccccctgtag

SEQ ID NO: 143961 - DNA, 426 bp, Artificial Sequence
  Description of Artificial Sequence: Synthetic coding sequence
ctcttctacacagccatcctgcacttcagcggcggccagctgatggtgactggacctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcctggaacagaggccctggtgattggcatcctggtggtgatcattggagtgtccctgggcatgaacacaggctacgccatcaaccccagccgggacctgcccccacgcatcttcaccttcatcgccggctggggcaagcaggtgttccgctggcaccacctgcccggcctgcactggctgcaccaccccaccggggcccctgagattggaggcttctgtggggtgtag

SEQ ID NO: 143962 - DNA, 498 bp, Artificial Sequence
  Description of Artificial Sequence: Synthetic coding sequence
atgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgactggacctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcctggaacagaggccctggtgattggcatcctggtggtgatcattggagtgtccctgggcatgaacacaggctacgccatcaaccccagccgggacctgcccccacgcatcttcaccttcatcgccggctggggcaagcaggtgttccgctactgcccctgccccggccccttcctgtag

SEQ ID NO: 143963 - DNA, 774 bp, Artificial Sequence
  Description of Artificial Sequence: Synthetic coding sequence
atggtgcaggccagcggccaccggcgcagcacccggggcagcaagatggtgtcctggagcgtcatcgccaagatccaggagatcctgcagaggaagatggtgcgggagttcctggccgagttcatgagcacctacgtgatgatggtgtttggcctgggctctgtggcccacatggtgctgaacaagaagtatggcagctacctgggcgtgaacctgggcttcggcttcggcgtgaccatgggcgtgcacgtggccggccgcatcagcggggcccacatgaatgctgctgtgacctttgccaactgtgccctgggccgggtgccctggaggaagtttcctgtgtatgtgctgggccagttcctgggcagcttcctggccgccgccaccatctacagcctcttctacacagccatcctgcacttcagcggcggccagctgatggtgactggacctgtggccacagctggcatctttgccacctacctgcctgaccacatgaccctgtggaggggcttcctgaatgaggcctggctgaccggcatgctgcagctgtgcctgtttgccatcacagaccaggagaacaacccagccctgcctggaacagaggccctggtgattggcatcctggtggtgatcattggagtgtccctgggcatgaacacaggctacgccatcaaccccagccgggacctgcccccacgcatcttcaccttcatcgccggctggggcaagcaggtgttccgctactgcccctgccccggccccttcctgtag

SEQ ID NO: 143964 - DNA, 426 bp, Artificial Sequence
  Description of Artificial Sequence: Synthetic coding sequence
atgaatgctgctgtgacctttgccaactgtgccctgggccgggtgccctggaggaagtttcctgtgtatgtgctgggccagttcctgggcagcttcctggccgccgccaccatctacagcctcttctacagcgtggccgacagagatgccccagctgtgtccctgcggcaccacggccctggagagcagcccagcacagccaggaacagaggagctggggacagacacccccggggccaccacagaggagtgccctggcatgagcaccgcatctgccaccagcctgtgcccggccctgccccaccccacctgcacctgcactgctggctgggccagacaggcctgcaggtgctgcccctgccccggcccatccccctgtccttctctgtgggccccctgtgtgtggagggctggggcgtgatgtag

SEQ ID NO: 143965 - DNA, 1602 bp, Artificial Sequence
  Description of Artificial Sequence: Synthetic coding sequence
atgggcagccgctgcctgaaccccccacctccagcccacagcgacaccaccgggaaggacagctttggaaacatcagaggagctgagaccggccagggcgccagcgcctgcagcgtgaccagcgcccgggtgacctgtggggccggcagcgagccccacagccacaggaaccctggcatcagcgcccaggtgggcctggcccccagctatggagctgcccggggcagaagaagacccctggccctgcagcagagcccccaggagaggagacatgtgggctggaacagcacccggggcctgctgcctgccagcctgcccggcacagccagcagccagagcgccagcgccacagccagcgctgccctgcccctgaaggtgacaggccccctggccaggaaccccaccccaccctggacagctgctgctgccctggccacccggggccagaggcctgagaagggcctcttccctggccctgcccccttcagcctgggcaagaggaagaggggccggggccgcacctgggagaggagaagaagagtgtccattgagaccagcacctgcttccggcccggctgtgagcggctgggcgctgctgctggggccaacctgagccagctggccagcagccagaggcccctgcgggagcgctgggtgctgtacaccatcatcatggctgctgctggggccccagatggcatggaggagcccggcatggacacagaagctgagaccgtggccacagaggccccagcccggcctgtgaactgcctggaggccgaggccgccgccggggctgctgctgaagattctggagctgcccggggcagcctgcagcctgccccagcccagcccccaggggaccctgctgcccaggcctctgtgtccaatggagaagatgctgggggcggggccggccgggagctggtggacctgaagatcatctggaacaagaccaagcatgatgtgaagttccccctggacagcacaggcagcgagctgaagcagaagatccacagcatcaccggcctgcccccagccatgcagaaggtgatgtacaagggcctggtgcctgaggacaagaccctgcgggagatcaaggtgaccagcggggccaagatcatggtggtgggcagcaccatcaatgatgtgctggccgtgaacacccccaaggatgctgcccagcaggatgccaaggccgaggagaacaagaaggagcccctgtgccggcagaagcagcacaggaaggtgctggacaagggcaagccagaagatgtgatgcccagcgtgaagggggcccaggagcggctgcccaccgtgcccctgagcggcatgtacaacaagagcggcggcaaggtgcggctgaccttcaagctggagcaggaccagctgtggattggcaccaaggagaggacagagaagctgcccatgggcagcatcaagaatgtggtgtctgagcccatcgagggccacgaggactaccacatgatggccttccagctgggccccacagaggccagctactactgggtgtactgggtgcccacccagtatgtggatgccatcaaggacacagtgctgggcaagtggcagtacttctag

SEQ ID NO: 143966 - DNA, 9198 bp, Artificial Sequence
  Description of Artificial Sequence: Synthetic coding sequence
atggaggagaagcagcagatcatcctggccaaccaggacggcggcaccgtggccggggccgcccccaccttctttgtgatcctgaagcagcctggaaatggcaagacagaccagggcatcctggtgaccaaccaggatgcctgtgccctggccagctctgtgagcagccctgtgaagagcaagggcaagatctgcctgcctgctgactgcaccgtgggcggcatcaccgtgaccctggacaacaacagcatgtggaatgagttctaccacaggagcacagagatgatcctgaccaagcagggccgcaggatgttcccctactgccgctactggatcaccggcctggacagcaacctgaagtacatcctggtgatggacatcagccctgtggacaaccaccgctacaagtggaatggccgctggtgggagcccagcggcaaggccgagccccacgtgctgggccgggtcttcatccaccctgagagccccagcacaggccactactggatgcaccagcctgtgtccttctacaagctgaagctgaccaacaacaccctggaccaggagggccacatcatcctgcacagcatgcaccgctacctgccccggctgcacctggtgcctgctgagaaggctgtggaggtgatccagctgaatggacctggggtgcacaccttcaccttcccccagacagagttctttgctgtgacagcctaccagaacatccagatcacccagctgaagattgactacaacccctttgccaagggcttcagagatgatggcctgaacaacaagccccagagagatggcaagcagaagaacagcagtgaccaggagggcaacaacatcagcagcagcagcggccaccgggtgcggctgacagagggccagggcagcgagatccagcccggggacctggaccccctgagccggggccacgagaccagcggcaagggcctggagaagaccagcctgaacatcaagagggacttcctgggcttcatggacacagacagcgccctgtctgaggtgccccagctgaagcaggagatcagcgagtgcctgattgccagcagctttgaagatgacagccgggtggccagccccctggaccagaatggcagcttcaacgtggtgatcaaggaggagcccctggatgattatgactatgagctgggagaatgtcctgagggcgtgacagtgaagcaggaggagacagatgaggagacagatgtgtacagcaacagtgatgatgaccccatcctggagaagcagctgaagaggcacaacaaggtggacaaccctgaggccgaccacctgagcagcaagtggctgcccagcagccccagcggcgtggccaaggccaagatgttcaagctggacaccgggaagatgcctgtggtgtacctggagccctgtgctgtgaccaggagcacagtgaagatcagcgagctgcctgacaacatgctgagcaccagcaggaaggacaagagctccatgctggccgagctggagtacctgcccacctacatcgagaacagcaatgaaacagccttctgcctgggcaaggagagtgaaaatggcctgaggaagcacagcccagacctgcgggtggtgcagaagtaccccctgctgaaggagccccagtggaagtacccagacatcagtgacagcatcagcacagagcgcatcctggatgacagcaaggacagcgtgggggacagcctgagcggcaaggaggacctgggcaggaagaggaccaccatgctgaagatcgccacagctgccaaggtggtgaatgccaaccagaatgccagccccaacgtgcctgggaagaggggccggcccaggaagctgaagctgtgcaaggccggccggccccccaagaacacaggcaagagcctcatcagcaccaagaacacccctgtgtccccaggcagcaccttcccagatgtgaagccagacctggaggatgtggatggagtgctgtttgtgtcctttgagagcaaggaggccctggacatccatgctgtggatggcaccacagaggagagcagcagcctgcaggccagcaccaccaatgattctggctaccgggcccgcatcagccagctggagaaggagctgattgaggacctgaagaccctgcggcacaagcaggtgatccaccctggcctgcaggaggtgggcctgaagctgaacagcgtggaccccaccatgagcattgacctgaagtacctgggcgtgcagctgcccctggccccagccaccagcttccccttctggaacctgaccggcaccaacccagccagcccagatgctggcttcccctttgtgtccaggacaggcaagaccaatgacttcaccaagatcaagggctggaggggcaagttccacagcgccagcgccagcagaaatgaaggaggcaacagcgagagcagcctgaagaacagaagtgccttctgcagcgacaagctggatgagtacctggagaatgaaggcaagctgatggagacctccatgggcttcagcagcaatgcccccaccagccctgtggtgtaccagctgcccaccaagagcaccagctatgtgaggaccctggacagcgtgctgaagaagcagagcaccatcagccccagcaccagctacagcctgaagccccacagcgtgccccctgtgtccaggaaggccaagagccagaaccggcaggccaccttcagcggccgcaccaagagcagctacaagagcatcctgccctaccctgtgagccccaagcagaagtacagccacgtgatcctgggggacaaggtgaccaagaacagcagcggcatcatcagcgagaaccaggccaacaactttgtggtgcccaccctggatgagaacatcttccccaagcagatcagcctgcggcaggcccagcagcagcagcagcagcagcagggcagcaggcctcctggcctgagcaagagccaggtgaagctgatggacctggaggactgtgccctgtgggagggcaagcccaggacctacatcacagaggagcgggcagatgtgtccctgaccaccctgctgacagcccaggccagcctgaagaccaagcccatccacaccatcatcaggaagagggccccaccctgcaacaatgacttctgccgcctgggctgtgtgtgcagcagcctggccctggagaagaggcagcctgcccactgccggcggccagactgcatgtttggctgcacctgcctgaagaggaaggtggtgctggtgaagggcggcagcaagaccaagcacttccagaggaaggccgcccaccgggaccccgtcttctatgacaccctgggggaggaggcccgggaggaggaggagggcatccgggaggaggaggagcagctgaaggagaagaagaagaggaagaagctggagtacaccatctgtgaaacagagcctgagcagcctgtgcgccactaccccctgtgggtgaaggtggagggggaggtggaccctgagcctgtgtacatccccacccccagcgtcatcgagcccatgaagcccctgctgctgccccagcctgaggtgctgagccccaccgtgaagggcaagctgctgaccggcatcaagagccccaggagctacacccccaagcccaaccctgtgatccgggaggaggacaaggaccctgtgtacctgtactttgagagcatgatgacctgtgcccgggtgcgggtgtatgaaaggaagaaggaggaccagaggcagcccagcagcagcagcagccccagccccagcttccagcagcagaccagctgccacagcagccctgagaaccacaacaatgccaaggagccagattctgagcagcagcccctgaagcagctgacctgtgacctggaggatgacagcgacaagctgcaggagaagtcctggaagagcagctgcaatgaaggagagagcagcagcaccagctacatgcaccagaggagccctgggggccccaccaagctgattgagatcatcagtgactgcaactgggaggaggacaggaacaagatcctgagcatcctgagccagcacatcaacagcaacatgccccagagcctgaaggtgggcagcttcatcatcgagctggccagccagaggaagagcagaggagagaagaacccccctgtgtacagcagccgggtgaagatctccatgcccagctgccaggaccaggatgacatggccgagaagagcggcagcgagaccccagatggccccctgagccctgggaagatggaggacatcagccctgtgcagacagatgccctggacagcgtgcgggagcggctgcatggaggcaagggcctgcccttctacgccggcctgagccctgctgggaagctggtggcctacaagaggaagcccagcagcagcaccagcggcctcatccaggtggccagcaatgccaaggtggccgccagcaggaagcccaggaccctgctgcccagcaccagcaacagcaagatggccagcagcagcggcacagccaccaacagacctgggaagaacctgaaggcctttgtgcctgccaagaggcccatcgccgcccggcccagccctgggggcgtcttcacccagtttgtgatgagcaaggtgggcgccctgcagcagaagatccctggggtgtccaccccccagaccctggccggcacccagaagttcagcatccggcccagccctgtgatggtggtgacccctgtggtgagcagcgagcctgtgcaggtgtgcagccctgtgacagctgctgtgaccaccaccaccccccaggtgttcctggagaacaccacagctgtgacccccatgacagccatcagtgatgtggagaccaaggagaccacctacagcagcggggccaccaccactggagtggtggaggtgtctgagaccaacaccagcacctctgtgaccagcacccagagcacagccaccgtgaacctgaccaagaccaccggcatcaccacccctgtggcctctgtggccttccccaagagcctggtggccagccccagcaccatcaccctgcctgtggccagcacagccagcaccagcctggtggtggtgacagctgctgccagcagctccatggtgaccacccccaccagcagcctgggctctgtgcccatcatcctgagcggcatcaatggcagcccccctgtgtcccagaggccagaaaatgctgcccagatccctgtggccaccccccaggtgagccccaacacagtgaagagagctggcccccggctgctgctgatccctgtgcagcagggcagccccaccctgcggcctgtgagcaacacccagctgcagggccacaggatggtgctgcagcctgtgcgcagccccagcggcatgaacctcttccgccaccccaacggccagatcgtgcagctgctgcccctgcaccagctgcggggcagcaacacccagcccaacctgcagcctgtgatgttcaggaaccctggctctgtgatgggcatccggctgcctgcccccagcaagcccagcgagaccccacccagcagcaccagcagcagcgccttctctgtgatgaaccctgtgatccaggccgtgggcagcagcagcgctgtgaatgtcatcacccaggcccccagcctgctgagcagcggggccagctttgtgtcccaggccggcaccctgaccctgcgcatcagccccccagagccccagagctttgccagcaagacaggcagcgagaccaagatcacctacagcagcggcggccagcctgtgggcacagccagcctcatccccctgcagagcggcagctttgccctgctgcagctgcccggccagaagcctgtgcccagcagcatcctgcagcacgtggccagcctgcagatgaagcgggagagccagaacccagaccagaaggatgagaccaacagcatcaagcgggagcaggagaccaagaaggtgctgcagagcgagggggaggccgtggaccctgaggccaacgtcatcaagcagaacagcggggccgccaccagcgaggagaccctgaatgacagcctggaggacagaggagaccacctggatgaagaatgtctgcctgaggagggctgtgccaccgtgaagcccagcgagcacagctgcatcaccggcagccacacagaccaggactacaaggatgtgaatgaggagtatggagccaggaacaggaagagcagcaaggagaaggtggccgtgctggaggtgaggaccatcagcgagaaggccagcaacaagacagtgcagaacctgagcaaggtgcagcaccagaagctgggagatgtgaaggtggagcagcagaagggctttgacaaccctgaggagaacagcagcgagttccctgtgaccttcaaggaggagagcaagtttgagctgagcggcagcaaggtgatggagcagcagagcaacctgcagcctgaggccaaggagaaggaatgtggggacagcctggagaaggaccgggagcgctggaggaagcacctgaagggccccctgaccaggaaatgtgtgggcgccagccaggagtgcaagaaggaggctgatgagcagctgatcaaggagaccaagacctgccaggagaacagtgatgtgttccagcaggagcagggcatcagtgacctgctgggcaagagcggcatcacagaagatgcccgggtgctgaagacagaatgtgacagctggagccgcatcagcaaccccagcgccttcagcatcgtgccccggcgggccgccaagagcagcagaggaaatggccacttccagggccacctgctgctgcctggagagcagatccagcccaagcaggagaagaagggcggccgcagcagcgctgacttcaccgtgctggacctggaggaggatgatgaagatgacaatgagaagacagatgacagcattgatgaaattgtggatgtggtgtctgactaccagagcgaggaggtggatgatgtggagaagaacaactgtgtggagtacattgaagatgatgaggagcacgtggacatcgagaccgtggaggagctgtctgaggagatcaacgtggcccacctgaagaccacagctgcccacacccagagcttcaagcagcccagctgcacccacatctctgcagatgagaaggctgctgagaggagcaggaaggccccacccatccccctgaagctgaagccagactactggagcgacaagctgcagaaggaggccgaggcctttgcctactacagaaggacccacacagccaatgaaagaagaagaagaggagagatgagggacctgtttgagaagctgaagatcaccctgggcctgctgcacagcagcaaggtgtccaagagcctcatcctgacccgggccttcagcgagatccagggcctgacagaccaggccgacaagctgattggccagaagaacctgctgaccaggaagaggaacatcctgatcaggaaggtgagcagcctgagcggcaagacagaggaggtggtgctgaagaagctggagtacatctatgccaagcagcaggccctggaggcccagaagaggaagaagaagatgggcagtgatgaatttgacatcagcccccgcatcagcaagcagcaggagggcagcagcgccagctctgtggacctgggccagatgttcatcaacaacagaagaggcaagcccctcatcctgagcaggaagaaggaccaggccacagagaacaccagccccctgaacaccccccacaccagcgccaacctggtgatgaccccccagggccagctgctgaccctgaagggccccctcttcagcggccctgtggtggccgtgtccccagacctgctggagagtgacctgaagccccaggtggccggcagcgctgtggccctgcctgaaaatgatgacctcttcatgatgcccagaattgtgaatgtgaccagcctggccacagaaggaggcctggtggacatgggcggcagcaagtacccccatgaggtgcctgacagcaagcccagcgaccacctgaaggacacagtgagaaatgaagacaacagcctggaggacaagggccgcatcagcagccggggcaacagagatggccgggtgaccctgggccccacccaggtgttcctggccaacaaggacagcggctacccccagatcgtggatgtgagcaacatgcagaaggcccaggagttcctgcccaagaagatcagcggggacatgaggggcatccagtacaagtggaaggagagcgagagcagaggagagcgggtgaagagcaaggacagcagcttccacaagctgaagatgaaggacctgaaggacagcagcattgagatggagctgaggaaggtgaccagcgccatcgaggaggccgccctggacagcagcgagctgctgaccaacatggaggatgaagatgacacagatgagaccctgaccagcctgctgaatgagatcgccttcctgaaccagcagctgaatgatgattctgtgggcctggccgagctgcccagctccatggacacagagttccctggagatgcccggcgggccttcatcagcaaggtgcccccaggcagccgggccaccttccaggtggagcacctgggcaccggcctgaaggagctgcctgatgtgcagggcgagagtgacagcatcagccccctgctgctgcacctggaggatgatgacttctctgaaaatgagaagcagctggccgagcccgccagcgagccagatgtgctgaagatcgtcatcgacagcgagatcaaggacagcctgctgagcaacaagaaggccattgatggcggcaagaacaccagcggcctgcctgctgagcctgagagcgtgagcagcccccccaccctgcacatgaagacaggcctggagaacagcaacagcacagacaccctgtggaggcccatgcccaagctggcccccctgggcctgaaggtggccaaccccagcagtgatgctgatggccagagcctgaaggtgatgccctgcctggcccccatcgccgccaaggtgggctctgtgggccacaagatgaacctgactggaaatgaccaggagggccgggagagcaaggtgatgcccaccctggcccctgtggtggccaagctgggcaacagcggggccagccccagcagcgctgggaagtag

SEQ ID NO: 143967 - DNA, 888 bp, Artificial Sequence
  Description of Artificial Sequence: Synthetic coding sequence
atgcagcctgagggcgctgagaagggcaagagcttcaagcagaggctggtgctgaagagcagcctggccaaggagaccctgtctgagttcctgggcaccttcatcctgattgtgctgggctgcggctgtgtggcccaggccatcctgagccggggccgctttggaggagtcatcaccatcaacgtgggcttctccatggctgtggccatggccatctacgtggccggcggcgtgtctgggggccacatcaacccagctgtgtccctggccatgtgcctgtttggccgcatgaagtggttcaagctgcccttctacgtgggcgcccagttcctgggcgcctttgtgggcgccgccaccgtgtttggcatctactatgatggcctgatgagctttgctgggggcaagctgctgattgtgggagaaaatgccacagcccacatctttgccacctacccagccccctacctgagcctggccaatgcctttgctgaccaggtggtggccaccatgatcctgctgatcatcgtgtttgccatctttgacagcaggaacctgggcgccccccggggcctggagcccatcgccatcggcctgctgatcatcgtgattgccagcagcctgggcctgaacagcggctgtgccatgaacccagcccgggacctgagccccaggctcttcaccgccctggccggctggggctttgaggtgttccgggccggcaacaacttctggtggatccctgtggtgggccccctggtgggcgctgtgattggaggcctcatctacgtgctggtgattgagatccaccaccctgagccagattctgtgttcaagacagagcagagcgaggacaagccagagaagtatgagctgagcgtcatcatgtag

SEQ ID NO: 143968 - DNA, 1992 bp, Artificial Sequence
  Description of Artificial Sequence: Synthetic coding sequence
atgggccgctaccgcatccgggtggccaccggggcctggctgttcagcggcagctacaacagagtgcagctgtggctggtgggcaccagaggagaggccgagctggagctgcagctgcggcctgcccggggggaggaggaggagtttgaccatgatgtggccgaggacctgggcctgctgcagtttgtgcggctgaggaagcaccactggctggtggatgatgcctggttctgtgaccgcatcaccgtgcagggccctggggcctgtgccgaggtggccttcccctgctaccgctgggtgcagggcgaggacatcctgagcctgcctgagggcacagcccggctgcccggggacaatgccctggacatgttccagaagcaccgggagaaggagctgaaggaccggcagcagatctactgctgggccacctggaaggagggcctgcccctgaccatcgctgctgacaggaaggatgacctgccccccaacatgaggttccacgaggagaagaggctggactttgagtggaccctgaaggccggggccctggagatggccctgaagagggtgtacaccctgctgagctcctggaactgcctggaggactttgaccagatcttctggggccagaagagcgccctggccgagaaggtgcggcagtgctggcaggatgatgagctgttctcctaccagttcctgaatggagccaaccccatgctgctgcggcgcagcaccagcctgcccagccggctggtgctgcccagcggcatggaggagctgcaggcccagctggagaaggagctgcagaatggcagcctgtttgaggccgacttcatcctgctggatggcatcccagccaacgtcatccggggggagaagcagtacctggccgcccccctggtgatgctgaagatggagcccaacgggaagctgcagcccatggtgatccagatccagccccccaaccccagcagccccacccccaccctcttcctgcccagcgacccccccctggcctggctgctggccaagtcctgggtgaggaacagcgacttccagctgcacgagatccagtaccacctgctgaacacccacctggtggccgaggtgattgctgtggccaccatgcgctgcctgcccggcctgcaccccatcttcaagttcctgatcccccacatccgctacaccatggagatcaacacccgggcccggacccagctgatcagtgatggcggcatctttgacaaggctgtgtccactggaggcggcggccacgtgcagctgctgcggcgggctgctgcccagctgacctactgcagcctgtgccccccagatgacctggccgaccggggcctgctgggcctgcccggggccctgtatgcccatgatgccctgcggctgtgggagatcatcgcccgctacgtggagggcatcgtgcacctgttctaccagagagatgacatcgtgaagggggaccctgagctgcaggcctggtgccgggagatcacagaggtgggcctgtgccaggcccaggaccggggcttccctgtgtccttccagagccagagccagctgtgccacttcctgaccatgtgtgtgttcacctgcacagcccagcacgccgccatcaaccagggccagctggactggtacgcctgggtgcccaatgccccctgcaccatgaggatgcccccacccaccaccaaggaggatgtgaccatggccaccgtgatgggcagcctgcctgatgtgcggcaggcctgcctgcagatggccatctcctggcacctgagccggcggcagcctgacatggtgcccctgggccaccacaaggagaagtacttcagcggccccaagcccaaggctgtgctgaaccagttcagaacagacctggagaagctggagaaggagatcacagccagaaatgagcagctggactggccctatgagtacctgaagcccagctgcatcgagaacagcgtgaccatctag

SEQ ID NO: 143969 - DNA, 2106 bp, Artificial Sequence
  Description of Artificial Sequence: Synthetic coding sequence
atggccacctacaaggtgcgggtggccaccggcacagacctgctgagcggcacccgggacagcatcagcctgaccatcgtgggcacccagggcgagagccacaagcagctgctgaaccacttcggccgggactttgccactggagctgtgggccagtacacagtgcagtgcccccaggacctgggggagctgatcatcatccggctgcacaaggagagatatgccttcttccccaaggacccctggtactgcaactacgtgcagatctgtgccccaaatggccgcatctaccacttccctgcctaccagtggatggatggctatgagaccctggccctgcgggaggccaccgggaagaccacagcagatgacagcctgcctgtgctgctggagcacaggaaggaggagatccgggccaagcaggacttctaccactggagggtcttcctgcccggcctgcccagctatgtgcacatccccagctaccggccccctgtgagaagacacaggaaccccaacagacctgagtggaatggctacatccctggcttccccatcctgatcaacttcaaggccaccaagttcctgaacctgaacctgcgctacagcttcctgaagacagccagcttctttgtgcggctgggccccatggccctggccttcaaggtgcggggcctgctggactgcaagcacagctggaagaggctgaaggacatcaggaagatcttccctgggaagaagtctgtggtgtctgaatatgtggccgagcactgggccgaggacaccttcttcggctaccagtacctgaatggagtgaaccctggcctcatccgccgctgcacccgcatcccagacaagtttcctgtgacagatgacatggtggcccccttcctgggggagggcacctgcctgcaggccgagctggagaagggcaacatctacctggccgactaccgcatcatggagggcatccccaccgtggagctgagcggcaggaagcagcaccactgtgcccccctgtgcctgctgcactttggacctgagggcaagatgatgcccatcgccatccagctgagccagaccccaggccctgactgccccatcttcctgcccagcgacagcgagtgggactggctgctggccaagacctgggtgcgctatgcagagttctacagccatgaggccatcgcccacctgctggagacccacctgattgctgaggccttctgcctggccctgctgaggaacctgcccatgtgccaccccctgtacaagctgctgatcccccacacccgctacacagtgcagatcaacagcatcggccgggctgtgctgctgaatgaaggaggcctgagcgccaagggcatgagcctgggcgtggagggctttgctggggtgatggtgcgggccctgtctgagctgacctatgacagcctgtacctgcccaatgactttgtggagcggggcgtgcaggacctgcccggctactactacagagatgacagcctggccgtgtggaatgccctggagaagtatgtgacagagatcatcacctactactaccccagtgatgctgctgtggagggggaccctgagctgcagagctgggtgcaggagatcttcaaggaatgtctgctgggccgggagagcagcggcttcccccgctgcctgaggacagtgcctgagctgatccgctacgtgaccatcgtcatctacacctgcagcgccaagcatgctgctgtgaacacaggccagatggagttcaccgcctggatgcccaacttccctgcctccatgaggaacccccccatccagaccaagggcctgaccaccctggagaccttcatggacaccctgcctgatgtgaagaccacctgcatcaccctgctggtgctgtggaccctgagccgggagccagatgaccggcggcccctgggccacttcccagacatccactttgtggaggaggcccccaggaggagcattgaggccttccggcagaggctgaaccagatcagccatgacatccggcagaggaacaagtgcctgcccatcccctactactacctggaccctgtgctgattgagaacagcatcagcatctag

SEQ ID NO: 143970 - DNA, 1989 bp, Artificial Sequence
  Description of Artificial Sequence: Synthetic coding sequence
atgggcctgtaccgcatccgggtgtccactggagccagcctgtatgccggcagcaacaaccaggtgcagctgtggctggtgggccagcacggggaggccgccctgggcaagaggctgtggccagcccggggcaaggagacagagctgaaggtggaggtgcctgagtacctgggccccctgctgtttgtgaagctgaggaagaggcacctgctgaaggatgatgcctggttctgcaactggatctctgtgcagggccctggagctggagatgaggtgcgcttcccctgctaccgctgggtggagggcaatggagtgctgagcctgcctgagggcaccggccgcacagtgggggaggacccccagggcctcttccagaagcaccgggaggaggagctggaggagaggaggaagctgtaccgctggggcaactggaaggatggcctcatcctgaacatggccggggccaagctgtatgacctgcctgtggatgagcgcttcctggaggacaagagggtggactttgaggtgtccctggccaagggcctggccgacctggccatcaaggacagcctgaatgtgctgacctgctggaaggacctggatgacttcaaccgcatcttctggtgtggccagagcaagctggccgagcgggtgcgggacagctggaaggaggatgccctgtttggctaccagttcctgaatggagccaaccctgtggtgctgcggcgcagcgcccacctgcctgcccggctggtgttccccccaggcatggaggagctgcaggcccagctggagaaggagctggagggcggcaccctgtttgaggccgacttcagcctgctggatggcatcaaggccaacgtcatcctgtgcagccagcagcacctggccgcccccctggtgatgctgaagctgcagccagatggcaagctgctgcccatggtgatccagctgcagctgcccaggacaggcagccccccaccacccctcttcctgcccacagacccccccatggcctggctgctggccaagtgctgggtgcgcagcagtgacttccagctgcacgagctgcagagccacctgctgcggggccacctgatggccgaggtgattgtggtggccaccatgcgctgcctgcccagcatccaccccatcttcaagctgatcatcccccacctgcgctacaccctggagatcaacgtgcgggccaggacaggcctggtgtctgacatgggcatctttgaccagatcatgagcactggaggcggcggccacgtgcagctgctgaagcaggccggggccttcctgacctacagcagcttctgccccccagatgacctggccgaccggggcctgctgggcgtgaagagcagcttctacgcccaggatgccctgcggctgtgggagatcatctaccgctacgtggagggcatcgtgtccctgcactacaagacagatgtggccgtgaaggatgatcctgagctgcagacctggtgccgggagatcacagaaattggcctgcagggcgcccaggaccggggcttccctgtgtccctgcaggcccgggaccaggtgtgccactttgtgaccatgtgcatcttcacctgcaccggccagcacgcctctgtgcacctgggccagctggactggtacagctgggtgcccaatgccccctgcaccatgaggctgcccccacccaccaccaaggatgccaccctggagaccgtgatggccaccctgcccaacttccaccaggccagcctgcagatgagcatcacctggcagctgggccggcggcagcctgtgatggtggccgtgggccagcacgaggaggagtacttcagcggccctgagcccaaggctgtgctgaagaagttccgggaggagctggccgccctggacaaggagattgagatcagaaatgccaagctggacatgccctatgagtacctgcggcccagcgtggtggagaacagcgtggccatctag

SEQ ID NO: 143971 - DNA, 2055 bp, Artificial Sequence
  Description of Artificial Sequence: Synthetic coding sequence
atgctgaagagaaatgaaagccagtggctggcccagaggcggcgctctgagaccagcctgagcaagatgggcctgtaccgcatccgggtgtccactggagccagcctgtatgccggcagcaacaaccaggtgcagctgtggctggtgggccagcacggggaggccgccctgggcaagaggctgtggccagcccggggcaaggagacagagctgaaggtggaggtgcctgagtacctgggccccctgctgtttgtgaagctgaggaagaggcacctgctgaaggatgatgcctggttctgcaactggatctctgtgcagggccctggagctggagatgaggtgcgcttcccctgctaccgctgggtggagggcaatggagtgctgagcctgcctgagggcaccggccgcacagtgggggaggacccccagggcctcttccagaagcaccgggaggaggagctggaggagaggaggaagctgtaccgctggggcaactggaaggatggcctcatcctgaacatggccggggccaagctgtatgacctgcctgtggatgagcgcttcctggaggacaagagggtggactttgaggtgtccctggccaagggcctggccgacctggccatcaaggacagcctgaatgtgctgacctgctggaaggacctggatgacttcaaccgcatcttctggtgtggccagagcaagctggccgagcgggtgcgggacagctggaaggaggatgccctgtttggctaccagttcctgaatggagccaaccctgtggtgctgcggcgcagcgcccacctgcctgcccggctggtgttccccccaggcatggaggagctgcaggcccagctggagaaggagctggagggcggcaccctgtttgaggccgacttcagcctgctggatggcatcaaggccaacgtcatcctgtgcagccagcagcacctggccgcccccctggtgatgctgaagctgcagccagatggcaagctgctgcccatggtgatccagctgcagctgcccaggacaggcagccccccaccacccctcttcctgcccacagacccccccatggcctggctgctggccaagtgctgggtgcgcagcagtgacttccagctgcacgagctgcagagccacctgctgcggggccacctgatggccgaggtgattgtggtggccaccatgcgctgcctgcccagcatccaccccatcttcaagctgatcatcccccacctgcgctacaccctggagatcaacgtgcgggccaggacaggcctggtgtctgacatgggcatctttgaccagatcatgagcactggaggcggcggccacgtgcagctgctgaagcaggccggggccttcctgacctacagcagcttctgccccccagatgacctggccgaccggggcctgctgggcgtgaagagcagcttctacgcccaggatgccctgcggctgtgggagatcatctaccgctacgtggagggcatcgtgtccctgcactacaagacagatgtggccgtgaaggatgatcctgagctgcagacctggtgccgggagatcacagaaattggcctgcagggcgcccaggaccggggcttccctgtgtccctgcaggcccgggaccaggtgtgccactttgtgaccatgtgcatcttcacctgcaccggccagcacgcctctgtgcacctgggccagctggactggtacagctgggtgcccaatgccccctgcaccatgaggctgcccccacccaccaccaaggatgccaccctggagaccgtgatggccaccctgcccaacttccaccaggccagcctgcagatgagcatcacctggcagctgggccggcggcagcctgtgatggtggccgtgggccagcacgaggaggagtacttcagcggccctgagcccaaggctgtgctgaagaagttccgggaggagctggccgccctggacaaggagattgagatcagaaatgccaagctggacatgccctatgagtacctgcggcccagcgtggtggagaacagcgtggccatctag

SEQ ID NO: 143972 - DNA, 1989 bp, Artificial Sequence; identical to SEQ ID NO: 143970
  Description of Artificial Sequence: Synthetic coding sequence

SEQ ID NO: 143973 - DNA, 486 bp, Artificial Sequence
  Description of Artificial Sequence: Synthetic coding sequence
atggaccaggagaccgtgggcaatgtggtgctgctggccatcgtgaccctcatctctgtggtgcagaatggcttctttgcccacaaggtggagcacgagagcaggacccagaatggccgctccttccagaggacaggcaccctggcctttgagcgggtgtacacagccaaccagaactgtgtggatgcctaccccaccttcctggccgtgctgtggagcgctggcctgctgtgcagccaggtgcctgctgcctttgctggcctgatgtacctgtttgtgcggcagaagtactttgtgggctacctgggggagaggacccagagcaccccaggctacatctttgggaagaggatcatcctcttcctgttcctgatgtctgtggccggcatcttcaactactacctgatcttcttctttggaagtgactttgagaactacatcaagaccatcagcaccaccatcagccccctgctgctgatcccctag

SEQ ID NO: 143974 - DNA, 2532 bp, Artificial Sequence
  Description of Artificial Sequence: Synthetic coding sequence
atgcccaggggggccttccggccctgcctgcctgccctgtactttgccttcctgacctgccccaccccagagcagaggatgagcggcacccaggccccagacatccacctgggggagcccgcccggggcaccggctgtgtgcggggcaagcagaccagcatccgggtgcaggactgtggcagaagagaggaggcccgggccgccagccgggagctgcggcgggagaaggcccaggagcacccccgggagagctgggcccacccccagccctacccagccccccagcccctggccctgcggcctgagacccagccctgcccagcctgccgcagcagccccccaggccgcctgctgctgcggcctgccctgcccggccaccccttcctgctgcccatcatggctgtgtaccgcctgtgtgtgaccaccggcccctacctgcgggccggcaccctggacaacatctctgtgaccctggtgggcacctgtggggagagccccaagcagaggctggacaggatgggccgggactttgcccctggctctgtgcagaagtacaaggtgcgctgcacagctgagctgggggagctgctgctgctgcgggtgcacaaggagagatatgccttcttcaggaaggacagctggtactgcagccgcatctgtgtgacagagccagatggctctgtgagccacttcccctgctaccagtggattgagggctactgcaccgtggagctgcggcctggaacagcccggaccatctgccaggacagcctgcccctgctgctggaccacaggacccgggagctgcgggcccggcaggagtgctaccgctggaagatctatgcccctggcttcccctgcatggtggatgtgaacagcttccaggagatggagagtgacaagaagtttgccctgaccaagaccaccacctgtgtggaccagggcgacagcagcggcaaccgctacctgcccggcttccccatgaagattgacatccccagcctgatgtacatggagcccaacgtgcgctacagcgccaccaagaccatcagcctgctcttcaatgccatcccagccagcctgggcatgaagctgcggggcctgctggacaggaagggctcctggaagaagctggatgacatgcagaacatcttctggtgccacaagaccttcaccaccaagtatgtgacagagcactggtgtgaggaccacttcttcggctaccagtacctgaatggagtgaaccctgtgatgctgcactgcatcagcagcctgcccagcaagctgcctgtgaccaatgacatggtggcccccctgctgggccaggacacctgcctgcagacagagctggagcggggcaacatcttcctggccgactactggatcctggccgaggcccccacccactgcctgaatggccggcagcagtatgtggccgcccccctgtgcctgctgtggctgagcccccagggcgccctggtgcccctggccatccagctgagccagaccccaggccctgacagccccatcttcctgcccacagacagcgagtgggactggctgctggccaagacctgggtgaggaacagcgagttcctggtgcatgagaacaacacccacttcctgtgcacccacctgctgtgtgaggcctttgccatggccaccctgcggcagctgcccctgtgccaccccatctacaagctgctgctgccccacacccgctacaccctgcaggtgaacaccatcgcccgggccaccctgctgaaccctgagggcctggtggaccaggtgaccagcatcggccggcagggcctcatctacctgatgagcacaggcctggcccacttcacctacaccaacttctgcctgcctgacagcctgcgggcccggggcgtgctggccatccccaactaccactacagagatgatggcctgaagatctgggccgccatcgagagctttgtgtctgagatcgtgggctactactaccccagtgatgcctctgtgcagcaggacagcgagctgcaggcctggacaggagagatctttgcccaggccttcctgggccgggagagcagcggcttccccagccggctgtgcaccccaggagagatggtgaagttcctgacagccatcatcttcaactgcagcgcccagcacgccgctgtgaacagcggccagcacgactttggagcctggatgcccaatgcccccagctccatgaggcagcccccaccccagaccaagggcaccaccaccctgaagacctacctggacaccctgcctgaggtgaacatcagctgcaacaacctgctgctcttctggctggtgtcccaggagcccaaggaccagaggcccctgggcacctacccagatgagcacttcacagaggaggcccccaggaggagcattgctgccttccagagccggctggcccagatcagccgggacatccaggagaggaaccagggcctggccctgccctacacctacctggacccccccctgattgagaacagcgtgtccatctag

SEQ ID NO: 143975 - DNA, 2604 bp, Artificial Sequence
  Description of Artificial Sequence: Synthetic coding sequence
atgggcaggaacagatcctggggcaccctgggcagcggccgcaccagcaccccaggccaccagagcggccccctgacccggcggcgggctgtgtcccagctgtaccgccgctacctgctcttcagcatcagcgccagtgaccccagcctgcggagcggcacccaggccccagacatccacctgggggagcccgcccggggcaccggctgtgtgcggggcaagcagaccagcatccgggtgcaggactgtggcagaagagaggaggcccgggccgccagccgggagctgcggcgggagaaggcccaggagcacccccgggagagctgggcccacccccagccctacccagccccccagcccctggccctgcggcctgagacccagccctgcccagcctgccgcagcagccccccaggccgcctgctgctgcggcctgccctgcccggccaccccttcctgctgcccatcatggctgtgtaccgcctgtgtgtgaccaccggcccctacctgcgggccggcaccctggacaacatctctgtgaccctggtgggcacctgtggggagagccccaagcagaggctggacaggatgggccgggactttgcccctggctctgtgcagaagtacaaggtgcgctgcacagctgagctgggggagctgctgctgctgcgggtgcacaaggagagatatgccttcttcaggaaggacagctggtactgcagccgcatctgtgtgacagagccagatggctctgtgagccacttcccctgctaccagtggattgagggctactgcaccgtggagctgcggcctggaacagcccggaccatctgccaggacagcctgcccctgctgctggaccacaggacccgggagctgcgggcccggcaggagtgctaccgctggaagatctatgcccctggcttcccctgcatggtggatgtgaacagcttccaggagatggagagtgacaagaagtttgccctgaccaagaccaccacctgtgtggaccagggcgacagcagcggcaaccgctacctgcccggcttccccatgaagattgacatccccagcctgatgtacatggagcccaacgtgcgctacagcgccaccaagaccatcagcctgctcttcaatgccatcccagccagcctgggcatgaagctgcggggcctgctggacaggaagggctcctggaagaagctggatgacatgcagaacatcttctggtgccacaagaccttcaccaccaagtatgtgacagagcactggtgtgaggaccacttcttcggctaccagtacctgaatggagtgaaccctgtgatgctgcactgcatcagcagcctgcccagcaagctgcctgtgaccaatgacatggtggcccccctgctgggccaggacacctgcctgcagacagagctggagcggggcaacatcttcctggccgactactggatcctggccgaggcccccacccactgcctgaatggccggcagcagtatgtggccgcccccctgtgcctgctgtggctgagcccccagggcgccctggtgcccctggccatccagctgagccagaccccaggccctgacagccccatcttcctgcccacagacagcgagtgggactggctgctggccaagacctgggtgaggaacagcgagttcctggtgcatgagaacaacacccacttcctgtgcacccacctgctgtgtgaggcctttgccatggccaccctgcggcagctgcccctgtgccaccccatctacaagctgctgctgccccacacccgctacaccctgcaggtgaacaccatcgcccgggccaccctgctgaaccctgagggcctggtggaccaggtgaccagcatcggccggcagggcctcatctacctgatgagcacaggcctggcccacttcacctacaccaacttctgcctgcctgacagcctgcgggcccggggcgtgctggccatccccaactaccactacagagatgatggcctgaagatctgggccgccatcgagagctttgtgtctgagatcgtgggctactactaccccagtgatgcctctgtgcagcaggacagcgagctgcaggcctggacaggagagatctttgcccaggccttcctgggccgggagagcagcggcttccccagccggctgtgcaccccaggagagatggtgaagttcctgacagccatcatcttcaactgcagcgcccagcacgccgctgtgaacagcggccagcacgactttggagcctggatgcccaatgcccccagctccatgaggcagcccccaccccagaccaagggcaccaccaccctgaagacctacctggacaccctgcctgaggtgaacatcagctgcaacaacctgctgctcttctggctggtgtcccaggagcccaaggaccagaggcccctgggcacctacccagatgagcacttcacagaggaggcccccaggaggagcattgctgccttccagagccggctggcccagatcagccgggacatccaggagaggaaccagggcctggccctgccctacacctacctggacccccccctgattgagaacagcgtgtccatctag

SEQ ID NO: 143976 - DNA, 2136 bp, Artificial Sequence
  Description of Artificial Sequence: Synthetic coding sequence
atggctgtgtaccgcctgtgtgtgaccaccggcccctacctgcgggccggcaccctggacaacatctctgtgaccctggtgggcacctgtggggagagccccaagcagaggctggacaggatgggccgggactttgcccctggctctgtgcagaagtacaaggtgcgctgcacagctgagctgggggagctgctgctgctgcgggtgcacaaggagagatatgccttcttcaggaaggacagctggtactgcagccgcatctgtgtgacagagccagatggctctgtgagccacttcccctgctaccagtggattgagggctactgcaccgtggagctgcggcctggaacagcccggaccatctgccaggacagcctgcccctgctgctggaccacaggacccgggagctgcgggcccggcaggagtgctaccgctggaagatctatgcccctggcttcccctgcatggtggatgtgaacagcttccaggagatggagagtgacaagaagtttgccctgaccaagaccaccacctgtgtggaccagggcgacagcagcggcaaccgctacctgcccggcttccccatgaagattgacatccccagcctgatgtacatggagcccaacgtgcgctacagcgccaccaagaccatcagcctgctcttcaatgccatcccagccagcctgggcatgaagctgcggggcctgctggacaggaagggctcctggaagaagctggatgacatgcagaacatcttctggtgccacaagaccttcaccaccaagtatgtgacagagcactggtgtgaggaccacttcttcggctaccagtacctgaatggagtgaaccctgtgatgctgcactgcatcagcagcctgcccagcaagctgcctgtgaccaatgacatggtggcccccctgctgggccaggacacctgcctgcagacagagctggagcggggcaacatcttcctggccgactactggatcctggccgaggcccccacccactgcctgaatggccggcagcagtatgtggccgcccccctgtgcctgctgtggctgagcccccagggcgccctggtgcccctggccatccagctgagccagaccccaggccctgacagccccatcttcctgcccacagacagcgagtgggactggctgctggccaagacctgggtgaggaacagcgagttcctggtgcatgagaacaacacccacttcctgtgcacccacctgctgtgtgaggcctttgccatggccaccctgcggcagctgcccctgtgccaccccatctacaagctgctgctgccccacacccgctacaccctgcaggtgaacaccatcgcccgggccaccctgctgaaccctgagggcctggtggaccaggtgaccagcatcggccggcagggcctcatctacctgatgagcacaggcctggcccacttcacctacaccaacttctgcctgcctgacagcctgcgggcccggggcgtgctggccatccccaactaccactacagagatgatggcctgaagatctgggccgccatcgagagctttgtgtctgagatcgtgggctactactaccccagtgatgcctctgtgcagcaggacagcgagctgcaggcctggacaggagagatctttgcccaggccttcctgggccgggagagcagcggcttccccagccggctgtgcaccccaggagagatggtgaagttcctgacagccatcatcttcaactgcagcgcccagcacgccgctgtgaacagcggccagcacgactttggagcctggatgcccaatgcccccagctccatgaggcagcccccaccccagaccaagggcaccaccaccctgaagacctacctggacaccctgcctgaggtgaacatcagctgcaacaacctgctgctcttctggctggtgtcccaggagcccaaggaccagaggcccctgggcacctacccagatgagcacttcacagaggaggcccccaggaggagcattgctgccttccagagccggctggcccagatcagccgggacatccaggagaggaaccagggcctggccctgccctacacctacctggacccccccctgattgagaacagcgtgtccatctag

SEQ ID NO: 143977 - DNA, 759 bp, Artificial Sequence
  Description of Artificial Sequence: Synthetic coding sequence
atggagccccagagcatgaagggccagaagaggccctttggaggcccctggaggctgaaggtgctgggcggccccccctggctgcggaggaccctgcccaagctgggccggcccaaggaggcccctgtggccaggatgagcacccagagcacccaccccctgaagccagaggccccccggctgcccccaggcatccctgagagccccagctgccagaggaggcacaccctgcctgccagcgagttccgctgcctgaccccagaagatgctgtgtctgcctttgaaattgaaagagaggccttcatctctgtgctgggcgtgtgccccctgtacctggatgagatccgccacttcctgaccctgtgcccagagctgagcctgggctggtttgaggagggctgcctggtggccttcatcatcggcagcctgtgggacaaggagcggctgatgcaggagagcctgaccctgcacaggtctgggggccacatcgcccacctgcacgtgctggccgtgcaccgggccttccggcagcagggccggggccccatcctgctgtggagatacctgcaccacctgggcagccagcctgctgtgagaagagctgccctgatgtgtgaagatgccctggtgcccttctatgagcgcttctccttccacgctgtgggcccctgtgccatcaccgtgggcagcctgaccttcatggagctgcactgcagcctgcggggccaccccttcctgcggaggaacagcggctgctag

SEQ ID NO: 143978 - DNA, 624 bp, Artificial Sequence
  Description of Artificial Sequence: Synthetic coding sequence
atgagcacccagagcacccaccccctgaagccagaggccccccggctgcccccaggcatccctgagagccccagctgccagaggaggcacaccctgcctgccagcgagttccgctgcctgaccccagaagatgctgtgtctgcctttgaaattgagcgggaggccttcatctctgtgctgggcgtgtgccccctgtacctggatgagatccgccacttcctgaccctgtgcccagagctgagcctgggctggtttgaggagggctgcctggtggccttcatcatcggcagcctgtgggacaaggagcggctgatgcaggagagcctgaccctgcacaggtctgggggccacatcgcccacctgcacgtgctggccgtgcaccgggccttccggcagcagggccggggccccatcctgctgtggagatacctgcaccacctgggcagccagcctgctgtgcggcgggccgccctgatgtgtgaagatgccctggtgcccttctatgagcgcttctccttccacgctgtgggcccctgtgccatcaccgtgggcagcctgaccttcatggagctgcactgcagcctgcggggccaccccttcctgcggagaaattctggctgctag

SEQ ID NO: 143979 - DNA, 1536 bp, Artificial Sequence
  Description of Artificial Sequence: Synthetic coding sequence
atggtgctgctggccgctgctgtgtgcaccaaggccggcaaggccatcgtgtcccggcagtttgtggagatgaccaggaccagaattgagggcctgctggccgccttccccaagctgatgaacacaggcaagcagcacacctttgtggagacagaatctgtgcgctacgtgtaccagcccatggagaagctgtacatggtgctgatcaccaccaagaacagcaacatcctggaggacctggagaccctgcggctcttcagcagggtcatccctgagtactgccgggccctggaggagaatgagatcagcgagcactgctttgacctgatctttgcctttgatgagatcgtggccctgggctacagagaaaatgtgaacctggcccagatccgcaccttcacagagatggacagccatgaggagaaggtgttccgggctgtgcgggagacccaggagcgggaggccaaggccgagatgaggaggaaggccaaggagctgcagcaggccaggagagatgctgagcggcagggcaagaaggcccctggctttggaggcttcggcagcagcgctgtgtctgggggcagcacagctgccatgatcacagagaccatcattgaaacagacaagcccaaggtggccccagccccagcccggcccagcggccccagcaaggccctgaagctgggcgccaagggcaaggaggtggacaactttgtggacaagctgaagtctgagggggagaccatcatgagcagctccatgggcaagaggaccagcgaggccaccaagatgcacgccccacccatcaacatggagagcgtgcacatgaagattgaggagaagatcaccctgacctgtggcagagatggcggcctgcagaacatggagctgcacggcatgatcatgctgcgcatcagtgatgacaagtatggccgcatccggctgcacgtggagaatgaagacaagaagggcgtgcagctgcagacccaccccaacgtggacaagaagctgttcaccgctgagagcctcatcggcctgaagaaccctgagaagagcttccctgtgaacagtgatgtgggcgtgctgaagtggaggctgcagaccacagaggagagcttcatccccctgaccatcaactgctggcccagcgagagcggaaatggctgtgatgtgaacattgaatatgagctgcaggaggacaacctggagctgaatgatgtggtgatcaccatccccctgcccagcggcgtgggcgcccctgtgattggagaaattgatggagagtacagacatgacagcagaagaaacaccctggagtggtgcctgcctgtgattgatgccaagaacaagagcggcagcctggagttcagcattgctggccagcccaatgacttcttccctgtgcaggtgtcctttgtgtccaagaagaactactgcaacatccaggtgaccaaggtgacccaggtggatggcaacagccctgtgcgcttcagcacagagaccaccttcctggtggacaagtatgagatcctgtag

SEQ ID NO: 143980 - DNA, 1659 bp, Artificial Sequence
  Description of Artificial Sequence: Synthetic coding sequence
atggccgagtgcaacctggtggccatcctgatcagcagcattgacaaccccctggacaagaacctggacaatggaggcaacagctgcctggacttccggcccctgaacagcttcagccagccccaggtgctgctggccgctgctgtgtgcaccaaggccggcaaggccatcgtgtcccggcagtttgtggagatgaccaggacccgcatcgagggcctgctggccgccttccccaagctgatgaacacaggcaagcagcacacctttgtggagacagagagcgtgcgctacgtgtaccagcccatggagaagctgtacatggtgctgatcaccaccaagaacagcaacatcctggaggacctggagaccctgcggctcttcagcagggtcatccctgagtactgccgggccctggaggagaatgagatcagcgagcactgctttgacctgatctttgcctttgatgaaattgtggccctgggctaccgggagaatgtgaacctggcccagatccgcaccttcacagagatggacagccatgaggagaaggtgttccgggctgtgcgggagacccaggagcgggaggccaaggccgagatgaggaggaaggccaaggagctgcagcaggccaggagagatgctgagcggcagggcaagaaggcccctggctttggaggcttcggcagcagcgctgtgtctgggggcagcacagctgccatgatcacagagaccatcatcgagacagacaagcccaaggtggccccagccccagcccggcccagcggccccagcaaggccctgaagctgggcgccaagggcaaggaggtggacaactttgtggacaagctgaagtctgagggggagaccatcatgagcagctccatgggcaagaggaccagcgaggccaccaagatgcacgccccacccatcaacatggagagcgtgcacatgaagattgaggagaagatcaccctgacctgtggcagagatggcggcctgcagaacatggagctgcacggcatgatcatgctgcgcatcagtgatgacaagtatggccgcatccggctgcacgtggagaatgaagacaagaagggcgtgcagctgcagacccaccccaacgtggacaagaagctgttcaccgctgagagcctgattggcctgaagaaccctgagaagagcttccctgtgaacagtgatgtgggcgtgctgaagtggaggctgcagaccacagaggagagcttcatccccctgaccatcaactgctggcccagcgagagcggaaatggctgtgatgtgaacatcgagtatgagctgcaggaggacaacctggagctgaatgatgtggtgatcaccatccccctgcccagcggcgtgggcgcccctgtgattggagaaattgatggagagtacagacatgacagcagaagaaacaccctggagtggtgcctgcctgtgattgatgccaagaacaagagcggcagcctggagttcagcattgctggccagcccaatgacttcttccctgtgcaggtgtcctttgtgtccaagaagaactactgcaacatccaggtgaccaaggtgacccaggtggatggcaacagccctgtgcgcttcagcacagagaccaccttcctggtggacaagtatgagatcctgtag

SEQ ID NO: 143981 - DNA, 1272 bp, Artificial Sequence
  Description of Artificial Sequence: Synthetic coding sequence
atgatccctgagtactgccgggccctggaggagaatgagatcagcgagcactgctttgacctgatctttgcctttgatgagatcgtggccctgggctacagagaaaatgtgaacctggcccagatccgcaccttcacagagatggacagccatgaggagaaggtgttccgggctgtgcgggagacccaggagcgggaggccaaggccgagatgaggaggaaggccaaggagctgcagcaggccaggagagatgctgagcggcagggcaagaaggcccctggctttggaggcttcggcagcagcgctgtgtctgggggcagcacagctgccatgatcacagagaccatcattgaaacagacaagcccaaggtggccccagccccagcccggcccagcggccccagcaaggccctgaagctgggcgccaagggcaaggaggtggacaactttgtggacaagctgaagtctgagggggagaccatcatgagcagctccatgggcaagaggaccagcgaggccaccaagatgcacgccccacccatcaacatggagagcgtgcacatgaagattgaggagaagatcaccctgacctgtggcagagatggcggcctgcagaacatggagctgcacggcatgatcatgctgcgcatcagtgatgacaagtatggccgcatccggctgcacgtggagaatgaagacaagaagggcgtgcagctgcagacccaccccaacgtggacaagaagctgttcaccgctgagagcctcatcggcctgaagaaccctgagaagagcttccctgtgaacagtgatgtgggcgtgctgaagtggaggctgcagaccacagaggagagcttcatccccctgaccatcaactgctggcccagcgagagcggaaatggctgtgatgtgaacattgaatatgagctgcaggaggacaacctggagctgaatgatgtggtgatcaccatccccctgcccagcggcgtgggcgcccctgtgattggagaaattgatggagagtacagacatgacagcagaagaaacaccctggagtggtgcctgcctgtgattgatgccaagaacaagagcggcagcctggagttcagcattgctggccagcccaatgacttcttccctgtgcaggtgtcctttgtgtccaagaagaactactgcaacatccaggtgaccaaggtgacccaggtggatggcaacagccctgtgcgcttcagcacagagaccaccttcctggtggacaagtatgagatcctgtag

SEQ ID NO: 143982 - DNA, 570 bp, Artificial Sequence
  Description of Artificial Sequence: Synthetic coding sequence
atggtgctgctggccgctgctgtgtgcaccaaggccggcaaggccatcgtgtcccggcagtttgtggagatgaccaggaccagaattgagggcctgctggccgccttccccaagctgatgaacacaggcaagcagcacacctttgtggagacagaatctgtgcgctacgtgtaccagcccatggagaagctgtacatggtgctgatcaccaccaagaacagcaacatcctggaggacctggagaccctgcggctcttcagcagggtcatccctgagtactgccgggccctggaggagaatgagatcagcgagcactgctttgacctgatctttgcctttgatgagatcgtggccctgggctacagagaaaatgtgaacctggcccagatccgcaccttcacagagatggacagccatgaggagaaggtgttccgggctgtgcgggagacccaggagcgggaggccaaggccgagatgaggaggaaggccaaggagctgcagcaggcccagagcgtgggcatcaccggcatgagccaccacgcccagctgctgctgtacttcaacccctag

SEQ ID NO: 143983 - DNA, 2223 bp, Artificial Sequence
  Description of Artificial Sequence: Synthetic coding sequence
atgacagtgaagctggactttgaagaatgtctgaaggacagcccccgcttccgggccagcattgagctggtggaggccgaggtgtctgagctggagacccggctggagaagctgctgaagctgggcaccggcctgctggagagcggccgccactacctggccgccagccgggcctttgtggtgggcatctgtgacctggcccggctgggccccccagagcccatgatggccgagtgcctggagaagttcaccgtgtccctgaaccacaagctggacagccatgctgagctgctggatgccacccagcacaccctgcagcagcagatccagaccctggtgaaggagggcctgcggggcttccgggaggcccggcgggacttctggagaggagctgagagcctggaggccgccctgacccacaatgctgaggtgcccaggagaagagcccaggaggccgaggaggccggggccgccctgaggacagcccgggccggctaccggggccgggccctggactatgccctgcagatcaacgtgattgaggacaagaggaagtttgacatcatggagtttgtgctgcggctggtggaggcccaggccacccacttccagcagggccacgaggagctgagccggctgagccagtacaggaaggagctgggcgcccagctgcaccagctggtgctgaacagcgcccgggagaagagggacatggagcagagacatgtgctgctgaagcagaaggagctgggcggggaggagcctgagcccagcctgcgggagggccctgggggcctggtgatggagggccacctgttcaagagggccagcaatgccttcaagacctggagccgccgctggttcaccatccagagcaaccagctggtgtaccagaagaagtacaaggaccctgtgacagtggtggtggatgacctgcggctgtgcaccgtgaagctgtgcccagattctgaaagacgcttctgctttgaggtggtgtccaccagcaagagctgcctgctgcaggccgacagcgagcggctgctgcagctgtgggtgtctgctgtgcagagcagcatcgccagcgccttcagccaggcccggctggatgacagcccccggggccctggccagggcagcggccacctggccatcggcagcgctgccaccctgggcagcggcggcatggcccggggccgggagcctggaggagtgggccacgtggtggcccaggtgcagagcgtggatggaaatgcccagtgctgtgactgccgggagcccgcccctgagtgggccagcatcaacctgggcgtgaccctgtgcatccagtgcagcggcatccacaggagcctgggcgtgcacttcagcaaggtgcgcagcctgaccctggacagctgggagcctgagctggtgaagctgatgtgtgagctgggcaatgtcatcatcaaccagatctatgaggcccgggtggaggccatggctgtgaagaagccaggccccagctgcagccggcaggagaaggaggcctggattcatgccaagtatgtggagaagaagttcctgaccaagctgcctgagatccggggcagaagaggaggccggggccggccccggggccagccccctgtgccccccaagcccagcatccggccccggcccggcagcctgcggagcaagccagagcccccatctgaggacctgggcagcctgcaccctggggccctgctcttccgggccagcggccacccccccagcctgcccaccatggctgatgccctggcccacggggctgatgtgaactgggtgaatggaggccaggacaatgccacccccctcatccaggccacagctgccaacagcctgctggcctgtgagttcctgctgcagaatggagccaacgtgaaccaggccgacagcgctggccggggccccctgcaccacgccaccatcctgggccacacaggcctggcctgcctcttcctgaagagaggagctgacctgggcgcccgggacagcgagggccgggaccccctgaccatcgccatggagacagccaatgctgacatcgtgaccctgctgcggctggccaagatgagggaggccgaggccgcccagggccaggccggagatgagacctacctggacatcttccgggacttcagcctgatggccagtgatgatcctgagaagctgagccgccgcagccatgacctgcacaccctgtag

SEQ ID NO: 143984 - DNA, 2337 bp, Artificial Sequence
  Description of Artificial Sequence: Synthetic coding sequence
atgaagatgacagtggactttgaagaatgtctgaaggacagcccccgcttccgggccgccctggaggaggtggagggagatgtggccgagctggagctgaagctggacaagctggtgaagctgtgcatcgccatgattgacaccgggaaggccttctgtgtggccaacaagcagttcatgaatggcatccgggacctggcccagtacagcagcaatgatgctgtggtggagaccagcctgaccaagttcagtgacagcctgcaggagatgatcaacttccacaccatcctgtttgaccagacccagaggagcatcaaggcccagctgcagaactttgtgaaggaggacctgaggaagttcaaggatgccaagaagcagtttgagaaggtgtctgaggagaaggaaaatgccctggtgaagaatgcccaggtgcagaggaacaagcagcacgaggtggaggaggccaccaacatcctgacagccaccaggaagtgcttccgccacatcgccctggactatgtgctgcagatcaacgtgctgcagagcaagagaagaagtgagatcctgaagtccatgctgtccttcatgtatgcccacctggccttcttccaccagggctatgacctcttcagcgagctgggcccctacatgaaggacctgggcgcccagctggaccggctggtggtggatgctgccaaggagaagcgggagatggagcagaagcacagcaccatccagcagaaggacttcagcagtgatgacagcaagctggagtacaacgtggatgctgccaatggaattgtgatggagggctacctgttcaagagggccagcaatgccttcaagacctggaacagacgctggttcagcatccagaacaaccagctggtgtaccagaagaagttcaaggacaaccccaccgtggtggtggaggacctgcggctgtgcaccgtgaagcactgtgaggacatcgagcggcgcttctgctttgaggtggtgagccccaccaagagctgcatgctgcaggccgacagcgagaagctgcggcaggcctggatcaaggctgtgcagaccagcatcgccacagcctaccgggagaagggagatgaaagtgagaagctggacaagaagagcagccccagcacaggcagcctggacagcggaaatgaaagcaaggagaagctgctgaagggggagagcgccctgcagagggtgcagtgcatccctggaaatgccagctgctgtgactgtggcctggccgacccccgctgggccagcatcaacctgggcatcaccctgtgcatcgagtgcagcggcatccacaggagcctgggcgtgcacttcagcaaggtgcgcagcctgaccctggacacctgggagcctgagctgctgaagctgatgtgtgagctgggcaatgatgtgatcaacagagtgtatgaggccaacgtggagaagatgggcatcaagaagccccagcccggccagaggcaggagaaggaggcctacatccgggccaagtatgtggagaggaagtttgtggacaagtacagcatcagcctgagccccccagagcagcagaagaagtttgtgtccaagagcagcgaggagaagaggctgagcatcagcaagtttggacctggggaccaggtgcgggccagcgcccagagctctgtgcgcagcaatgattctggcatccagcagagcagtgatgatggccgggagagcctgcccagcacagtgtctgccaacagcctgtatgagcctgagggggagcggcaggacagctccatgttcctggacagcaagcacctgaaccctggcctgcagctgtaccgggccagctatgagaagaacctgcccaagatggccgaggccctggcccacggggctgatgtgaactgggccaacagcgaggagaacaaggccacccccctcatccaggccgtgctgggcggcagcctggtgacctgtgagttcctgctgcagaatggagccaacgtgaaccagagagatgtgcagggccggggccccctgcaccacgccaccgtgctgggccacacaggccaggtgtgcctcttcctgaagagaggagccaaccagcacgccacagatgaggagggcaaggaccccctgagcattgctgtggaggccgccaatgctgacatcgtgaccctgctgcggctggccaggatgaatgaggagatgagggagagcgagggcctgtatggccagcctggagatgagacctaccaggacatcttccgggacttcagccagatggccagcaacaaccctgagaagctgaaccgcttccagcaggacagccagaagttctag

SEQ ID NO: 143985 - DNA, 3618 bp, Artificial Sequence
  Description of Artificial Sequence: Synthetic coding sequence
atgaccaagaaggaggagcccccacccagccgggtgcccagggctgtgcgggtggccagcctgctgtctgagggggaggagctgtctggagatgaccagggagatgaggaggaggatgaccacgcctatgaaggagtgcccaacggcggctggcacaccagcagcctgagcctgagcctgcccagcaccatcgccgccccccaccccatggatggccccccaggcggcagcacccctgtgacccctgtgatcaaggccggctggctggacaagaaccccccccagggcagctacatctaccagaagcgctgggtgcggctggacacagaccacctgcgctactttgacagcaacaaggatgcctacagcaagcgcttcatctctgtggcctgcatcagccacgtggccgccatcggggaccagaagtttgaagtcatcaccaacaacagaacatttgccttccgggcagagagtgatgtggagaggaaggagtggatgcaggccctgcagcaggccatggccgagcagagggcccgggcccggctgagcagcgcctacctgctgggcgtgcccggcagcgagcagcctgacagagctggcagcctggagctgcggggcttcaagaacaagctgtatgtggccgtggtgggggacaaggtgcagctgtacaagaacctggaggagtaccacctgggcatcggcatcaccttcatcgacatgtctgtgggcaatgtgaaggaggtggaccggcgcagctttgacctgaccaccccctaccgcatcttctccttctctgctgacagcgagctggagaaggagcagtggctggaggccatgcagggcgccatcgccgaggccctgagcaccagcgaggtggccgagcgcatctgggccgccgcccccaaccgcttctgtgccgactgtggggccccccagcctgactgggccagcatcaacctgtgtgtggtgatctgcaagagatgtgccggggagcaccggggcctgggcgccggcgtgtccaaggtgcgcagcctgaagatggacaggaaggtgtggacagagaccctgattgagctgttcctgcagctgggcaatggagctggcaaccgcttctgggccgccaacgtgcccccatctgaggccctgcagcccagcagcagccccagcacccggcgctgccacctggaggccaagtaccgggagggcaagtaccgccgctaccaccccctgtttggaaaccaggaggagctggacaaggccctgtgtgccgctgtgaccaccacagacctggccgagacccaggccctgctgggctgtggggccggcatcaactgcttcagcggggaccctgaggcccccacccccctggccctggccgagcaggccggccagaccctgcagatggagttcctgaggaacaacagaaccacagaggtgccccggctggacagcatgaagcccctggagaagcactacagcgtggtgctgcccaccgtgagccacagcggcttcctgtacaagacagccagcgctgggaagctgctgcaggaccggcgggcccgggaggagttcagccgccgctggtgtgtgctgggagatggagtgctgagctactttgaaaatgaaagagctgtgacccccaacggggagatccgggccagcgagatcgtgtgcctggccgtgcccccaccagacacccacggctttgagcacacctttgaggtgtacacagaaggagagcggctgtacctgtttggcctggagagcgctgagcaggcccacgagtgggtgaagtgcatcgccaaggcctttgtgccccccctggccgaggacctgctggcccgggactttgagcggctgggccgcctgccctacaaggccggcctgagcctgcagagggcccaggagggctggttcagcctgagcggcagcgagctgcgggctgtgtttcctgagggcccctgtgaggagcccctgcagctgaggaagctgcaggagctgagcatccagggcgacagcgagaaccaggtgctggtgctggtggagaggaggaggaccctgtacatccagggcgagcggcggctggacttcatgggctggctgggcgccatccagaaggccgccgcctccatgggagacaccctgtctgagcagcagctgggggacagcgacatccctgtgattgtgtaccgctgtgtggactacatcacccagtgtggcctgaccagcgagggcatctacagaaaatgtggccagaccagcaagacccagaggctgctggagagcctgcggcaggatgcccggtctgtgcacctgaaggagggggagcagcacgtggatgatgtgagcagcgccctgaagcgcttcctgcgggacctgcctgatggcctcttcacccgggcccagaggctgacctggctggaggccagcgagattgaagatgaggaggagaaggtgagccgctaccgggagctgctggtgcggctgccccctgtgaacagagccaccgtgaaggccctgatcagccacctgtactgtgtgcagtgcttcagtgacaccaaccagatgaatgtgcacaacctggccatcgtgtttggccccaccctcttccagacagatggccaggactacaaggccggccgggtggtggaggacctgatcaaccactacgtggtggtgttttctgtggatgaggaggagctgaggaagcagcgggaggagatcacagccatcgtgaagatgagggtggccggcacagccagcggcacccagcacgccggggacttcatctgcaccgtgtacctggaggagaagaaggccgagacagagcagcacatcaaggtgcctgcctccatgacagctgaggagctgaccctggagatcctggacagaagaaatgtgggcatccgggagaaggactactggacctgctttgaggtgaatgaaagagaggaggccgagcggcccctgcactttgctgagaaggtgctgcccatcctgcacggcctgggcacagacagccacctggtggtgaagaagcaccaggccatggaggccatgctgctgtacctggccagccgggtgggggacaccaagcacggcatgatgaagttccgggaggacaggagcctgctgggcctgggcctgcccagcggcggcttccatgaccgctacttcatcctgaacagcagctgcctgcggctgtacaaggaggtgcgcagccagaggccctggagcggggcccctgagaccagccacaggcctgagaaggagtggcccatcaagagcctgaaggtgtacctgggcgtgaagaagaagctgcggccccccacctgctggggcttcaccgtggtgcatgaaacagagaagcatgagaagcagcagtggtacctgtgctgtgacacccagatggagctgcgggagtggtttgccaccttcctgtttgtgcagcatgatggcctggtgtggcccagcgagcccagccgggtgtccagagctgtgcctgaggtgcggctgggctctgtgtccctcatccccctgcggggctctgaaaatgagatgagaagatctgtggccgccttcaccgctgaccccctgagcctgctgagaaatgtgtag

SEQ ID NO: 143986 - DNA, 1884 bp, Artificial Sequence
  Description of Artificial Sequence: Synthetic coding sequence
aaatgctgggccgtgtgggtgggcgctgtgtggacagagggcgcctggcagccccgggtgggcgtcatctgtggcctgaagggccgcatgaccctgagcggcagccggggccaggaggagcccccacccagccgggtgcccagggctgtgcgggtggccagcctgctgtctgagggggaggagctgtctggagatgaccagggagatgaggaggaggatgaccacgcctatgaaggagtgcccaacggcggctggcacaccagcagcctgagcctgagcctgcccagcaccatcgccgccccccaccccatggatggccccccaggcggcagcacccctgtgacccctgtgatcaaggccggctggctggacaagaaccccccccagggcagctacatctaccagaagcgctgggtgcggctggacacagaccacctgcgctactttgacagcaacaaggatgcctacagcaagcgcttcatctctgtggcctgcatcagccacgtggccgccatcggggaccagaagtttgaagtcatcaccaacaacagaacatttgccttccgggcagagagtgatgtggagaggaaggagtggatgcaggccctgcagcaggccatggccgagcagagggcccgggcccggctgagcagcgcctacctgctgggcgtgcccggcagcgagcagcctgacagagctggcagcctggagctgcggggcttcaagaacaagctgtatgtggccgtggtgggggacaaggtgcagctgtacaagaacctggaggagtaccacctgggcatcggcatcaccttcatcgacatgtctgtgggcaatgtgaaggaggtggaccggcgcagctttgacctgaccaccccctaccgcatcttctccttctctgctgacagcgagctggagaaggagcagtggctggaggccatgcagggcgccatcgccgaggccctgagcaccagcgaggtggccgagcgcatctgggccgccgcccccaaccgcttctgtgccgactgtggggccccccagcctgactgggccagcatcaacctgtgtgtggtgatctgcaagagatgtgccggggagcaccggggcctgggcgccggcgtgtccaaggtgcgcagcctgaagatggacaggaaggtgtggacagagaccctgattgagctgttcctgcagctgggcaatggagctggcaaccgcttctgggccgccaacgtgcccccatctgaggccctgcagcccagcagcagccccagcacccggcgctgccacctggaggccaagtaccgggagggcaagtaccgccgctaccaccccctgtttggaaaccaggaggagctggacaaggccctgtgtgccgctgtgaccaccacagacctggccgagacccaggccctgctgggctgtggggccggcatcaactgcttcagcggggaccctgaggcccccacccccctggccctggccgagcaggccggccagaccctgcagatggagttcctgaggaacaacagaaccacagaggtgccccggctggacagcatgaagcccctggagaagcactacagcgtggtgctgcccaccgtgagccacagcggcttcctgtacaagacagccagcgctgggaagctgctgcaggaccggcgggcccgggaggagttcagccgccgctggtgtgtgctgggagatggagtgctgagctactttgaaaatgaaagagctgtgacccccaacggggagatccgggccagcgagatcgtgtgcctggccgtgcccccaccagacacccacggctttgagcacacctttgaggtgtacacagaaggagagcggctgtacctgtgggccggggagtgtggggccggcagctag

SEQ ID NO: 143987 - DNA, 4320 bp, Artificial Sequence
  Description of Artificial Sequence: Synthetic coding sequence
atggccgaggccggagatgctgccctgtctgtggccgagtggctgcgggccctgcacctggagcagtacacaggcctgtttgagcagcacggcctggtgtgggccacagagtgccagggcctgagtgacacccggctgatggacatgggcatgctgctgcccggccacagaagacgcatcctggccggcctgctgcgggcccacaccagccctgccccagccccccggcccacccccaggcctgtgcccatgaagaggcacatcttccgcagcccccctgtgcctgccaccccacctgagcccctgcccaccaccacagaagatgagggcctgcctgctgccccacccatccccccccggcgcagctgcctgccccccacctgcttcaccacccccagcacagctgccccagaccctgtgctgccccccctgcctgccaagaggcacctggccgagctgtctgtgccccctgtgccccccaggacaggccccccccggctgctggtgtccctgcccaccaaggaggaggagagcctgctgcccagcctgagcagccccccccagccccagagcgaggagcccctgagcaccctgccccagggccccccccagccccccagccccccaccctgccccccagagatcccccccaagcctgtgcggctcttccctgagtttgatgacagcgactatgatgaggtgcctgaggagggccctggggccccagcccgggtgatgaccaagaaggaggagcccccacccagccgggtgcccagggctgtgcgggtggccagcctgctgtctgagggggaggagctgtctggagatgaccagggagatgaggaggaggatgaccacgcctatgagggcgtgcccaatggaggctggcacaccagcagcctgagcctgagcctgcccagcaccatcgccgccccccaccccatggatggccccccaggcggcagcacccctgtgacccctgtgatcaaggccggctggctggacaagaaccccccccagggcagctacatctaccagaagcgctgggtgcggctggacacagaccacctgcgctactttgacagcaacaaggatgcctacagcaagcgcttcatctctgtggcctgcatcagccacgtggccgccatcggggaccagaagtttgaggtgatcaccaacaacagaacatttgccttccgggcagagagtgatgtggagaggaaggagtggatgcaggccctgcagcaggccatggccgagcagagggcccgggcccggctgagcagcgcctacctgctgggcgtgcccggcagcgagcagcctgaccgggccggcagcctggagctgcggggcttcaagaacaagctgtatgtggccgtggtgggggacaaggtgcagctgtacaagaacctggaggagtaccacctgggcatcggcatcaccttcatcgacatgtctgtgggcaatgtgaaggaggtggacagaagaagctttgacctgaccaccccctaccgcatcttctccttctctgctgacagcgagctggagaaggagcagtggctggaggccatgcagggcgccatcgccgaggccctgagcaccagcgaggtggccgagcgcatctgggccgccgcccccaaccgcttctgtgccgactgtggggccccccagcctgactgggccagcatcaacctgtgtgtggtgatctgcaagagatgtgccggggagcaccggggcctgggcgctggggtgtccaaggtgcgcagcctgaagatggacaggaaggtgtggacagagaccctcatcgagctgttcctgcagctgggcaatggagctggcaaccgcttctgggccgccaacgtgccccccagcgaggccctgcagcccagcagcagccccagcacccggcgctgccacctggaggccaagtaccgggagggcaagtaccgccgctaccaccccctgtttggaaaccaggaggagctggacaaggccctgtgtgccgctgtgaccaccacagacctggccgagacccaggccctgctgggctgtggggccggcatcaactgcttcagcggggaccctgaggcccccacccccctggccctggccgagcaggccggccagaccctgcagatggagttcctgaggaacaacagaaccacagaggtgccccggctggacagcatgaagcccctggagaagcactacagcgtggtgctgcccaccgtgagccacagcggcttcctgtacaagacagccagcgctgggaagctgctgcaggacagaagagcccgggaggagttcagccgccgctggtgtgtgctgggagatggagtgctgagctactttgaaaatgaaagagctgtgaccccaaatggagagatccgggccagcgagatcgtgtgcctggccgtgcccccaccagacacccacggctttgagcacacctttgaggtgtacacagaaggagagcggctgtacctgtttggcctggagagcgctgagcaggcccacgagtgggtgaagtgcatcgccaaggcctttgtgccccccctggccgaggacctgctggcccgggactttgagcggctgggccgcctgccctacaaggccggcctgagcctgcagagggcccaggagggctggttcagcctgagcggcagcgagctgcgggctgtgtttcctgagggcccctgtgaggagcccctgcagctgaggaagctgcaggagctgagcatccagggcgacagcgagaaccaggtgctggtgctggtggagaggaggaggaccctgtacatccagggcgagcggcggctggacttcatgggctggctgggcgccatccagaaggctgctgcctccatgggagacaccctgtctgagcagcagctgggggacagcgacatccctgtgattgtgtaccgctgtgtggactacatcacccagtgtggcctgaccagcgagggcatctacagaaaatgtggccagaccagcaagacccagaggctgctggagagcctgcggcaggatgcccggtctgtgcacctgaaggagggggagcagcacgtggatgatgtgtcctctgccctgaagcgcttcctgcgggacctgcctgatggcctcttcacccgggcccagaggctgacctggctggaggccagcgagattgaagatgaggaggagaaggtgagccgctaccgggagctgctggtgcggctgccccctgtgaacagagccaccgtgaaggccctgatcagccacctgtactgtgtgcagtgcttcagtgacaccaaccagatgaatgtgcacaacctggccatcgtgtttggccccaccctcttccagacagatggccaggactacaaggccggccgggtggtggaggacctgatcaaccactacgtggtggtgttttctgtggatgaggaggagctgaggaagcagcgggaggagatcacagccatcgtgaagatgagggtggccggcacagccagcggcacccagcacgccggggacttcatctgcaccgtgtacctggaggagaagaaggccgagacagagcagcacatcaaggtgcctgcctccatgacagctgaggagctgaccctggagatcctggacagaagaaatgtgggcatccgggagaaggactactggacctgctttgaggtgaatgaaagagaggaggccgagcggcccctgcactttgctgagaaggtgctgcccatcctgcacggcctgggcacagacagccacctggtggtgaagaagcaccaggccatggaggccatgctgctgtacctggccagccgggtgggggacaccaagcacggcatgatgaagttcagagaagatagaagcctgctgggcctgggcctgcccagcggcggcttccatgaccgctacttcatcctgaacagcagctgcctgcggctgtacaaggaggtgcgcagccacaggcctgagaaggagtggcccatcaagagcctgaaggtgtacctgggcgtgaagaagaagctgcggccccccacctgctggggcttcaccgtggtgcatgaaacagagaagcatgagaagcagcagtggtacctgtgctgtgacacccagatggagctgcgggagtggtttgccaccttcctgtttgtgcagcatgatggcctggtgtggcccagcgagcccagccgggtgtccagagctgtgcctgaggtgcggctgggctctgtgtccctcatccccctgcggggctctgaaaatgagatgagaagatctgtggccgccttcaccgctgaccccctgagcctgctgagaaatgtgtag

SEQ ID NO: 143988 - DNA, 3633 bp, Artificial Sequence
  Description of Artificial Sequence: Synthetic coding sequence
atgaccctgagcggcagccggggccaggaggagcccccacccagccgggtgcccagggctgtgcgggtggccagcctgctgtctgagggggaggagctgtctggagatgaccagggagatgaggaggaggatgaccacgcctatgagggcgtgcccaatggaggctggcacaccagcagcctgagcctgagcctgcccagcaccatcgccgccccccaccccatggatggccccccaggcggcagcacccctgtgacccctgtgatcaaggccggctggctggacaagaaccccccccagggcagctacatctaccagaagcgctgggtgcggctggacacagaccacctgcgctactttgacagcaacaaggatgcctacagcaagcgcttcatctctgtggcctgcatcagccacgtggccgccatcggggaccagaagtttgaggtgatcaccaacaacagaacatttgccttccgggcagagagtgatgtggagaggaaggagtggatgcaggccctgcagcaggccatggccgagcagagggcccgggcccggctgagcagcgcctacctgctgggcgtgcccggcagcgagcagcctgaccgggccggcagcctggagctgcggggcttcaagaacaagctgtatgtggccgtggtgggggacaaggtgcagctgtacaagaacctggaggagtaccacctgggcatcggcatcaccttcatcgacatgtctgtgggcaatgtgaaggaggtggacagaagaagctttgacctgaccaccccctaccgcatcttctccttctctgctgacagcgagctggagaaggagcagtggctggaggccatgcagggcgccatcgccgaggccctgagcaccagcgaggtggccgagcgcatctgggccgccgcccccaaccgcttctgtgccgactgtggggccccccagcctgactgggccagcatcaacctgtgtgtggtgatctgcaagagatgtgccggggagcaccggggcctgggcgctggggtgtccaaggtgcgcagcctgaagatggacaggaaggtgtggacagagaccctcatcgagctgttcctgcagctgggcaatggagctggcaaccgcttctgggccgccaacgtgccccccagcgaggccctgcagcccagcagcagccccagcacccggcgctgccacctggaggccaagtaccgggagggcaagtaccgccgctaccaccccctgtttggaaaccaggaggagctggacaaggccctgtgtgccgctgtgaccaccacagacctggccgagacccaggccctgctgggctgtggggccggcatcaactgcttcagcggggaccctgaggcccccacccccctggccctggccgagcaggccggccagaccctgcagatggagttcctgaggaacaacagaaccacagaggtgccccggctggacagcatgaagcccctggagaagcactacagcgtggtgctgcccaccgtgagccacagcggcttcctgtacaagacagccagcgctgggaagctgctgcaggacagaagagcccgggaggagttcagccgccgctggtgtgtgctgggagatggagtgctgagctactttgaaaatgaaagagctgtgaccccaaatggagagatccgggccagcgagatcgtgtgcctggccgtgcccccaccagacacccacggctttgagcacacctttgaggtgtacacagaaggagagcggctgtacctgtttggcctggagagcgctgagcaggcccacgagtgggtgaagtgcatcgccaaggcctttgtgccccccctggccgaggacctgctggcccgggactttgagcggctgggccgcctgccctacaaggccggcctgagcctgcagagggcccaggagggctggttcagcctgagcggcagcgagctgcgggctgtgtttcctgagggcccctgtgaggagcccctgcagctgaggaagctgcaggagctgagcatccagggcgacagcgagaaccaggtgctggtgctggtggagaggaggaggaccctgtacatccagggcgagcggcggctggacttcatgggctggctgggcgccatccagaaggctgctgcctccatgggagacaccctgtctgagcagcagctgggggacagcgacatccctgtgattgtgtaccgctgtgtggactacatcacccagtgtggcctgaccagcgagggcatctacagaaaatgtggccagaccagcaagacccagaggctgctggagagcctgcggcaggatgcccggtctgtgcacctgaaggagggggagcagcacgtggatgatgtgtcctctgccctgaagcgcttcctgcgggacctgcctgatggcctcttcacccgggcccagaggctgacctggctggaggccagcgagattgaagatgaggaggagaaggtgagccgctaccgggagctgctggtgcggctgccccctgtgaacagagccaccgtgaaggccctgatcagccacctgtactgtgtgcagtgcttcagtgacaccaaccagatgaatgtgcacaacctggccatcgtgtttggccccaccctcttccagacagatggccaggactacaaggccggccgggtggtggaggacctgatcaaccactacgtggtggtgttttctgtggatgaggaggagctgaggaagcagcgggaggagatcacagccatcgtgaagatgagggtggccggcacagccagcggcacccagcacgccggggacttcatctgcaccgtgtacctggaggagaagaaggccgagacagagcagcacatcaaggtgcctgcctccatgacagctgaggagctgaccctggagatcctggacagaagaaatgtgggcatccgggagaaggactactggacctgctttgaggtgaatgaaagagaggaggccgagcggcccctgcactttgctgagaaggtgctgcccatcctgcacggcctgggcacagacagccacctggtggtgaagaagcaccaggccatggaggccatgctgctgtacctggccagccgggtgggggacaccaagcacggcatgatgaagttcagagaagatagaagcctgctgggcctgggcctgcccagcggcggcttccatgaccgctacttcatcctgaacagcagctgcctgcggctgtacaaggaggtgcgcagccagaggccctggagcggggcccctgagaccagccacaggcctgagaaggagtggcccatcaagagcctgaaggtgtacctgggcgtgaagaagaagctgcggccccccacctgctggggcttcaccgtggtgcatgaaacagagaagcatgagaagcagcagtggtacctgtgctgtgacacccagatggagctgcgggagtggtttgccaccttcctgtttgtgcagcatgatggcctggtgtggcccagcgagcccagccgggtgtccagagctgtgcctgaggtgcggctgggctctgtgtccctcatccccctgcggggctctgaaaatgagatgagaagatctgtggccgccttcaccgctgaccccctgagcctgctgagaaatgtgtag

SEQ ID NO: 143989 - DNA, 4353 bp, Artificial Sequence
  Description of Artificial Sequence: Synthetic coding sequence
atggccgaggccggagatgctgccctgtctgtggccgagtggctgcgggccctgcacctggagcagtacacaggcctgtttgagcagcacggcctggtgtgggccacagagtgccagggcctgagtgacacccggctgatggacatgggcatgctgctgcccggccacagaagacgcatcctggccggcctgctgcgggcccacaccagccctgccccagccccccggcccacccccaggcctgtgcccatgaagaggcacatcttccgcagcccccctgtgcctgccaccccacctgagcccctgcccaccaccacagaagatgagggcctgcctgctgccccacccatccccccccggcgcagctgcctgccccccacctgcttcaccacccccagcacagctgccccagaccctgtgctgccccccctgcctgccaagaggcacctggccgagctgtctgtgccccctgtgccccccaggacaggccccccccggctgctggtgtccctgcccaccaaggaggaggagagcctgctgcccagcctgagcagccccccccagccccagagcgaggagcccctgagcaccctgccccagggccccccccagccccccagccccccaccctgccccccagagatcccccccaagcctgtgcggctcttccctgagtttgatgacagcgactatgatgaggtgcctgaggagggccctggggccccagcccgggtgatgaccaagaaggaggagcccccacccagccgggtgcccagggctgtgcgggtggccagcctgctgtctgagggggaggagctgtctggagatgaccagggagatgaggaggaggatgaccacgcctatgagggcgtgcccaatggaggctggcacaccagcagcctgagcctgagcctgcccagcaccatcgccgccccccaccccatggatggccccccaggcggcagcacccctgtgacccctgtgatcaaggccggctggctggacaagaaccccccccagggcagctacatctaccagaagcgctgggtgcggctggacacagaccacctgcgctactttgacagcaacaaggatgcctacagcaagcgcttcatctctgtggcctgcatcagccacgtggccgccatcggggaccagaagtttgaggtgatcaccaacaacagaacatttgccttccgggcagagagtgatgtggagaggaaggagtggatgcaggccctgcagcaggccatggccgagcagagggcccgggcccggctgagcagcgcctacctgctgggcgtgcccggcagcgagcagcctgaccgggccggcagcctggagctgcggggcttcaagaacaagctgtatgtggccgtggtgggggacaaggtgcagctgtacaagaacctggaggagtaccacctgggcatcggcatcaccttcatcgacatgtctgtgggcaatgtgaaggaggtggacagaagaagctttgacctgaccaccccctaccgcatcttctccttctctgctgacagcgagctggagaaggagcagtggctggaggccatgcagggcgccatcgccgaggccctgagcaccagcgaggtggccgagcgcatctgggccgccgcccccaaccgcttctgtgccgactgtggggccccccagcctgactgggccagcatcaacctgtgtgtggtgatctgcaagagatgtgccggggagcaccggggcctgggcgctggggtgtccaaggtgcgcagcctgaagatggacaggaaggtgtggacagagaccctcatcgagctgttcctgcagctgggcaatggagctggcaaccgcttctgggccgccaacgtgccccccagcgaggccctgcagcccagcagcagccccagcacccggcgctgccacctggaggccaagtaccgggagggcaagtaccgccgctaccaccccctgtttggaaaccaggaggagctggacaaggccctgtgtgccgctgtgaccaccacagacctggccgagacccaggccctgctgggctgtggggccggcatcaactgcttcagcggggaccctgaggcccccacccccctggccctggccgagcaggccggccagaccctgcagatggagttcctgaggaacaacagaaccacagaggtgccccggctggacagcatgaagcccctggagaagcactacagcgtggtgctgcccaccgtgagccacagcggcttcctgtacaagacagccagcgctgggaagctgctgcaggacagaagagcccgggaggagttcagccgccgctggtgtgtgctgggagatggagtgctgagctactttgaaaatgaaagagctgtgaccccaaatggagagatccgggccagcgagatcgtgtgcctggccgtgcccccaccagacacccacggctttgagcacacctttgaggtgtacacagaaggagagcggctgtacctgtttggcctggagagcgctgagcaggcccacgagtgggtgaagtgcatcgccaaggcctttgtgccccccctggccgaggacctgctggcccgggactttgagcggctgggccgcctgccctacaaggccggcctgagcctgcagagggcccaggagggctggttcagcctgagcggcagcgagctgcgggctgtgtttcctgagggcccctgtgaggagcccctgcagctgaggaagctgcaggagctgagcatccagggcgacagcgagaaccaggtgctggtgctggtggagaggaggaggaccctgtacatccagggcgagcggcggctggacttcatgggctggctgggcgccatccagaaggctgctgcctccatgggagacaccctgtctgagcagcagctgggggacagcgacatccctgtgattgtgtaccgctgtgtggactacatcacccagtgtggcctgaccagcgagggcatctacagaaaatgtggccagaccagcaagacccagaggctgctggagagcctgcggcaggatgcccggtctgtgcacctgaaggagggggagcagcacgtggatgatgtgtcctctgccctgaagcgcttcctgcgggacctgcctgatggcctcttcacccgggcccagaggctgacctggctggaggccagcgagattgaagatgaggaggagaaggtgagccgctaccgggagctgctggtgcggctgccccctgtgaacagagccaccgtgaaggccctgatcagccacctgtactgtgtgcagtgcttcagtgacaccaaccagatgaatgtgcacaacctggccatcgtgtttggccccaccctcttccagacagatggccaggactacaaggccggccgggtggtggaggacctgatcaaccactacgtggtggtgttttctgtggatgaggaggagctgaggaagcagcgggaggagatcacagccatcgtgaagatgagggtggccggcacagccagcggcacccagcacgccggggacttcatctgcaccgtgtacctggaggagaagaaggccgagacagagcagcacatcaaggtgcctgcctccatgacagctgaggagctgaccctggagatcctggacagaagaaatgtgggcatccgggagaaggactactggacctgctttgaggtgaatgaaagagaggaggccgagcggcccctgcactttgctgagaaggtgctgcccatcctgcacggcctgggcacagacagccacctggtggtgaagaagcaccaggccatggaggccatgctgctgtacctggccagccgggtgggggacaccaagcacggcatgatgaagttcagagaagatagaagcctgctgggcctgggcctgcccagcggcggcttccatgaccgctacttcatcctgaacagcagctgcctgcggctgtacaaggaggtgcgcagccagaggccctggagcggggcccctgagaccagccacaggcctgagaaggagtggcccatcaagagcctgaaggtgtacctgggcgtgaagaagaagctgcggccccccacctgctggggcttcaccgtggtgcatgaaacagagaagcatgagaagcagcagtggtacctgtgctgtgacacccagatggagctgcgggagtggtttgccaccttcctgtttgtgcagcatgatggcctggtgtggcccagcgagcccagccgggtgtccagagctgtgcctgaggtgcggctgggctctgtgtccctcatccccctgcggggctctgaaaatgagatgagaagatctgtggccgccttcaccgctgaccccctgagcctgctgagaaatgtgtag

SEQ ID NO: 143990 - DNA, 3402 bp, Artificial Sequence
  Description of Artificial Sequence: Synthetic coding sequence
atgaccaagaaggaggagcccccacccagccgggtgcccagggctgtgcgggtggccagcctgctgtctgagggggaggagctgtctggagatgaccagggagatgaggaggaggatgaccacgcctatgaaggagtgcccaacggcggctggcacaccagcagcctgagcctgagcctgcccagcaccatcgccgccccccaccccatggatggccccccaggcggcagcacccctgtgacccctgtgatcaaggccggctggctggacaagaaccccccccagggcagctacatctaccagaagcgctgggtgcggctggacacagaccacctgcgctactttgacagcaacaaggatgcctacagcaagcgcttcatctctgtggcctgcatcagccacgtggccgccatcggggaccagaagtttgaagtcatcaccaacaacagaacatttgccttccgggcagagagtgatgtggagaggaaggagtggatgcaggccctgcagcaggccatggccgagcagagggcccgggcccggctgagcagcgcctacctgctgggcgtgcccggcagcgagcagcctgacagagctggcagcctggagctgcggggcttcaagaacaagctgtatgtggccgtggtgggggacaaggtgcagctgtacaagaacctggaggagtaccacctgggcatcggcatcaccttcatcgacatgtctgtgggcaatgtgaaggaggtggaccggcgcagctttgacctgaccaccccctaccgcatcttctccttctctgctgacagcgagctggagaaggagcagtggctggaggccatgcagggcgccatcgccgaggccctgagcaccagcgaggtggccgagcgcatctgggccgccgcccccaaccgcttctgtgccgactgtggggccccccagcctgactgggccagcatcaacctgtgtgtggtgatctgcaagagatgtgccggggagcaccggggcctgggcgccggcgtgtccaaggtgcgcagcctgaagatggacaggaaggtgtggacagagaccctgattgaggccctgtgtgccgctgtgaccaccacagacctggccgagacccaggccctgctgggctgtggggccggcatcaactgcttcagcggggaccctgaggcccccacccccctggccctggccgagcaggccggccagaccctgcagatggagttcctgaggaacaacagaaccacagaggtgccccggctggacagcatgaagcccctggagaagcactacagcgtggtgctgcccaccgtgagccacagcggcttcctgtacaagacagccagcgctgggaagctgctgcaggacagaagagcccgggaggagttcagccgccgctggtgtgtgctgggagatggagtgctgagctactttgaaaatgaaagagctgtgaccccaaatggagagatccgggccagcgagatcgtgtgcctggccgtgcccccaccagacacccacggctttgagcacacctttgaggtgtacacagaaggagagcggctgtacctgtttggcctggagagcgctgagcaggcccacgagtgggtgaagtgcatcgccaaggcctttgtgccccccctggccgaggacctgctggcccgggactttgagcggctgggccgcctgccctacaaggccggcctgagcctgcagagggcccaggagggctggttcagcctgagcggcagcgagctgcgggctgtgtttcctgagggcccctgtgaggagcccctgcagctgaggaagctgcaggagctgagcatccagggcgacagcgagaaccaggtgctggtgctggtggagaggaggaggaccctgtacatccagggcgagcggcggctggacttcatgggctggctgggcgccatccagaaggctgctgcctccatgggagacaccctgtctgagcagcagctgggggacagcgacatccctgtgattgtgtaccgctgtgtggactacatcacccagtgtggcctgaccagcgagggcatctacagaaaatgtggccagaccagcaagacccagaggctgctggagagcctgcggcaggatgcccggtctgtgcacctgaaggagggggagcagcacgtggatgatgtgtcctctgccctgaagcgcttcctgcgggacctgcctgatggcctcttcacccgggcccagaggctgacctggctggaggccagcgagattgaagatgaggaggagaaggtgagccgctaccgggagctgctggtgcggctgccccctgtgaacagagccaccgtgaaggccctgatcagccacctgtactgtgtgcagtgcttcagtgacaccaaccagatgaatgtgcacaacctggccatcgtgtttggccccaccctcttccagacagatggccaggactacaaggccggccgggtggtggaggacctgatcaaccactacgtggtggtgttttctgtggatgaggaggagctgaggaagcagcgggaggagatcacagccatcgtgaagatgagggtggccggcacagccagcggcacccagcacgccggggacttcatctgcaccgtgtacctggaggagaagaaggccgagacagagcagcacatcaaggtgcctgcctccatgacagctgaggagctgaccctggagatcctggacagaagaaatgtgggcatccgggagaaggactactggacctgctttgaggtgaatgaaagagaggaggccgagcggcccctgcactttgctgagaaggtgctgcccatcctgcacggcctgggcacagacagccacctggtggtgaagaagcaccaggccatggaggccatgctgctgtacctggccagccgggtgggggacaccaagcacggcatgatgaagttcagagaagatagaagcctgctgggcctgggcctgcccagcggcggcttccatgaccgctacttcatcctgaacagcagctgcctgcggctgtacaaggaggtgcgcagccacaggcctgagaaggagtggcccatcaagagcctgaaggtgtacctgggcgtgaagaagaagctgcggccccccacctgctggggcttcaccgtggtgcatgaaacagagaagcatgagaagcagcagtggtacctgtgctgtgacacccagatggagctgcgggagtggtttgccaccttcctgtttgtgcagcatgatggcctggtgtggcccagcgagcccagccgggtgtccagagctgtgcctgaggtgcggctgggctctgtgtccctcatccccctgcggggctctgaaaatgagatgagaagatctgtggccgccttcaccgctgaccccctgagcctgctgagaaatgtgtag

SEQ ID NO: 143991 - DNA, 4320 bp, Artificial Sequence; identical to SEQ ID NO: 143987
  Description of Artificial Sequence: Synthetic coding sequence

SEQ ID NO: 143992 - DNA, 5115 bp, Artificial Sequence
  Description of Artificial Sequence: Synthetic coding sequence
atgagctctgtgtctgaggtgaatgtggacatcaaggacttcctgatgagcatcaacctggagcagtacctgctgcacttccacgagagcggcttcaccaccgtgaaggactgtgccgccatcaatgacagcctgctgcagaagattggcatcagccccaccggccacagaagacgcatcctgaagcagctgcagatcatcctgagcaagatgcaggacatccccatctatgccaacgtgcacaagaccaagaagaatgatgaccccagcaaggactaccacgtgcccagcagtgaccagaacatctgcatcgagctgagcaacagcggctctgtgcagaccagcagccccccccagctggagaccgtgaggaagaacctggaggacagtgatgcctctgtggagaggagccagtacccccagagtgatgacaagctgagcccccccaagagggacttccccacagctgaggagccccacctgaacctgggcagcctgaatgacagcctgtttggaagtgacaacatcaagattgagagcctcatcaccaagaagacagtggaccacacagtggaggagcagcagacagagaaggtgaagctgatcacagagaacctgagcaagctgcccaatgctgacagtgaatgtctgagctttgtgggctgcagcaccagcggcaccaacagcggaaatggcaccaacggcctgctggagggcagcccccccagccccttcttcaagttccagggcgagatgattgtgaatgacctgtatgtgcccagcagccccatcctggcccctgtgcgcagccgcagcaagctggtgtcccggcccagccgctccttcctgctgcggcacaggcctgtgcctgagatccctggcagcaccaagggcgtgtctggcagctacttccgggagaggagaaatgtggccaccagcacagagaagtctgtggcctggcagaacagcaatgaggagaacagcagcagcatcttcccctacggggagaccttcctgttccagaggctggagaacagcaagaagaggagcatcaagaatgagttcctgacccagggcgaggccctgaagggggaggccgccacagccaccaacagcttcatcatcaagagcagcatctatgacaacaggaaggagaagatcagcgaggacaaggtggaggacatctggatcccccgggaggacaagaacaacttcctgattgacacagccagcgagagcgagtacagcacagtggaggagtgcttccagagcctgcggaggaagaacagcaaggccagcaagagcaggacccagaaggccctgatcctggacagcgtgaacagacacagctaccccctgagcagcaccagcggaaatgctgacagcagcgctgtgagcagccaggccatcagcccctatgcctgcttctatggagccagcgccaagaaggtgaagagcggctggctggacaagctgagcccccagggcaagaggatgttccagaagcgctgggtgaagtttgatggcctgagcatctcctactacaacaatgagaaggagatgtacagcaagggcatcatccccctgagcgccatcagcacagtgcgggtgcagggcgacaacaagtttgaggtggtgaccacccagaggacctttgtgttccgggtggagaaggaggaggagagaaatgactggatcagcatcctgctgaatgccctgaagagccagagcctgaccagccagagccaggccgtggtgaccccagagaagtgtggctacctggagctgcggggctacaaggccaagatcttcaccgtgctgagcggcaacagcgtgtggctgtgcaagaatgagcaggacttcaagagcggcctgggcatcaccatcatccccatgaatgtggccaacgtgaagcaggtggacagaacagtgaagcagagctttgagatcatcaccccctaccgctccttctccttcaccgctgagacagagaaggagaagcaggactggattgaagctgtgcagcagagcattgctgagaccctgagtgactatgaggtggccgagaagatctggttcaatgaaagcaacagaagctgtgccgactgcaaggccccagaccctgactgggccagcatcaacctgtgtgtggtgatctgcaagaagtgtgccggccagcacaggagcctgggccccaaggacagcaaggtgcgcagcctgaagatggatgccagcatctggagcaatgaactcatcgagctgttcatcgtcatcggcaacaagagggccaatgacttctgggccggcaacctgcagaaggatgaggagctgcacatggacagccctgtggagaagaggaagaacttcatcacccagaagtacaaggagggcaagttcaggaagaccctgctggccagcctgaccaaggaggagctgaacaaggccctgtgtgccgctgtggtgaagccagatgtgctggagaccatggccctgctcttcagcggggctgatgtgatgtgtgccaccggggaccctgtgcacagcaccccctacctgctggccaagaaggccggccagagcctgcagatggagttcctgtaccacaacaagttcagtgacttcccccagcacgacatccacagcgagggcgtgctgagccaggagagcagccagagcaccttcctgtgtgacttcctgtaccaggcccccagcgctgccagcaagctgagcagcgagaagaagctgctggaggagaccaacaagaagtggtgtgtgctggagggcggcttcctgagctactatgaaaatgacaagagcaccaccccaaatggcaccatcaacatcaatgaagtcatctgcctggccatccacaaggaggacttctacctgaacacaggccccatcttcatctttgagatctacctgcccagcgagagggtcttcctgtttggagctgagaccagccaggcccagaggaagtggacagaggccatcgccaagcactttgtgcccctgtttgctgagaacctgacagaagctgactatgacctgattggccagctgttctacaaggactgccacgccctggaccagtggaggaagggctggtttgccatggacaagagcagcctgcacttctgcctgcagatgcaggaggtgcagggcgacaggatgcacctgcggcggctgcaggagctgaccatcagcaccatggtgcagaatggagagaagctggatgtgctgctgctggtggagaagggccgcaccctgtacatccacggccacaccaagctggacttcaccgtgtggcacacagccatcgagaaggctgctggaacagatggaaatgccctgcaggaccagcagctgagcaagaatgatgtgcccatcatcgtgaacagctgcatcgcctttgtgacccagtatggcctgggctgcaagtacatctaccagaagaatggagaccccctgcacatcagcgagctgctggagagcttcaagaaggatgcccggagcttcaagctgcgggccggcaagcaccagctggaggatgtgacagctgtgctgaagagcttcctgagtgacattgatgatgccctgctgaccaaggagctgtacccctactggatcagcgccctggacacccaggatgacaaggagcgcatcaagaagtatggagccttcatccgcagcctgcccggggtgaacagagccaccctggccgccatcatcgagcacctgtacagagtgcagaagtgcagcgagatcaaccacatgaatgcccacaacctggccctggtgttcagcagctgcctcttccagaccaagggccagaccagcgaggaggtgaatgtgattgaagatctcatcaacaactacgtggagatctttgaggtgaaggaggaccaggtgaagcagatggacatcgagaacagcttcatcaccaagtggaaggacacccaggtgtcccaggccggggacctgctgattgaggtgtatgtggagaggaaggagccagactgcagcatcatcatccgcatcagccctgtgatggaggccgaggagctgaccaatgacatcctggccatcaagaacatcatccccaccaagggggacatctgggccacctttgaggtgattgaaaatgaggagctggagcggcccctgcactacaaggaaaatgtgctggagcaggtgctgcgctggagcagcctggccgagcccggcagcgcctacctggtggtgaagcgcttcctgacagctgacaccatcaagcactgcagcgacaggagcaccctgggcagcatcaaggagggcatcctgaagatcaaggaggagcccagcaagatcctgagcggcaacaagttccaggaccgctactttgtgctgagagatggcttcctgttcctgtacaaggatgtgaagagcagcaagcatgacaagatgttcagcctgagctccatgaagttctacagaggagtgaagaagaagatgaagccacccacctcctggggcctgacagcctacagcgagaagcaccactggcacctgtgctgtgacagcagcaggacccagacagagtggatgaccagcatcttcatcgcccagcatgaatatgacatctggcccccagctgggaaggagaggaagaggagcatcaccaagaaccccaagattggaggcctgcccctcatccccatccagcacgagggcaatgccaccctggccaggaagaacatcgagagcgcccgggcagagctggagcggctgcggctgtctgagaagtgtgacaaggagagcgtggacagcagcctgaaggagcgggcctccatggtggcccactgcctggagcacaaggatgacaagctgaggaaccggcccaggaagcacaggagcttcaactgcctggaggacacagagcctgaggcccccctgggccagcccaagggccacaagggcctgaagaccctgaggaagacagaagatagaaacagcaaggccaccctggacagcgaccacaagctgcccagcagggtcatcgaggagctgaatgtggtgctgcagaggagcaggaccctgcccaaggagctgcaggatgagcagatcctgaagtag

SEQ ID NO: 143993 - DNA, 144 bp, Artificial Sequence
  Description of Artificial Sequence: Synthetic coding sequence
atgagctctgtgtctgaggtgaatgtggacatcaaggacttcctgatgagcatcaacctggagcagtacctgctgcacttccacgagagcggcttcaccaccgtgaaggactgtgccgccatcaatgacagcctgctgcagtag

SEQ ID NO: 143994 - DNA, 3399 bp, Artificial Sequence
  Description of Artificial Sequence: Synthetic coding sequence
atgaggagcagcgccagccggctgagcagcttcagcagccgggacagcctgtggaacaggatgccagaccagatctctgtgtctgagttcatcgccgagaccacagaggactacaacagccccaccaccagcagcttcaccacccggctgcacaactgcaggaacacagtgaccctgctggaggaggccctggaccaggacagaacagccctgcagaaggtgaagaagtctgtgaaggccatctacaacagcggccaggaccacgtgcagaatgaagaaaattatgcccaggtgctggacaagtttggcagcaacttcctgagccgggacaacccagacctgggcacagcctttgtgaagttcagcaccctgaccaaggagctgagcaccctgctgaagaacctgctgcagggcctgagccacaacgtcatcttcaccctggacagcctgctgaagggggacctgaagggcgtgaagggggacctgaagaagccctttgacaaggcctggaaggactatgagaccaagttcaccaagattgagaaggagaagcgggagcacgccaagcagcacggcatgatcagaacagagatcactggagctgagattgctgaggagatggagaaggagaggaggctcttccagctgcagatgtgtgagtacctgatcaaggtgaatgagatcaagaccaagaagggcgtggacctgctgcagaacctgatcaagtactaccacgcccagtgcaacttcttccaggacggcctgaagacagctgacaagctgaagcagtacatcgagaagctggccgctgacctgtacaacatcaagcagacccaggatgaggagaagaagcagctgacagccctgcgggacctgatcaagagcagcctgcagctggaccagaaggaggcccggcaggacagccagagccggcagggcggctacagcatgcaccagctgcagggcaacaaggagtatggcagcgagaagaagggctacctgctgaagaagagtgatggcatcaggaaggtgtggcagaggaggaaatgttctgtgaagaatggcatcctgaccatcagccacgccaccagcaaccggcagcctgccaagctgaacctgctgacctgccaggtgaagcccaatgctgaggacaagaagagctttgacctgatcagccacaacagaacctaccacttccaggccgaggatgagcaggactatgtggcctggatctctgtgctgaccaacagcaaggaggaggccctgaccatggccttccggggggagcagagcgctggggagaacagcctggaggacctgaccaaggccatcattgaagatgtgcagaggctgcctggaaatgacatctgctgtgactgtggcagcagcgagcccacctggctgagcaccaacctgggcatcctgacctgcattgaatgttctggcatccaccgggagatgggcgtgcacatcagccgcatccagagcctggagctggacaagctgggcaccagcgagctgctgctggccaagaatgtgggcaacaacagcttcaatgacatcatggaggccaacctgcccagccccagccccaagcccacccccagcagtgacatgacagtgaggaaggagtacatcacagccaagtatgtggaccaccgcttcagcaggaagacctgcagcaccagcagcgccaagctgaatgagctgctggaggccatcaagagccgggacctgctggccctgatccaggtgtatgcagagggcgtggagctgatggagcccctgctggagcccggccaggagctgggggagacagccctgcacctggccgtgaggacagctgaccagaccagcctgcacctggtggacttcctggtgcagaactgtggcaacctggacaagcagacagccctgggcaacacagtgctgcactactgcagcatgtacagcaagccagagtgcctgaagctgctgctgcggagcaagcccaccgtggacatcgtgaaccaggccggggagacagccctggacatcgccaagaggctgaaggccacccagtgtgaggacctgctgagccaggccaagagcggcaagttcaacccccacgtgcacgtggagtatgagtggaacctgcggcaggaggagattgatgaaagtgatgatgacctggatgacaagcccagccccatcaagaaggagaggagcccccggccccagagcttctgccacagcagcagcatcagcccccaggacaagctggccctgcccggcttcagcaccccccgggacaagcagaggctgtcctatggagccttcaccaaccagatctttgtgtccaccagcacagacagccccaccagccccaccacagaggccccacccctgcccccaagaaatgctgggaagggccccaccggcccccccagcaccctgcccctgagcacccagaccagcagcggcagcagcaccctgagcaagaagaggcctcctcctcctcctcctggccacaagaggaccctgagtgacccccccagccccctgccccacggcccccccaacaagggagctgtgccctggggcaatgatggcggccccagcagcagcagcaagaccaccaacaagtttgagggcctgagccagcagagcagcaccagcagcgccaagacagccctgggcccccgggtgctgcccaagctgccccagaaggtggccctgaggaagacagaccacctgagcctggacaaggccaccatccccccagagatcttccagaagagcagccagctggccgagctgccccagaagcccccacctggggacctgccccccaagcccacagagctggcccccaagccccagattggagacctgccccccaagccaggagagctgccccccaagccccagctgggggacctgccccccaagccccagctgagtgacctgccccccaagccccagatgaaggacctgccccccaagccccagctgggggacctgctggccaagagccagacaggagatgtgagccccaaggcccagcagcccagcgaggtgaccctgaagagccaccccctggacctgagccccaacgtgcagagcagagatgccatccagaagcaggccagcgaggacagcaatgacctgacccccaccctgcctgagacccctgtgcccctgcccaggaagatcaacacaggcaagaacaaggtgagaagagtgaagaccatctatgactgccaggccgacaatgatgatgagctgaccttcatcgagggggaggtgatcatcgtgactggagaggaggaccaggagtggtggattggccacatcgagggccagcctgagaggaaaggagtcttccctgtgtcctttgtgcacatcctgagtgactag

SEQ ID NO: 143995 - DNA, 3390 bp, Artificial Sequence
  Description of Artificial Sequence: Synthetic coding sequence
atgaggagcagcgccagccggctgagcagcttcagcagccgggacagcctgtggaacaggatgccagaccagatctctgtgtctgagttcatcgccgagaccacagaggactacaacagccccaccaccagcagcttcaccacccggctgcacaactgcaggaacacagtgaccctgctggaggaggccctggaccaggacagaacagccctgcagaaggtgaagaagtctgtgaaggccatctacaacagcggccaggaccacgtgcagaatgaagaaaattatgcccaggtgctggacaagtttggcagcaacttcctgagccgggacaacccagacctgggcacagcctttgtgaagttcagcaccctgaccaaggagctgagcaccctgctgaagaacctgctgcagggcctgagccacaacgtcatcttcaccctggacagcctgctgaagggggacctgaagggcgtgaagggggacctgaagaagccctttgacaaggcctggaaggactatgagaccaagttcaccaagattgagaaggagaagcgggagcacgccaagcagcacggcatgatcagaacagagatcactggagctgagattgctgaggagatggagaaggagaggaggctcttccagctgcagatgtgtgagtacctgatcaaggtgaatgagatcaagaccaagaagggcgtggacctgctgcagaacctgatcaagtactaccacgcccagtgcaacttcttccaggacggcctgaagacagctgacaagctgaagcagtacatcgagaagctggccgctgacctgtacaacatcaagcagacccaggatgaggagaagaagcagctgacagccctgcgggacctgatcaagagcagcctgcagctggaccagaaggaggacagccagagccggcagggcggctacagcatgcaccagctgcagggcaacaaggagtatggcagcgagaagaagggctacctgctgaagaagagtgatggcatcaggaaggtgtggcagaggaggaagtgcagcgtgaagaatggcatcctgaccatcagccacgccaccagcaaccggcagcctgccaagctgaacctgctgacctgccaggtgaagcccaatgctgaggacaagaagagctttgacctgatcagccacaacagaacctaccacttccaggctgaagatgagcaggactatgtggcctggatctctgtgctgaccaacagcaaggaggaggccctgaccatggccttccggggggagcagagcgctggggagaacagcctggaggacctgaccaaggccatcattgaagatgtgcagaggctgcctggaaatgacatctgctgtgactgtggcagcagcgagcccacctggctgagcaccaacctgggcatcctgacctgcatcgagtgcagcggcatccaccgggagatgggcgtgcacatcagccgcatccagagcctggagctggacaagctgggcaccagcgagctgctgctggccaagaatgtgggcaacaacagcttcaatgacatcatggaggccaacctgcccagccccagccccaagcccacccccagcagtgacatgacagtgaggaaggagtacatcacagccaagtatgtggaccaccgcttcagcaggaagacctgcagcaccagcagcgccaagctgaatgagctgctggaggccatcaagagccgggacctgctggccctgatccaggtgtatgcagagggcgtggagctgatggagcccctgctggagcccggccaggagctgggggagacagccctgcacctggccgtgaggacagctgaccagaccagcctgcacctggtggacttcctggtgcagaactgtggcaacctggacaagcagacagccctgggcaacacagtgctgcactactgcagcatgtacagcaagccagaatgtctgaagctgctgctgcggagcaagcccaccgtggacatcgtgaaccaggccggggagacagccctggacatcgccaagaggctgaaggccacccagtgtgaggacctgctgagccaggccaagagcggcaagttcaacccccacgtgcacgtggagtatgagtggaacctgcggcaggaggagattgatgaaagtgatgatgacctggatgacaagcccagccccatcaagaaggagaggagcccccggccccagagcttctgccacagcagcagcatcagcccccaggacaagctggccctgcccggcttcagcaccccccgggacaagcagaggctgtcctatggagccttcaccaaccagatctttgtgtccaccagcacagacagccccaccagccccaccacagaggccccacccctgcccccaagaaatgctgggaagggccccactggaccacccagcaccctgcccctgagcacccagaccagcagcggcagcagcaccctgagcaagaagaggcctcctcctcctcctcctggccacaagaggaccctgagtgacccccccagccccctgccccacggcccccccaacaagggagctgtgccctggggcaatgatggcggccccagcagcagcagcaagaccaccaacaagtttgagggcctgagccagcagagcagcaccagcagcgccaagacagccctgggcccccgggtgctgcccaagctgccccagaaggtggccctgaggaagacagaccacctgagcctggacaaggccaccatccccccagagatcttccagaagagcagccagctggccgagctgccccagaagcccccacctggggacctgccccccaagcccacagagctggcccccaagccccagatcggggacctgccccccaagccaggagagctgccccccaagccccagctgggggacctgccccccaagccccagctgagtgacctgccccccaagccccagatgaaggacctgccccccaagccccagctgggggacctgctggccaagagccagacaggagatgtgagccccaaggcccagcagcccagcgaggtgaccctgaagagccaccccctggacctgagccccaacgtgcagagcagagatgccatccagaagcaggccagcgaggacagcaatgacctgacccccaccctgcctgagacccctgtgcccctgcccaggaagatcaacacaggcaagaacaaggtgcggcgggtgaagaccatctatgactgccaggccgacaatgatgatgagctgaccttcattgaaggagaggtgatcatcgtgactggagaggaggaccaggagtggtggattggccacatcgagggccagcctgagaggaagggcgtcttccctgtgtcctttgtgcacatcctgagtgactag

SEQ ID NO: 143996 - DNA, 3390 bp, Artificial Sequence; identical to SEQ ID NO: 143995
  Description of Artificial Sequence: Synthetic coding sequence

SEQ ID NO: 143997 - DNA, 1065 bp, Artificial Sequence
  Description of Artificial Sequence: Synthetic coding sequence
atgagcctgcggggcagcctgagccggctgctgcagaccagggtgcacagcatcctgaagaagtctgtgcacagcgtggccgtgattggagcccccttcagccagggccagaagaggaagggcgtggagcacggccctgctgccatccgggaggccggcctgatgaagaggctgagcagcctgggctgccacctgaaggactttggagacctgtccttcacccctgtgcccaaggatgacctgtacaacaacctgattgtgaaccccaggtctgtgggcctggccaaccaggagctggccgaggtggtgtccagagctgtgtctgatggctacagctgtgtgaccctgggcggggaccacagcctggccatcggcaccatcagcggccacgcccggcactgcccagacctgtgtgtggtgtgggtggatgcccacgccgacatcaacacccccctgaccaccagcagcggcaacctgcacggccagcctgtgtccttcctgctgcgggagctgcaggacaaggtgccccagctgcccggcttctcctggatcaagccctgcatcagcagcgccagcatcgtgtacatcggcctgagagatgtggaccccccagagcacttcatcctgaagaactatgacatccagtacttctccatgagggacatcgaccggctgggcatccagaaggtgatggagaggacctttgacctgctgattggcaagaggcagaggcccatccacctgagctttgatattgatgcctttgaccccaccctggccccagccaccggcacccctgtggtgggcggcctgacctaccgggagggcatgtacatcgccgaggagatccacaacacaggcctgctgagcgccctggacctggtggaggtgaacccccagctggccaccagcgaggaggaggccaagaccacagccaacctggccgtggatgtgattgccagcagctttggccagacccgggagggcggccacatcgtgtatgaccagctgcccacccccagcagcccagatgaaagtgagaaccaggcccgggtgcgcatctag

SEQ ID NO: 143998 - DNA, 207 bp, Artificial Sequence
  Description of Artificial Sequence: Synthetic coding sequence
atgaagctgaatgagaagttcagcgagggctggaggaagcccaatgcctcctggaagagcagctgcagcaagaacagcagtgaccgggacaagctgagcctgccccacaagaagctggagcggggctcctggagggtgtggcagcccaggagcaccctgtgcaggaccctggacaagacagaggaggagcgggccaagcgggagtag

SEQ ID NO: 143999 - DNA, 429 bp, Artificial Sequence
  Description of Artificial Sequence: Synthetic coding sequence
atgaagctgaatgagaagttcagcgagggctggaggaagcccaatgcctcctggaagagcagctgcagcaagaacagcagtgaccgggacaagctgagcctgccccacaagaagctggagcggggctcctggagggtgtggcagcccaggagcaccctgtgcaggaccctggacaagacagaggaggagcgggccaagcgggaggagctggagcgcatcctggaggagaacaacaggaagattgctgaggcccaggccaagctggccgaggagcagctgagaattgtggaggagcagaggaagatccacgaggagaggatgaagctggagcaggagcggcagaggcagcagaaggaggagcagaagatcatcctgggcaagggcaagagccggcccaagctgtccttcagcctgaagacccaggactag

SEQ ID NO: 144000 - DNA, 822 bp, Artificial Sequence
  Description of Artificial Sequence: Synthetic coding sequence
atgggccgcagccgcagccgcagcagcagccgcagcaagcacaccaagagcagcaagcacaacaagaagaggagccgcagccgcagccgcagccgggacaaggagcgggtgaggaagaggagcaagagccgggagagcaagaggaacagaagaagagagagccgcagccgcagccgcagcaccaacacagctgtgtccagaagagagcgggaccgggagcgggccagcagccccccagacagaattgacatctttggaagaacagtgtccaagaggagcagcctggatgagaagcagaagcgggaggaggaggagaagaaggccgagtttgagcggcagaggaagatccggcagcaggagattgaggagaagctgattgaggaggagacagcccggcgggtggaggagctggtggccaagagggtggaggaggagctggagaagaggaaggatgaaattgagcgggaggtgctgcggcgggtggaggaggccaagaggatcatggagaagcagctgctggaggagctggagcggcagaggcaggccgagctggccgcccagaaggcccgggaggaggaggagcgggccaagcgggaggagctggagcgcatcctggaggagaacaacaggaagattgctgaggcccaggccaagctggccgaggagcagctgcgcatcgtggaggagcagaggaagatccacgaggagaggatgaagctggagcaggagcggcagaggcagcagaaggaggagcagaagatcatcctgggcaagggcaagagccggcccaagctgtccttcagcctgaagacccaggactag

SEQ ID NO: 144001 - DNA, 672 bp, Artificial Sequence
  Description of Artificial Sequence: Synthetic coding sequence
atgggccgcagccgcagccgcagcagcagccgcagcaagcacaccaagagcagcaagcacaacaagaagagggccagcagccccccagacagaattgacatctttggaagaacagtgtccaagaggagcagcctggatgagaagcagaagcgggaggaggaggagaagaaggccgagtttgagcggcagaggaagatccggcagcaggagattgaggagaagctgattgaggaggagacagcccggcgggtggaggagctggtggccaagagggtggaggaggagctggagaagaggaaggatgaaattgagcgggaggtgctgcggcgggtggaggaggccaagaggatcatggagaagcagctgctggaggagctggagcggcagaggcaggccgagctggccgcccagaaggcccgggaggtgaccctgggccgcctggagagccgggacagcccctggcagaacttccagtgctgggtgctgcccccagcccagttcaggaagcgctggaacacagactacctgatccccttcagcagcaagctgaacattgctgccaaggtgaacttcctggcctacagcgaggtgctgacagacaacctgaaggtgggcagcttctacaagacctacagccgcatcctgtttgacctgatggagctggccatctag

SEQ ID NO: 144002 - DNA, 495 bp, Artificial Sequence
  Description of Artificial Sequence: Synthetic coding sequence
atgccagacaccatgctgcctgcctgcttcctgggcctgctggccttcagcagcgcctgctacttccagaactgcccccggggcggcaagagggccatgtctgacctggagctgcggcagtgcctgccctgtggccctgggggcaagggccgctgcttcggccccagcatctgctgtgctgatgagctgggctgctttgtgggcacagctgaggccctgcgctgccaggaggagaactacctgcccagcccctgccagagcggccagaaggcctgtggcagcggcggccgctgtgccgcctttggagtgtgctgcaatgatgagagctgtgtgacagagccagaatgtcgggagggcttccaccggcgggcccgggccagtgacaggagcaatgccacccagctggatggccctgctggggccctgctgctgcggctggtgcagctggccggggcccctgagccctttgagcccgcccagccagatgcctactag

SEQ ID NO: 144003 - DNA, 1257 bp, Artificial Sequence
  Description of Artificial Sequence: Synthetic coding sequence
atgaggctgtctgctggcccagatgctggccccagcggcaacagcagcccctggtggcccctggccactggagctggcaacaccagccgggaggccgaggccctgggggagggcaatggacctccaagagatgtgagaaatgaggagctggccaagctggagattgctgtgctggccgtgacctttgctgtggccgtgctgggcaacagctctgtgctgctggccctgcacaggacccccaggaagaccagcaggatgcacctgttcatccgccacctgagcctggccgacctggccgtggccttcttccaggtgctgccccagatgtgctgggacatcacctaccgcttccggggccctgactggctgtgccgggtggtgaagcacctgcaggtgtttggcatgtttgccagcgcctacatgctggtggtgatgacagctgaccgctacatcgctgtgtgccaccccctgaagaccctgcagcagcctgcccggcgcagccggctgatgattgctgctgcctgggtgctgagctttgtgctgagcaccccccagtactttgtgttctccatgattgaggtgaacaacgtgaccaaggcccgggactgctgggccaccttcatccagccctggggcagccgggcctacgtgacctggatgactggaggcatctttgtggcccctgtggtgatcctgggcacctgctacggcttcatctgctacaacatctggtgcaatgtgcggggcaagacagccagccggcagagcaaaggagctgagcaggccggcgtggccttccagaagggcttcctgctggccccctgtgtgtcctctgtgaagagcatcagccgggccaagatcagaacagtgaagatgaccttcgtcatcgtgacagcctacatcgtgtgctgggcccccttcttcatcatccagatgtggagcgtgtgggaccccatgtctgtgtggacagaaagtgagaaccccaccatcaccatcacagccctgctgggcagcctgaacagctgctgcaacccctggatctacatgttcttcagcggccacctgctgcaggactgtgtgcagagcttcccctgctgccagaacatgaaggagaagttcaacaaggaggacacagacagcatgagccggcggcagaccttctacagcaacaacagaagccccaccaacagcacaggcatgtggaaggacagccccaagagcagcaagagcatcaagttcatccctgtgtccacctag

SEQ ID NO: 144004 - DNA, 1275 bp, Artificial Sequence
  Description of Artificial Sequence: Synthetic coding sequence
atggattctggccccctgtgggatgccaaccccaccccccggggcaccctgagcgccccaaatgccaccaccccctggctgggcagagatgaggagctggccaaggtggagattggagtgctggccaccgtgctggtgctggccactggaggcaacctggccgtgctgctgaccctgggccagctgggcaggaagaggagcaggatgcacctgtttgtgctgcacctggccctgacagacctggccgtggccctcttccaggtgctgccccagctgctgtgggacatcacctaccgcttccagggccctgacctgctgtgcagagctgtgaagtacctgcaggtgctgtccatgtttgccagcacctacatgctgctggccatgaccctggaccgctacctggccgtgtgccaccccctgcggagcctgcagcagcccggccagagcacctacctgctgattgctgccccctggctgctggccgccatcttcagcctgccccaggtgttcatcttcagcctgcgggaggtgatccagggcagcggcgtgctggactgctgggccgactttggcttcccctggggcccccgggcctacctgacctggaccaccctggccatctttgtgctgcctgtgaccatgctgacagcctgctacagcctcatctgccacgagatctgcaagaacctgaaggtgaagacccaggcctggagggtgggcggcggcggctggaggacctgggaccggcccagccccagcaccctggccgccaccacccggggcctgcccagccgggtgagcagcatcaacaccatcagccgggccaagatcagaacagtgaagatgaccttcgtcatcgtgctggcctacatcgcctgctgggcccccttcttctctgtgcagatgtggagcgtgtgggacaagaatgccccagatgaggacagcaccaacgtggccttcaccatctccatgctgctgggcaacctgaacagctgctgcaacccctggatctacatgggcttcaacagccacctgctgccccggcccctgcggcacctggcctgctgcggcggcccccagcccaggatgagaagaaggctgagtgatggcagcctgagcagccgccacaccaccctgctgaccaggagcagctgcccagccaccctgagcctgagcctgagcctgaccctgagcggccggcccaggcctgaggagagcccccgggacctggagctggctgatggagagggcacagctgagaccatcatcttctag

SEQ ID NO: 144005 - DNA, 1116 bp, Artificial Sequence
  Description of Artificial Sequence: Synthetic coding sequence
atgctgatggccagcaccaccagcgctgtgcccggccaccccagcctgcccagcctgcccagcaacagcagccaggagcggcccctggacacccgggaccccctgctggcccgggcagagctggccctgctgagcatcgtgtttgtggccgtggccctgagcaatggcctggtgctggccgccctggcccggcggggcagaagaggccactgggcccccatccacgtgttcatcggccacctgtgcctggccgacctggccgtggccctcttccaggtgctgccccagctggcctggaaggccacagaccgcttccggggcccagatgccctgtgcagagctgtgaagtacctgcagatggtgggcatgtatgccagcagctacatgatcctggccatgaccctggacagacaccgggccatctgccggcccatgctggcctaccgccacggcagcggggcccactggaacagacctgtgctggtggcctgggccttcagcctgctgctgagcctgccccagctgttcatctttgcccagagaaatgtggagggcggcagcggcgtgacagactgctgggcctgctttgctgagccctggggccgccgcacctacgtgacctggatcgccctgatggtgtttgtggcccccaccctgggcattgctgcctgccaggtgctgatcttccgggagatccacgccagcctggtgcccggccccagcgagaggcctgggggcagaagaagaggaagaagaacaggcagccctggagagggcgcccacgtgtctgctgctgtggccaagacagtgaggatgaccctggtgattgtggtggtgtatgtgctgtgctgggcccccttcttcctggtgcagctgtgggccgcctgggaccctgaggcccccctggagggcgccccctttgtgctgctgatgctgctggccagcctgaacagctgcaccaacccctggatctatgccagcttcagcagctctgtgagcagcgagctgcggagcctgctgtgctgtgcccggggccgcaccccacccagcctgggcccccaggatgagagctgcaccacagccagcagcagcctggccaaggacaccagcagctag

SEQ ID NO: 144006 - DNA, 1116 bp, Artificial Sequence; identical to SEQ ID NO: 144005
  Description of Artificial Sequence: Synthetic coding sequence

SEQ ID NO: 144007 - DNA, 930 bp, Artificial Sequence
  Description of Artificial Sequence: Synthetic coding sequence
atgctgatggccagcaccaccagcgctgtgcccggccaccccagcctgcccagcctgcccagcaacagcagccaggagcggcccctggacacccgggaccccctgctggcccgggcagagctggccctgctgagcatcgtgtttgtggccgtggccctgagcaatggcctggtgctggccgccctggcccggcggggcagaagaggccactgggcccccatccacgtgttcatcggccacctgtgcctggccgacctggccgtggccctcttccaggtgctgccccagctggcctggaaggccacagaccgcttccggggcccagatgccctgtgcagagctgtgaagtacctgcagatggtgggcatgtatgccagcagctacatgatcctggccatgaccctggacagacaccgggccatctgccggcccatgctggcctaccgccacggcagcggggcccactggaacagacctgtgctggtggcctgggccttcagcctgctgctgagcctgccccagctgttcatctttgcccagagaaatgtggagggcggcagcggcgtgacagactgctgggcctgctttgctgagccctggggccgccgcacctacgtgacctggatcgccctgatggtgtttgtggcccccaccctgggcattgctgcctgccaggtgctgatcttccgggagatccacgccagcctggtgcccggccccagcgagaggcctgggggcagaagaagaggaagaagaacaggcagccctggagagggcgcccacgtgtctgctgctgtggccaagacagtgaggatgaccctggtgattgtggtggtgtatgtgctgtgctgggcccccttcttcctggtgcagctgtgggccgcctgggaccctgaggcccccctggagggcggctgcagccggggctag

SEQ ID NO: 144008 - DNA, 1005 bp, Artificial Sequence
  Description of Artificial Sequence: Synthetic coding sequence
atgggcagaagaagcagtgacacagaggaggagagccgcagcaagaggaagaagaagcacagaagaagaagcagcagcagcagcagcagtgacagcaggacctacagcaggaagaagggcggcaggaagagccgcagcaagagccgctcctggagccgggacctgcagcccaggagccacagctatgacagaagaagaagacacaggagcagcagcagcagcagctatggcagcaggaggaagaggagccgcagccgcagccggggccggggcaagagctacagagtgcagaggagccgcagcaagagcaggacccggcgcagccgcagccggccccggctgcggagccacagccgcagcagcgagaggagcagccacaggaggaccaggagccgcagccgggaccgggagaggaggaagggccgggacaaggagaagcgggagaaggagaaggacaagggcaaggacaaggagctgcacaacatcaagagaggagagagcggcaacatcaaggccggcctggagcacctgcccccagctgagcaggccaaggcccggctgcagctggtgctggaggccgccgccaaggcagatgaggccctgaaggccaaggagagaaatgaggaggaggccaagaggaggaaggaggaggaccaggccaccctggtggagcaggtgaagagggtgaaggagattgaggccattgaaagtgacagctttgtgcagcagaccttccgcagcagcaaggaggtgaagaagtctgtggagcccagcgaggtgaagcaggccaccagcaccagcggccctgccagcgctgtggccgacccccccagcacagagaaggagattgaccccaccagcatccccacagccatcaagtaccaggatgacaacagcctggcccaccccaacctcttcatcgagaaggcagatgctgaggagaagtggttcaagaggctgattgccctgcggcaggagcggctgatgggcagccctgtggcctag

SEQ ID NO: 144009 - DNA, 831 bp, Artificial Sequence
  Description of Artificial Sequence: Synthetic coding sequence
atgggcagaagaagcagtgacacagaggaggagagccgcagcaagaggaagaagaagcacagaagaagaagcagcagcagcagcagcagtgacagcaggacctacagcaggaagaagggcggcaggaagagccgcagcaagagccgctcctggagccgggacctgcagcccaggagccacagctatgacagaagaagaagacacaggagcagcagcagcagcagctatggcagcaggaggaagaggagccgcagccgcagccggggccggggcaagagctacagagtgcagaggagccgcagcaagagcaggacccggcgggagagcggcaacatcaaggccggcctggagcacctgcccccagctgagcaggccaaggcccggctgcagctggtgctggaggccgccgccaaggcagatgaggccctgaaggccaaggagagaaatgaggaggaggccaagaggaggaaggaggaggaccaggccaccctggtggagcaggtgaagagggtgaaggagattgaggccattgaaagtgacagctttgtgcagcagaccttccgcagcagcaaggaggtgaagaagtctgtggagcccagcgaggtgaagcaggccaccagcaccagcggccctgccagcgctgtggccgacccccccagcacagagaaggagattgaccccaccagcatccccacagccatcaagtaccaggatgacaacagcctggcccaccccaacctcttcatcgagaaggcagatgctgaggagaagtggttcaagaggctgattgccctgcggcaggagcggctgatgggcagccctgtggcctag

SEQ ID NO: 144010 - DNA, 831 bp, Artificial Sequence; identical to SEQ ID NO: 144009
  Description of Artificial Sequence: Synthetic coding sequence

SEQ ID NO: 144011 - DNA, 612 bp, Artificial Sequence
  Description of Artificial Sequence: Synthetic coding sequence
atgggcagaagaagcagtgacacagaggaggagagccgcagcaagaggaagaagaagcacagaagaagaagcagcagcagcagcagcagtgacagcaggacctacagcaggaagaagggcggcaggaagagccgcagcaagagccgctcctggagccgggacctgcagcccaggagccacagctatgacagaagaagaagacacaggagcagcagcagcagcagctatggcagcaggaggaagaggagccgcagccgcagccggggccggggcaagagctacagagtgcagaggagccgcagcaagagcaggacccggcgcagccgcagccggccccggctgcggagccacagccgcagcagcgagaggagcagccacaggaggaccaggagccgcagccgggaccgggagaggaggaagggccgggacaaggagaagcgggagaaggagaaggacaagggcaaggacaaggagctgcacaacatcaagagaggagagagcggcaacatcaaggccggcctggagcacctgcccccagctgagcaggccaaggcccggctgcagctggtgctggaggccgccgccaaggcagatgaggccctgaaggcctag

SEQ ID NO: 144012 - DNA, 585 bp, Artificial Sequence
  Description of Artificial Sequence: Synthetic coding sequence
atgggcagaagaagcagtgacacagaggaggagagccgcagcaagaggaagaagaagcacagaagaagaagcagcagcagcagcagcagtgacagcaggacctacagcaggaagaagggcggcaggaagagccgcagcaagagccgctcctggagccgggacctgcagcccaggagccacagctatgacagaagaagaagacacaggagcagcagcagcagcagctatggcagcaggaggaagaggagccgcagccgcagccggggccggggcaagagctacagagtgcagaggagccgcagcaagagcaggacccggcgcagccgcagccggccccggctgcggagccacagccgcagcagcgagaggagcagccacaggaggaccaggagccgcagccgggaccgggagaggaggaagggccgggacaaggagaagcgggagaaggagaaggacaagggcaaggacaaggagctgcacaacatcaagagaggagagagcggcaacatcaaggccggcctggagcacctgcccccagctgagcaggccaaggcccggctgcagctggtgctggaggccgcctag

SEQ ID NO: 144013 - DNA, 1005 bp, Artificial Sequence; identical to SEQ ID NO: 144008
  Description of Artificial Sequence: Synthetic coding sequence

SEQ ID NO: 144014 - DNA, 498 bp, Artificial Sequence
  Description of Artificial Sequence: Synthetic coding sequence
atgggcagaagaagcagtgacacagaggaggagagccgcagcaagaggaagaagaagcacagaagaagaagcagcagcagcagcagcagtgacagcaggacctacagcaggaagaagggcggcaggaagagccgcagcaagagccgctcctggagccgggacctgcagcccaggagccacagctatgacagaagaagaagacacaggagcagcagcagcagcagctatggcagcaggaggaagaggagccgcagccgcagccggggccggggcaagagctacagagtgcagaggagccgcagcaagagcaggacccggcgcagccgcagccggccccggctgcggagccacagccgcagcagcgagaggagcagccacaggaggaccaggagccgcagccgggaccgggagaggaggaagggccgggacaaggagaagcgggagaaggagaaggacaagggcaaggacaaggagctgcacaacatcaagaggggctag

SEQ ID NO: 144015 - DNA, 948 bp, Artificial Sequence
  Description of Artificial Sequence: Synthetic coding sequence
atgaggaacaggatggcccctgagaacccccagcctgaccccttcatcaacagaaactacagcaacatgaaggtgattcctccccaggaccctgccagccccagcttcaccctgctgagcaagctggagtgcagcggcaccgtgtctgcctactgcagcctgaacctgcccggcagcacagacccccccaccagcgccagccgggtggccgccaccacagccatcagaagaagacacaaggagaggaccagcttcacccaccagcagtatgaggagctggaggccctcttcagccagaccatgtttcctgacaggaacctgcaggagaagctggccctgcggctggacctgcctgagagcacagtgaaggtgtggttcaggaacagacgcttcaagctgaagaagcagcagcagcagcagagcgccaagcagaggaaccagatcctgcccagcaagaagaatgtgcccaccagccccaggaccagccccagcccctatgccttcagccctgtgatcagtgacttctacagcagcctgcccagccagcccctggaccccagcaactgggcctggaacagcaccttcacagagagcagcaccagtgacttccagatgcaggacacccagtgggagcggctggtggcctctgtgcctgccctgtacagtgatgcctatgacatcttccagatcatcgagctgtacaacctgcctgatgaaaatgagatcagcagcagcagcttccactgcctgtaccagtacctgagccccaccaagtaccaggtgggcggccagggcagcagcctgagcatctttgctggccctgctgtgggcctgagccctgcccagacctggcccaacatgaccagccaggcctttgaggcctacagcctgacagacagcctggagttccagaagaccagcaacatggtggacctgggcttcctgtag

SEQ ID NO: 144016 - DNA, 4701 bp, Artificial Sequence
  Description of Artificial Sequence: Synthetic coding sequence
atgacagctgacaaggacaaggacaaggacaaggagaaggaccgggaccgggaccgggaccgggagcgggagaagagggacaaggcccgggagagcgagaacagccggccccggcgcagctgcaccctggagggcggggccaagaactatgcagagagtgaccacagtgaagatgaagataatgacaacaacagcgccacagctgaggagagcaccaagaagaacaagaagaagccacccaagaagaagagccgctatgaaagaacagacacaggagagatcaccagctacatcacagaagatgatgtggtgtacagacctggggactgtgtgtacatcgagagccggcggcccaacaccccctacttcatctgcagcatccaggacttcaagctggtgcacaacagccaggcctgctgccgcagccccaccccagccctgtgtgaccccccagcctgcagcctgcctgtggccagccagcccccccagcacctgtctgaggccggccggggccctgtgggcagcaagagggaccacctgctgatgaatgtgaagtggtactaccggcagagcgaggtgcctgacagcgtgtaccagcacctggtgcaggacagacacaatgaaaatgattctggccgggagctggtgatcacagaccccgtcatcaagaaccgggagctgttcatcagtgactatgtggacacctaccacgccgccgccctgcggggcaagtgcaacatcagccacttcagtgacatctttgctgcccgggagttcaaggcccgggtggacagcttcttctacatcctgggctacaaccctgagacccggcggctgaacagcacccagggcgagatccgggtgggccccagccaccaggccaagctgcctgacctgcagcccttccccagcccagatggagacacagtgacccagcacgaggagctggtgtggatgcctggggtgaatgactgtgacctgctgatgtacctgcgggccgcccgctccatggccgcctttgctggcatgtgtgatggcggcagcacagaagatggctgtgtggccgccagcagagatgacaccaccctgaatgccctgaacaccctgcacgagagcggctatgatgctgggaaggccctgcagaggctggtgaagaagcctgtgcccaagctgattgagaagtgctggacagaagatgaggtgaagagatttgtgaagggcctgcggcagtatggcaagaacttcttccgcatcaggaaggagctgctgcccaacaaggagaccggggagctgatcaccttctactactactggaagaagaccccagaggccgccagcagccgggcccacagaagacaccggcggcaggccgtgttccgccgcatcaagaccaggacagccagcacccctgtgaacacccccagcaggcctcccagcagcgagttcctggacctgagcagcgcctctgaagatgactttgattctgaggacagcgagcaggagctgaagggctacgcctgccgccactgcttcaccaccaccagcaaggactggcaccacggcggccgggagaacatcctgctgtgcacagactgccgcatccacttcaagaagtatggagagctgccccccatcgagaagcctgtggaccccccacccttcatgttcaagcctgtgaaggaggaggatgatggcctgagcggcaagcacagcatgaggaccaggaggagccggggctccatgagcaccctgcggagcggcaggaagaagcagcctgccagcccagatggccgcaccagccccatcaatgaagacatccgcagcagtggaagaaacagccccagcgctgccagcaccagcagcaatgacagcaaggccgagaccgtgaagaagagcgccaagaaggtgaaggaggaggccagcagccccctgaagagcaacaagaggcagcgggagaaggtggccagtgacacagaggaggccgacaggaccagcagcaagaagaccaagacccaggagatcagccggcccaacagccccagcgagggggagggggagagcagtgacagccgctctgtgaatgatgagggcagcagtgaccccaaggacatcgaccaggacaacagaagcaccagccccagcatccccagcccccaggacaatgaaagtgacagcgacagcagcgcccagcagcagatgctgcaggcccagcccccagccctgcaggcccccactggagtgaccccagcccccagcagcgcccctcctggcaccccccagctgcccaccccaggccccaccccatctgccacagctgtgcccccccagggcagccccacagccagccaggcccccaaccagccccaggcccccacagcccctgtgccccacacccacatccagcaggccccagccctgcacccccagaggcctcccagcccccaccccccaccccaccccagcccccacccccccctgcagcccctgaccggcagcgctggccagcccagcgcccccagccacgcccagccccccctgcacggccagggccccccaggcccccacagcctgcaggccggccccctgctgcagcaccctggccccccccagcccttcggcctgcccccccaggccagccagggccaggcccccctgggcaccagccctgctgctgcctacccccacaccagcctgcagctgcctgccagccagagcgccctgcagagccagcagcccccccgggagcagcccctgcccccagcccccctggccatgccccacatcaagcccccacccaccacccccatcccccagctgcctgccccccaggcccacaagcaccccccccacctgagcggccccagccccttctccatgaatgccaacctgcccccacctccagccctgaagcccctgagcagcctgagcacccaccacccccccagcgcccaccccccacccctgcagctgatgccccagagccagcccctgcccagcagccctgcccagcccccaggcctgacccagagccagaacctgcccccacctccagccagccaccccccaacaggcctgcaccaggtggccccccagcccccatttgcccagcacccctttgtgcctgggggccccccacccatcaccccacccacctgccccagcaccagcaccccacctgctggccctggcaccagcgcccagcccccctgcagcggggccgccgccagcggcggcagcattgctgggggcagcagctgccccctgcccaccgtgcagatcaaggaggaggccctggatgatgctgaggagcctgagagccccccacctccacccaggagccccagccctgagcccaccgtggtggacacccccagccacgccagccagagcgcccgcttctacaagcacctggaccggggctacaacagctgtgccaggacagacctgtacttcatgcccctggccggcagcaagctggccaagaagcgggaggaggccatcgagaaggccaagcgggaggccgagcagaaggcccgggaggagcgggagcgggagaaggagaaggagaaggagcgggagcgggagcgggagcgggagcgggaggccgagagagctgccaaggccagcagcagcgcccacgagggccgcctgagtgacccccagctgagcggccctggccacatgaggcccagctttgagcccccacccaccaccatcgctgctgtgcccccctacatcggccctgacaccccagccctgcggaccctgtctgaatatgcccggccccacgtgatgagccccaccaacagaaaccaccccttctacatgcccctgaaccccacagaccccctgctggcctaccacatgcctggcctgtacaacgtggaccccaccatccgggagcgggagctgcgggagcgggagatccgggagcgggagatccgggagcgggagctgcgggagaggatgaagccaggctttgaggtgaagcccccagagctggaccccctgcaccctgctgccaaccccatggagcactttgcccggcacagcgccctgaccatccccccaacagctggcccccacccctttgccagcttccaccctggcctgaaccccctggagcgggagcggctggccctggccggcccccagctgcggcctgagatgagctacccagaccggctggccgctgagcgcatccatgctgagaggatggccagcctgaccagtgaccccctggcccggctgcagatgtttaatgtgaccccccaccaccaccagcacagccacatccacagccacctgcacctgcaccagcaggaccccctgcaccagggcagcgctggccctgtgcaccccctggtggaccccctgacagctggcccccacctggcccgcttcccctacccacctggcaccctgcccaaccccctgctgggccagccccctcatgaacatgagatgctgcggcaccctgtgtttggcaccccctacccccgggacctgcccggggccatccccccacccatgtctgctgcccaccagctgcaggccatgcacgcccagagcgctgagctgcagaggctggccatggagcagcagtggctgcacggccacccccacatgcacggcggccacctgcccagccaggaggactactacagccggctgaagaaggagggggacaagcagctgtag

SEQ ID NO: 144017 - DNA, 3897 bp, Artificial Sequence
  Description of Artificial Sequence: Synthetic coding sequence
atggatgaccccttcagcccctgccggcggctgaacagcacccagggcgagatccgggtgggccccagccaccaggccaagctgcctgacctgcagcccttccccagcccagatggagacacagtgacccagcacgaggagctggtgtggatgcctggggtgaatgactgtgacctgctgatgtacctgcgggccgcccgctccatggccgcctttgctggcatgtgtgatggcggcagcacagaagatggctgtgtggccgccagcagagatgacaccaccctgaatgccctgaacaccctgcacgagagcggctatgatgctgggaaggccctgcagaggctggtgaagaagcctgtgcccaagctgattgagaagtgctggacagaagatgaggtgaagagatttgtgaagggcctgcggcagtatggcaagaacttcttccgcatcaggaaggagctgctgcccaacaaggagaccggggagctgatcaccttctactactactggaagaagaccccagaggccgccagcagccgggcccacagaagacaccggcggcaggccgtgttccgccgcatcaagaccaggacagccagcacccctgtgaacacccccagcaggcctcccagcagcgagttcctggacctgagcagcgcctctgaagatgactttgattctgaggacagcgagcaggagctgaagggctacgcctgccgccactgcttcaccaccaccagcaaggactggcaccacggcggccgggagaacatcctgctgtgcacagactgccgcatccacttcaagaagtatggagagctgccccccatcgagaagcctgtggaccccccacccttcatgttcaagcctgtgaaggaggaggatgatggcctgagcggcaagcacagcatgaggaccaggaggagccggggctccatgagcaccctgcggagcggcaggaagaagcagcctgccagcccagatggccgcaccagccccatcaatgaagacatccgcagcagtggaagaaacagccccagcgctgccagcaccagcagcaatgacagcaaggccgagaccgtgaagaagagcgccaagaaggtgaaggaggaggccagcagccccctgaagagcaacaagaggcagcgggagaaggtggccagtgacacagaggaggccgacaggaccagcagcaagaagaccaagacccaggagatcagccggcccaacagccccagcgagggggagggggagagcagtgacagccgctctgtgaatgatgagggcagcagtgaccccaaggacatcgaccaggacaacagaagcaccagccccagcatccccagcccccaggacaatgaaagtgacagcgacagcagcgcccagcagcagatgctgcaggcccagcccccagccctgcaggcccccactggagtgaccccagcccccagcagcgcccctcctggcaccccccagctgcccaccccaggccccaccccatctgccacagctgtgcccccccagggcagccccacagccagccaggcccccaaccagccccaggcccccacagcccctgtgccccacacccacatccagcaggccccagccctgcacccccagaggcctcccagcccccaccccccaccccaccccagcccccacccccccctgcagcccctgaccggcagcgctggccagcccagcgcccccagccacgcccagccccccctgcacggccagggccccccaggcccccacagcctgcaggccggccccctgctgcagcaccctggccccccccagcccttcggcctgcccccccaggccagccagggccaggcccccctgggcaccagccctgctgctgcctacccccacaccagcctgcagctgcctgccagccagagcgccctgcagagccagcagcccccccgggagcagcccctgcccccagcccccctggccatgccccacatcaagcccccacccaccacccccatcccccagctgcctgccccccaggcccacaagcaccccccccacctgagcggccccagccccttctccatgaatgccaacctgcccccacctccagccctgaagcccctgagcagcctgagcacccaccacccccccagcgcccaccccccacccctgcagctgatgccccagagccagcccctgcccagcagccctgcccagcccccaggcctgacccagagccagaacctgcccccacctccagccagccaccccccaacaggcctgcaccaggtggccccccagcccccatttgcccagcacccctttgtgcctgggggccccccacccatcaccccacccacctgccccagcaccagcaccccacctgctggccctggcaccagcgcccagcccccctgcagcggggccgccgccagcggcggcagcattgctgggggcagcagctgccccctgcccaccgtgcagatcaaggaggaggccctggatgatgctgaggagcctgagagccccccacctccacccaggagccccagccctgagcccaccgtggtggacacccccagccacgccagccagagcgcccgcttctacaagcacctggaccggggctacaacagctgtgccaggacagacctgtacttcatgcccctggccggcagcaagctggccaagaagcgggaggaggccatcgagaaggccaagcgggaggccgagcagaaggcccgggaggagcgggagcgggagaaggagaaggagaaggagcgggagcgggagcgggagcgggagcgggaggccgagagagctgccaaggccagcagcagcgcccacgagggccgcctgagtgacccccagctgagcggccctggccacatgaggcccagctttgagcccccacccaccaccatcgctgctgtgcccccctacatcggccctgacaccccagccctgcggaccctgtctgaatatgcccggccccacgtgatgagccccaccaacagaaaccaccccttctacatgcccctgaaccccacagaccccctgctggcctaccacatgcctggcctgtacaacgtggaccccaccatccgggagcgggagctgcgggagcgggagatccgggagcgggagatccgggagcgggagctgcgggagaggatgaagccaggctttgaggtgaagcccccagagctggaccccctgcaccctgctgccaaccccatggagcactttgcccggcacagcgccctgaccatccccccaacagctggcccccacccctttgccagcttccaccctggcctgaaccccctggagcgggagcggctggccctggccggcccccagctgcggcctgagatgagctacccagaccggctggccgctgagcgcatccatgctgagaggatggccagcctgaccagtgaccccctggcccggctgcagatgtttaatgtgaccccccaccaccaccagcacagccacatccacagccacctgcacctgcaccagcaggaccccctgcaccagggcagcgctggccctgtgcaccccctggtggaccccctgacagctggcccccacctggcccgcttcccctacccacctggcaccctgcccaaccccctgctgggccagccccctcatgaacatgagatgctgcggcaccctgtgtttggcaccccctacccccgggacctgcccggggccatccccccacccatgtctgctgcccaccagctgcaggccatgcacgcccagagcgctgagctgcagaggctggccatggagcagcagtggctgcacggccacccccacatgcacggcggccacctgcccagccaggaggactactacagccggctgaagaaggagggggacaagcagctgtag

SEQ ID NO: 144018 - DNA, 4701 bp, Artificial Sequence; identical to SEQ ID NO: 144016
  Description of Artificial Sequence: Synthetic coding sequence

SEQ ID NO: 144019 - DNA, 3039 bp, Artificial Sequence
  Description of Artificial Sequence: Synthetic coding sequence
atgttcaagcctgtgaaggaggaggatgatggcctgagcggcaagcacagcatgaggaccaggaggagccggggctccatgagcaccctgcggagcggcaggaagaagcagcctgccagcccagatggccgcaccagccccatcaatgaagacatccgcagcagtggaagaaacagccccagcgctgccagcaccagcagcaatgacagcaaggccgagaccgtgaagaagagcgccaagaaggtgaaggaggaggccagcagccccctgaagagcaacaagaggcagcgggagaaggtggccagtgacacagaggaggccgacaggaccagcagcaagaagaccaagacccaggagatcagccggcccaacagccccagcgagggggagggggagagcagtgacagccgctctgtgaatgatgagggcagcagtgaccccaaggacatcgaccaggacaacagaagcaccagccccagcatccccagcccccaggacaatgaaagtgacagcgacagcagcgcccagcagcagatgctgcaggcccagcccccagccctgcaggcccccactggagtgaccccagcccccagcagcgcccctcctggcaccccccagctgcccaccccaggccccaccccatctgccacagctgtgcccccccagggcagccccacagccagccaggcccccaaccagccccaggcccccacagcccctgtgccccacacccacatccagcaggccccagccctgcacccccagaggcctcccagcccccaccccccaccccaccccagcccccacccccccctgcagcccctgaccggcagcgctggccagcccagcgcccccagccacgcccagccccccctgcacggccagggccccccaggcccccacagcctgcaggccggccccctgctgcagcaccctggccccccccagcccttcggcctgcccccccaggccagccagggccaggcccccctgggcaccagccctgctgctgcctacccccacaccagcctgcagctgcctgccagccagagcgccctgcagagccagcagcccccccgggagcagcccctgcccccagcccccctggccatgccccacatcaagcccccacccaccacccccatcccccagctgcctgccccccaggcccacaagcaccccccccacctgagcggccccagccccttctccatgaatgccaacctgcccccacctccagccctgaagcccctgagcagcctgagcacccaccacccccccagcgcccaccccccacccctgcagctgatgccccagagccagcccctgcccagcagccctgcccagcccccaggcctgacccagagccagaacctgcccccacctccagccagccaccccccaacaggcctgcaccaggtggccccccagcccccatttgcccagcacccctttgtgcctgggggccccccacccatcaccccacccacctgccccagcaccagcaccccacctgctggccctggcaccagcgcccagcccccctgcagcggggccgccgccagcggcggcagcattgctgggggcagcagctgccccctgcccaccgtgcagatcaaggaggaggccctggatgatgctgaggagcctgagagccccccacctccacccaggagccccagccctgagcccaccgtggtggacacccccagccacgccagccagagcgcccgcttctacaagcacctggaccggggctacaacagctgtgccaggacagacctgtacttcatgcccctggccggcagcaagctggccaagaagcgggaggaggccatcgagaaggccaagcgggaggccgagcagaaggcccgggaggagcgggagcgggagaaggagaaggagaaggagcgggagcgggagcgggagcgggagcgggaggccgagagagctgccaaggccagcagcagcgcccacgagggccgcctgagtgacccccagctgagcggccctggccacatgaggcccagctttgagcccccacccaccaccatcgctgctgtgcccccctacatcggccctgacaccccagccctgcggaccctgtctgaatatgcccggccccacgtgatgagccccaccaacagaaaccaccccttctacatgcccctgaaccccacagaccccctgctggcctaccacatgcctggcctgtacaacgtggaccccaccatccgggagcgggagctgcgggagcgggagatccgggagcgggagatccgggagcgggagctgcgggagaggatgaagccaggctttgaggtgaagcccccagagctggaccccctgcaccctgctgccaaccccatggagcactttgcccggcacagcgccctgaccatccccccaacagctggcccccacccctttgccagcttccaccctggcctgaaccccctggagcgggagcggctggccctggccggcccccagctgcggcctgagatgagctacccagaccggctggccgctgagcgcatccatgctgagaggatggccagcctgaccagtgaccccctggcccggctgcagatgtttaatgtgaccccccaccaccaccagcacagccacatccacagccacctgcacctgcaccagcaggaccccctgcaccagggcagcgctggccctgtgcaccccctggtggaccccctgacagctggcccccacctggcccgcttcccctacccacctggcaccctgcccaaccccctgctgggccagccccctcatgaacatgagatgctgcggcaccctgtgtttggcaccccctacccccgggacctgcccggggccatccccccacccatgtctgctgcccaccagctgcaggccatgcacgcccagagcgctgagctgcagaggctggccatggagcagcagtggctgcacggccacccccacatgcacggcggccacctgcccagccaggaggactactacagccggctgaagaaggagggggacaagcagctgtag

SEQ ID NO: 144020 - DNA, 1953 bp, Artificial Sequence
  Description of Artificial Sequence: Synthetic coding sequence
atggccagcggggagcacagccctggcagcggggccgcccggcggcccctgcacagcgcccaggccgtggatgtggccagcgccagcaacttccgggcctttgagctgctgcacctgcacctggacctgcgggcagagtttggacctcctggccctggggccggcagccggggcctgagcggcacagctgtgctggacctgcgctgcctggagcctgagggcgctgctgagctgcggctggacagccacccctgcctggaggtgacagctgctgccctgcggcgggagcggcccggcagcgaggagcccccagctgagcctgtgtccttctacacccagcccttcagccactacggccaggccctgtgtgtgtccttcccccagccctgcagagctgctgagcggctgcaggtgctgctgacctacagagtgggggagggccctggggtgtgctggctggcccctgagcagacagctgggaagaagaagccctttgtgtacacccagggccaggccgtgctgaacagagccttcttcccctgctttgacaccccagctgtgaagtacaagtacagcgccctgattgaggtgcctgatggcttcaccgctgtgatgtctgccagcacctgggagaagaggggccccaacaagttcttcttccagatgtgccagcccatccccagctacctgattgccctggccatcggggacctggtgtctgctgaggtgggccccaggagccgggtgtgggccgagccctgcctgattgatgctgccaaggaggagtacaacggggtgattgaggagttcctggccactggagagaagctgtttggcccctacgtgtggggccgctatgacctgctcttcatgccacccagcttcccctttggaggcatggagaacccctgcctgacctttgtgaccccctgcctgctggccggggacaggagcctggctgatgtgatcatccacgagatcagccacagctggtttggaaacctggtgaccaatgccaactggggcgagttctggctgaatgaaggcttcaccatgtatgcccagaggcgcatcagcaccatcctgtttggagctgcctacacctgcctggaggccgccaccggccgggccctgctgcggcagcacatggacatcaccggggaggagaaccccctgaacaagctgcgggtgaagattgagcccggggtggaccctgatgacacctacaatgagaccccctatgagaagggcttctgctttgtgtcctacctggcccacctggtgggggaccaggaccagtttgacagcttcctgaaggcctacgtgcatgagttcaagttccgcagcatcctggctgatgacttcctggacttctacctggagtacttccctgagctgaagaagaagagggtggacatcatccctggctttgaatttgaccgctggctgaacaccccaggctggccaccctacctgcctgacctgagccctggggacagcctgatgaagccagctgaggagctggcccagctgtgggccgctgaggagctggacatgaaggccatcgaggccgtggccatcagcccctggaagacctaccagctggtgtacttcctggacaagatcctgcagaagagccccctgcccccaggaaatgtgaagaagctgggggacacctaccccagcatcagcaatgccagaaatgctgagctgcggctgcgctggggccagatcgtgctgaagaatgaccaccaggaggacttctggaaggtgaaggagttcctgcacaaccagggcaagcagaagtacaccctgcccctgtaccacgccatgatgggcggcagcgaggtggcccagaccctggccaaggagacctttgccagcacagccagccagctgcacagcaatgtggtgaactacgtgcagcagatcgtggcccccaagggcagctag

SEQ ID NO: 144021 - DNA, 1836 bp, Artificial Sequence
  Description of Artificial Sequence: Synthetic coding sequence
atggccagcggggagcacagccctggcagcggggccgcccggcggcccctgcacagcgcccaggccgtggatgtggccagcgccagcaacttccgggcctttgagctgctgcacctgcacctggacctgcgggcagagtttggacctcctggccctggggccggcagccggggcctgagcggcacagctgtgctggacctgcgctgcctggagcctgagggcgctgctgagctgcggctggacagccacccctgcctggaggtgacagctgctgccctgcggcgggagcggcccggcagcgaggagcccccagctgagcctgtgtccttctacacccagcccttcagccactacggccaggccctgtgtgtgtccttcccccagccctgcagagctgctgagcggctgcaggtgctgctgacctacagagtgggggagggccctggggtgtgctggctggcccctgagcagacagctgggaagaagaagccctttgtgtacacccagggccaggccgtgctgaacagagccttcttcccctgctttgacaccccagctgtgaagtacaagtacagcgccctgattgaggtgcctgatggcttcaccgctgtgatgtctgccagcacctgggagaagaggggccccaacaagttcttcttccagatgtgccagcccatccccagctacctgattgccctggccatcggggacctggtgtctgctgaggtgggccccaggtatgacctgctcttcatgcctccttccttcccctttggaggcatggagaacccctgcctgacctttgtgaccccctgcctgctggccggggacaggagcctggctgatgtgatcatccacgagatcagccacagctggtttggaaacctggtgaccaatgccaactggggcgagttctggctgaatgaaggcttcaccatgtatgcccagaggcgcatcagcaccatcctgtttggagctgcctacacctgcctggaggccgccaccggccgggccctgctgcggcagcacatggacatcactggagaggagaaccccctgaacaagctgcgggtgaagattgagcccggggtggaccctgatgacacctacaatgagaccccctatgagaagggcttctgctttgtgtcctacctggcccacctggtgggggaccaggaccagtttgacagcttcctgaaggcctacgtgcatgagttcaagttccgcagcatcctggctgatgacttcctggacttctacctggagtacttccctgagctgaagaagaagagggtggacatcatccctggctttgaatttgaccgctggctgaacaccccaggctggccaccctacctgcctgacctgagccctggggacagcctgatgaagccagctgaggagctggcccagctgtgggccgctgaggagctggacatgaaggccattgaagctgtggccatcagcccctggaagacctaccagctggtgtacttcctggacaagatcctgcagaagagccccctgcccccaggaaatgtgaagaagctgggggacacctaccccagcatcagcaatgccagaaatgctgagctgcggctgcgctggggccagatcgtgctgaagaatgaccaccaggaggacttctggaaggtgaaggagttcctgcacaaccagggcaagcagaagtacaccctgcccctgtaccacgccatgatgggcggcagcgaggtggcccagaccctggccaaggagacctttgccagcacagccagccagctgcacagcaatgtggtgaactacgtgcagcagatcgtggcccccaagggcagctag

SEQ ID NO: 144022 - DNA, 1035 bp, Artificial Sequence
  Description of Artificial Sequence: Synthetic coding sequence
atgacctgctgcagctgcaccagcctgagcgccctgctggacttctgggccgaggtgtgctggctggcccctgagcagacagctgggaagaagaagccctttgtgtacacccagggccaggccgtgctgaacagagccttcttcccctgctttgacaccccagctgtgaagtacaagtacagcgccctgattgaggtgcctgatggcttcaccgctgtgatgtctgccagcacctgggagaagaggggccccaacaagttcttcttccagatgtgccagcccatccccagctacctgattgccctggccatcggggacctggtgtctgctgaggtgggccccaggagccgggtgtgggccgagccctgcctgattgatgctgccaaggaggagtacaatggagtcatcgaggagttcctggccaccggggagaagctgtttggcccctacgtgtggggccgctatgacctgctcttcatgcctccttccttcccctttggaggcatggagaacccctgcctgacctttgtgaccccctgcctgctggccggggacaggagcctggctgatgtgatcatccacgagatcagccacagctggtttggaaacctggtgaccaatgccaactggggcgagttctggctgaatgaaggcttcaccatgtatgcccagaggcgcatcagcaccatcctgtttggagctgcctacacctgcctggaggccgccaccggccgggccctgctgcggcagcacatggacatcactggagaggagaaccccctgaacaagctgcgggtgaagattgagcccggggtggaccctgatgacacctacaatgagaccccctatgagaagggcttctgctttgtgtcctacctggcccacctggtgggggaccaggaccagtttgacagcttcctgaaggcctacgtgcatgagttcaagttccgcagcatcctggctgatgacttcctggacttctacctggagtacttccctgagctgaagaagaagagggtggacatcatcccctag

SEQ ID NO: 144023 - DNA, 507 bp, Artificial Sequence
  Description of Artificial Sequence: Synthetic coding sequence
ctcattgatgctgccaaggaggagtacaacggggtgattgaggagttcctggccactggagagaagctgtttggcccctacgtgtggggccgctatgacctgctcttcatgccacccagcttcccctttggaggcatggagaacccctgcctgacctttgtgaccccctgcctgctggccggggacaggagcctggctgatgtgatcatccacgagatcagccacagctggtttggaaacctggtgaccaatgccaactggggcgagttctggctgaatgaaggcttcaccatgtatgcccagaggcgcatcagcaccatcctgtttggagtggaccctgatgacacctacaatgagaccccctatgagaagggcttctgctttgtgtcctacctggcccacctggtgggggaccaggaccagtttgacagcttcctgaaggcctacgtgcatgagttcaagttccgcagcatcctggctgatgacttcctggacttctacctgtag

SEQ ID NO: 144024 - DNA, 1485 bp, Artificial Sequence
  Description of Artificial Sequence: Synthetic coding sequence
atgtctgccaccaggtctgcctacatggaggaggagggcgtcttccacttccacatggagcaccctgtgcctgcctacctggtggccctggtggccggggacctgaagccagctgacatcggccccaggagccgggtgtgggccgagccctgcctgctgcccacagccaccagcaagctgtctggagctgtggagcagtggctgtctgctgctgagcggctgtatggcccctacatgtggggccgctatgacatcgtgttcctgcccccatccttccccatcgtggccatggagaacccctgcctgaccttcatcatcagcagcatcctggagagtgatgagttcctggtgattgatgtgatccacgaggtggcccacagctggtttggaaatgctgtgaccaatgccacctgggaggagatgtggctgtctgagggcctggccacctacgcccagaggcgcatcaccacagagacctacggggccgccttcacctgcctggagacagccttccggctggatgccctgcaccggcagatgaagctgctgggggaggacagccctgtgtccaagctgcaggtgaagctggagcccggggtgaaccccagccacctgatgaacctcttcacctatgagaagggctactgctttgtgtactacctgagccagctgtgtggggacccccagagatttgatgacttcctgcgggcctacgtggagaagtacaagttcacctctgtggtggcccaggacctgctggacagcttcctgtccttcttccctgagctgaaggagcagagcgtggactgccgggccggcctggagtttgagcgctggctgaatgccactggaccacccctggccgagccagacctgagccagggcagcagcctgaccaggcctgtggaggccctcttccagctgtggacagctgagcccctggaccaggccgccgccagcgccagcgccatcgacatcagcaagtggaggaccttccagacagccctcttcctggaccggctgctggatggcagccccctgccccaggaggtggtgatgagcctgagcaagtgctacagcagcctgctggacagcatgaatgctgagatccgcatccgctggctgcagatcgtggtgagaaatgactactacccagacctgcaccgggtgcggcgcttcctggagagccagatgagcaggatgtacaccatccccctgtatgaggacctgtgcaccggggccctgaagagctttgccctggaggtgttctaccagacccagggccgcctgcaccccaacctgcggcgggccatccagcagatcctgagccagggcctgggcagcagcacagagcccgccagcgagcccagcacagagctgggcaaggccgaggccgacacagacagtgatgcccaggccctgctgctgggagatgaggcccccagcagcgccatcagcctgagagatgtgaatgtgtctgcctag

SEQ ID NO: 144025 - DNA, 1236 bp, Artificial Sequence
  Description of Artificial Sequence: Synthetic coding sequence
atggaggtgaacccccccaagcaggagcacctgctggccctgaaggtgatgaggctgaccaagcccaccctcttcaccaacatccctgtgacctgtgaggagaaggacctgcccggggacctcttcaaccagctgatgagagatgaccccagcacagtgaatggagctgaggtgctgatgctgggggagatgctgaccctgccccagaactttggaaacatcttcctgggggagaccttcagcagctacatctctgtgcacaatgacagcaaccaggtggtgaaggacatcctggtgaaggctgacctgcagaccagcagccagaggctgaacctgagcgccagcaatgctgctgtggccgagctgaagccagactgctgcattgatgatgtgatccaccacgaggtgaaggagatcggcacccacatcctggtgtgtgctgtgtcctacaccacccaggccggggagaagatgtacttcaggaagttcttcaagttccaggtgctgaagcccctggatgtgaagaccaagttctacaatgctgagacagatgaggtgttcctggaggcccagatccagaacatgaccaccagccccatgttcatggagaaggtgtccctggagcccagcatcatgtacaacgtgacagagctgaacagcgtgtcccaggccggggagtgtgtgtccaccttcggcagccgggcctacctgcagcccatggacacccggcagtacctgtactgcctgaagcccaagaatgaatttgctgagaaggccggcatcatcaagggcgtgaccgtcatcggcaagctggacatcgtgtggaagaccaacctgggggagcggggccgcctgcagaccagccagctgcagaggatggcccctggctatggagatgtgcggctgagcctggaggccatcccagacacagtgaacctggaggagcccttccacatcacctgcaagatcaccaactgcagcgagaggaccatggacctggtgctggagatgtgcaacaccaacagcatccactggtgtggcatcagcggccggcagctgggcaagctgcaccccagcagcagcctgtgcctggccctgaccctgctgagctctgtgcagggcctgcagagcatcagcggcctgcggctgacagacaccttcctgaagaggacctatgaatatgatgacatcgcccaggtgtgtgtggtgtcctctgccatcaaggtggagagctag

SEQ ID NO: 144026 - DNA, 1365 bp, Artificial Sequence
  Description of Artificial Sequence: Synthetic coding sequence
atgcacgtgggccacctgcggagcaccatcattggagagagcatcagccggctgtttgaatttgctggctatgatgtgctgcggctgaaccacgtgggggactggggcacccagtttggcatgctgattgcccacctgcaggacaagttcccagactacctgactgtgagcccccccatcggggacctgcaggtgttctacaaggagagcaagaagagatttgacacagaggaggagttcaagaagagggcctaccagtgtgtggtgctgctgcagggcaagaacccagacatcaccaaggcctggaagctgatctgtgatgtgtcccggcaggagctgaacaagatctatgatgccctggatgtgtccctgattgagcggggggagagcttctaccaggacaggatgaatgacatcgtgaaggagtttgaggaccggggctttgtgcaggtggatgatggcaggaagatcgtgtttgtgcccggctgcagcatccccctgaccatcgtgaagagtgatggcggctacacctatgacaccagtgacctggccgccatcaagcagaggctgtttgaggagaaggctgacatgatcatctacgtggtggacaatggccagagcgtgcacttccagaccatctttgctgctgcccagatgattggctggtatgaccccaaggtgaccagggtcttccacgccggctttggagtggtgctgggggaggacaagaagaagttcaagaccaggtctggagaaacagtgcggctgatggacctgctgggggagggcctgaagaggtccatggacaagctgaaggagaaggagcgggacaaggtgctgacagctgaggagctgaatgctgcccagacctctgtggcctacggctgcatcaagtatgctgacctgagccacaaccggctgaatgactacatcttctcctttgacaagatgctggatgaccggggcaacacagctgcctacctgctgtatgccttcacccgcatccgcagcatcgcccggctggccaacattgatgaggagatgctgcagaaggccgcccgggagaccaagatcctgctggaccacgagaaggagtggaagctgggccgctgcatcctgcgcttccctgagatcctgcagaagatcctggatgacctcttcctgcacaccctgtgtgactacatctatgagctggccacagccttcacagagttctatgacagctgctactgtgtggagaaggaccggcagacaggcaagatcctgaaggtgaacatgtggaggatgctgctgtgtgaggccgtggccgctgtgatggccaagggctttgacatcctgggcatcaagcctgtgcagaggatgtag

SEQ ID NO: 144027 - DNA, 618 bp, Artificial Sequence
  Description of Artificial Sequence: Synthetic coding sequence
ttccagagcgtggagagcagcaccaggaagctggaccacatcaacatctgcagcagcaacttccccaagaggagctttgccctggtgacccaggccggcgtgcagtggcacaacctggacagcctgcagagccccccacctggcttcaagcgcttcccctgcctgagcctgcccagctcctgggactgccgggaggtggccgacttccagctgtctgtggacagcctgctggagaaggacaatgaccacagcaggccagacatccaggtgcaggccaagaggctggccgagaagctgcgctgtgacacagtggtgtctgagatcagcacaggccagaggacagtgaacttcaagatcaaccgggagctgctgaccaagacagtgctgcagcaggtgattgaagatggcagcaaatatggcctgaagtctgagctgttcagcggcctgccccagaagaagatcgtggtggagttcagcagccccaacgtggccaagaagttccacgtgggccacctgcggagcaccatcatcggcaacttcatcgccaacctgaaggaggccctgggccaccaggtgatccgcatcaactacctgggggactggggcatgcagttctag

SEQ ID NO: 144028 - DNA, 1737 bp, Artificial Sequence
  Description of Artificial Sequence: Synthetic coding sequence
atggcctgtggcttccggcgggccatcgcctgccagctgagccgggtgctgaacctgcccccagagaacctgatcaccagcatctctgctgtgcccatcagccagaaggaggaggtggccgacttccagctgtctgtggacagcctgctggagaaggacaatgaccacagcaggccagacatccaggtgcaggccaagaggctggccgagaagctgcgctgtgacacagtggtgtctgagatcagcacaggccagaggacagtgaacttcaagatcaaccgggagctgctgaccaagacagtgctgcagcaggtgattgaagatggcagcaaatatggcctgaagtctgagctgttcagcggcctgccccagaagaagatcgtggtggagttcagcagccccaacgtggccaagaagttccacgtgggccacctgcggagcaccatcatcggcaacttcatcgccaacctgaaggaggccctgggccaccaggtgatccgcatcaactacctgggggactggggcatgcagtttggcctgctgggcaccggcttccagctgtttggctatgaggagaagctgcagagcaaccccctgcagcacctgtttgaggtgtatgtgcaggtgaacaaggaggccgcagatgacaagtctgtggccaaggccgcccaggagttcttccagaggctggagctgggagatgtgcaggccctgagcctgtggcagaagttccgggacctgagcattgaggagtacatccgggtgtacaagaggctgggcgtgtactttgatgagtacagcggggagagcttctaccgggagaagagccaggaggtgctgaagctgctggagagcaagggcctgctgctgaagaccatcaagggcacagctgtggtggacctgtctggaaatggagaccccagcagcatctgcaccgtgatgagaagtgatggcaccagcctgtatgccacccgggacctggccgccgccatcgacaggatggacaagtacaactttgacaccatgatctacgtgacagacaagggccagaagaagcacttccagcaggtgttccagatgctgaagatcatgggctatgactgggccgagcgctgccagcacgtgccctttggagtggtgcagggcatgaagaccaggagaggagatgtgaccttcctggaggatgtgctgaatgagatccagctgaggatgctgcagaacatggccagcatcaagaccaccaaggagctgaagaacccccaggagacagctgagcgggtgggcctggccgccctgatcatccaggacttcaagggcctgctgctgagtgactacaagttctcctgggacagagtcttccagagcagaggagacacaggagtcttcctgcagtacacccacgcccggctgcacagcctggaggagaccttcggctgcggctacctgaatgacttcaacacagcctgcctgcaggagccccagagcgtgtccatcctgcagcacctgctgcgctttgatgaggtgctgtacaagagcagccaggacttccagcccaggcacatcgtgtcctacctgctgaccctgagccacctggccgctgtggcccacaagaccctgcagatcaaggacagccccccagaggtggccggggcccggctgcacctgttcaaggctgtgcgctctgtgctggccaacggcatgaagctgctgggcatcacccctgtgtgcaggatgtag

SEQ ID NO: 144029 - DNA, 621 bp, Artificial Sequence
  Description of Artificial Sequence: Synthetic coding sequence
tgattccagagcgtggagagcagcaccaggaagctggaccacatcaacatctgcagcagcaacttccccaagaggagctttgccctggtgacccaggccggcgtgcagtggcacaacctggacagcctgcagagccccccacctggcttcaagcgcttcccctgcctgagcctgcccagctcctgggactgccgggaggtggccgacttccagctgtctgtggacagcctgctggagaaggacaatgaccacagcaggccagacatccaggtgcaggccaagaggctggccgagaagctgcgctgtgacacagtggtgtctgagatcagcacaggccagaggacagtgaacttcaagatcaaccgggagctgctgaccaagacagtgctgcagcaggtgattgaagatggcagcaaatatggcctgaagtctgagctgttcagcggcctgccccagaagaagatcgtggtggagttcagcagccccaacgtggccaagaagttccacgtgggccacctgcggagcaccatcatcggcaacttcatcgccaacctgaaggaggccctgggccaccaggtgatccgcatcaactacctgggggactggggcatgcagttctag

SEQ ID NO: 144030 - DNA, 1482 bp, Artificial Sequence
  Description of Artificial Sequence: Synthetic coding sequence
atgtctgtggacatgaacagccagggcagtgacagcaatgaagaagattatgaccccaactgtgaggaggaggaggaggaggaggaggatgaccccggggacatcgaggactactacgtgggcgtggccagtgatgtggagcagcagggcgcagatgcctttgatcctgaggagtaccagttcacctgcctgacctacaaggagagcgagggcgccctgaatgagcacatgaccagcctggcctctgtgctgaaggtgagccacagcgtggccaagctgatcctggtgaacttccactggcaggtgtctgagatcctggaccgctacaagagcaacagcgcccagctgctggtggaggcccgggtgcagcccaaccccagcaagcacgtgcccaccagccaccccccccaccactgtgctgtgtgcatgcagtttgtgaggaaagaaaacctgctgagcctggcctgccagcaccagttctgccgcagctgctgggagcagcactgcagcgtgctggtgaaggatggagtgggcgtgggcgtgtcctgcatggcccaggactgccccctgcggaccccagaggactttgtgttccccctgctgcccaatgaggagctgcgggagaagtaccgccgctacctgttccgggactatgtggagagccactaccagctgcagctgtgccctggagctgactgccccatggtgatccgggtgcaggagccccgggccaggagagtgcagtgcaaccgctgcaatgaggtgttctgcttcaagtgccggcagatgtaccacgcccccacagactgtgccaccatcaggaagtggctgaccaagtgtgctgatgacagcgagacagccaactacatcagcgcccacaccaaggactgccccaagtgcaacatctgcatcgagaagaatggaggctgcaaccacatgcagtgcagcaagtgcaagcatgacttctgctggatgtgcctgggggactggaagacccacggcagcgagtactatgaatgtagccgctacaaggaaaatccagacatcgtgaaccagagccagcaggcccaggcccgggaggccctgaagaagtacctgttctactttgagcgctgggagaaccacaacaagagcctgcagctggaggcccagacctaccagaggatccacgagaagatccaggagcgggtgatgaacaacctgggcacctggattgactggcagtacctgcagaatgctgccaagctgctggccaagtgccgctacaccctgcagtacacctacccctatgcctactacatggagagcggccccaggaagaagctgtttgagtaccagcaggcccagctggaggccgagattgagaacctgtcctggaaggtggagagagctgacagctatgacagaggagacctggagaaccagatgcacatcgccgagcagaggaggaggaccctgctgaaggacttccatgacacctag

SEQ ID NO: 144031 - DNA, 954 bp, Artificial Sequence
  Description of Artificial Sequence: Synthetic coding sequence
ggcatcactggagtgtcctgcatggcccaggactgccccctgcggaccccagaggactttgtgttccccctgctgcccaatgaggagctgcgggagaagtaccgccgctacctgttccgggactatgtggagagccactaccagctgcagctgtgccctggagctgactgccccatggtgatccgggtgcaggagccccgggccaggagagtgcagtgcaaccgctgcaatgaggtgttctgcttcaagtgccggcagatgtaccacgcccccacagactgtgccaccatcaggaagtggctgaccaagtgtgctgatgacagcgagacagccaactacatcagcgcccacaccaaggactgccccaagtgcaacatctgcatcgagaagaatggaggctgcaaccacatgcagtgcagcaagtgcaagcatgacttctgctggatgtgcctgggggactggaagacccacggcagcgagtactatgaatgtagccgctacaaggaaaatccagacatcgtgaaccagagccagcaggcccaggcccgggaggccctgaagaagtacctgttctactttgagcgctgggagaaccacaacaagagcctgcagctggaggcccagacctaccagaggatccacgagaagatccaggagcgggtgatgaacaacctgggcacctggattgactggcagtacctgcagaatgctgccaagctgctggccaagtgccgctacaccctgcagtacacctacccctatgcctactacatggagagcggccccaggaagaagctgtttgagtaccagcaggcccagctggaggccgagattgagaacctgtcctggaaggtggagagagctgacagctatgacagaggagacctggagaaccagatgcacatcgccgagcagaggaggaggaccctgctgaaggacttccatgacacctag

SEQ ID NO: 144032 - DNA, 1233 bp, Artificial Sequence
  Description of Artificial Sequence: Synthetic coding sequence
tctgtggacatgaacagccagggcagtgacagcaatgaggaggactatgaccccaactgtgaggaggaggaggaggaggaggaggatgatcctggggacatcgaggactactacgtgggcgtggccagtgatgtggagcagcagggcgcagatgcctttgatcctgaggagtaccagttcacctgcctgacctacaaggagagcgagggcgccctgaatgagcacatgaccagcctggcctctgtgctgaaggtgagccacagcgtggccaagctgatcctggtgaacttccactggcaggtgtctgagatcctggaccgctacaagagcaacagcgcccagctgctggtggaggcccgggtgcagcccaaccccagcaagcacgtgcccaccagccaccccccccaccactgtgctgtgtgcatgcagtttgtgaggaaggagaacctgctgagcctggcctgccagcaccagttctgccgcagctgctgggagcagcactgcagcgtgctggtgaaggatggagtgggcgtgggcgtgtcctgcatggcccaggactgccccctgcggaccccagaagattttgtgttccccctgctgcccaatgaggagctgcgggagaagtaccgccgctacctgttccgggactatgtggagagccactaccagctgcagctgtgccctggagctgactgccccatggtgatccgggtgcaggagccccgggcccggcgggtgcagtgcaaccgctgcaatgaggtgttctgcttcaagtgccggcagatgtaccacgcccccacagactgtgccaccatcaggaagtggctgaccaagtgtgctgatgattctgaaacagccaactacatcagcgcccacaccaaggactgccccaagtgcaacatctgcatcgagaagaatggaggctgcaaccacatgcagtgcagcaagtgcaagcatgacttctgctggatgtgcctgggggactggaagacccacggcagcgagtactatgagtgcagccgctacaaggagaacccagacatcgtgaaccagagccagcaggcccaggcccgggaggccctgaagaagtacctgttctactttgagcggctggagaacctgtcctggaaggtggagagagctgacagctatgacagaggagacctggagaaccagatgcacatcgccgagcagaggaggaggaccctgctgaaggacttccatgacacctag

SEQ ID NO: 144033 - DNA, 1482 bp, Artificial Sequence; identical to SEQ ID NO: 144030
  Description of Artificial Sequence: Synthetic coding sequence

SEQ ID NO: 144034 - DNA, 1584 bp, Artificial Sequence
  Description of Artificial Sequence: Synthetic coding sequence
ctgcggcgggccgccagcggccccctggcccccagcctgcccccaccccggcccccccggcggcaccagcccagcaatgccaacagaagatcctggggcggggccgccgcccggggggccggggcccggcctgccagcggccaccagcctgagcctgagcgggagcccggcccccggcggccccggcccctgcctgccagcgcctctgtgagaagagccccagcccggcgggccatggacagtgatgagggctacaactatgaatttgtgaatgaagtcatccagaacccagccaccatcacccgcatcctgctgagccacttcaactgggacaaggagaagctgatggagcgctactttgatggcaacctggagaagctgtttgctgagtgccacgtgatcaaccccagcaagaagagcaggacccggcagatgaacaccaggagcagcgcccaggacatgccctgccagatctgctacctgaactaccccaacagctacttcaccggcctggagtgtggccacaagttctgcatgcagtgctggagcgagtacctgaccaccaagatcatggaggagggcatgggccagaccatcagctgcccagcccacggctgtgacatcctggtggatgacaacacagtgatgaggctcatcacagacagcaaggtgaagctgaagtaccagcacctgatcaccaacagctttgtggagtgcaaccggctgctgaagtggtgcccagccccagactgccaccacgtggtgaaggtgcagtacccagatgccaagcctgtgcgctgcaagtgtggccggcagttctgcttcaactgtggggagaactggcatgaccctgtgaagtgcaagtggctgaagaagtggatcaagaagtgtgatgatgattctgagaccagcaactggattgctgccaacaccaaggaatgtcccaagtgccacgtgaccatcgagaaggatggcggctgcaaccacatggtgtgcaggaaccagaactgcaaggccgagttctgctgggtgtgcctgggcccctgggagccccacggcagcgcctggtacaactgcaaccgctacaatgaagatgatgccaaggccgccagagatgcccaggagaggagcagagctgccctgcagcgctacctgttctactgcaaccgctacatgaaccacatgcagagcctgcgctttgagcacaagctgtatgcccaggtgaagcagaagatggaggagatgcagcagcacaacatgtcctggattgaggtgcagttcctgaagaaggctgtggatgtgctgtgccagtgccgggccaccctgatgtacacctacgtgtttgccttctacctgaagaagaacaaccagagcatcatctttgagaacaaccaggccgacctggagaatgccacagaggtgctgagcggctacctggagcgggacatcagccaggacagcctgcaggacatcaagcagaaggtgcaggacaagtaccgctactgtgagagcagaagaagagtgctgctgcagcacgtgcatgagggctatgagaaggacctgtgggagtacatcgaggactag

SEQ ID NO: 144035 - DNA, 1674 bp, Artificial Sequence
  Description of Artificial Sequence: Synthetic coding sequence
atggacagtgatgagggctacaactatgaatttgatgaagatgaggagtgcagcgaggaggacagcggggctgaggaggaggaggatgaagatgatgatgagccagatgatgacaccctggacctgggggaggtggagctggtggagcccggcctgggcgtgggcggggagagagatggcctgctgtgtggggagaccggcggcggcggcggcagcgccctgggccctgggggcggcggcggcggcggcggcggcggcggcggcggcggccctggccacgagcaggaggaggactaccgctatgaggtgctgacagctgagcagatcctgcagcacatggtggagtgcatccgggaggtgaatgaagtcatccagaacccagccaccatcacccgcatcctgctgagccacttcaactgggacaaggagaagctgatggagcgctactttgatggcaacctggagaagctgtttgctgagtgccacgtgatcaaccccagcaagaagagcaggacccggcagatgaacaccaggagcagcgcccaggacatgccctgccagatctgctacctgaactaccccaacagctacttcaccggcctggagtgtggccacaagttctgcatgcagtgctggagcgagtacctgaccaccaagatcatggaggagggcatgggccagaccatcagctgcccagcccacggctgtgacatcctggtggatgacaacacagtgatgaggctcatcacagacagcaaggtgaagctgaagtaccagcacctgatcaccaacagctttgtggagtgcaaccggctgctgaagtggtgcccagccccagactgccaccacgtggtgaaggtgcagtacccagatgccaagcctgtgcgctgcaagtgtggccggcagttctgcttcaactgtggggagaactggcatgaccctgtgaagtgcaagtggctgaagaagtggatcaagaagtgtgatgatgattctgagaccagcaactggattgctgccaacaccaaggaatgtcccaagtgccacgtgaccatcgagaaggatggcggctgcaaccacatggtgtgcaggaaccagaactgcaaggccgagttctgctgggtgtgcctgggcccctgggagccccacggcagcgcctggtacaactgcaaccgctacaatgaagatgatgccaaggccgccagagatgcccaggagaggagcagagctgccctgcagcgctacctgttctactgcaaccgctacatgaaccacatgcagagcctgcgctttgagcacaagctgtatgcccaggtgaagcagaagatggaggagatgcagcagcacaacatgtcctggattgaggtgcagttcctgaagaaggctgtggatgtgctgtgccagtgccgggccaccctgatgtacacctacgtgtttgccttctacctgaagaagaacaaccagagcatcatctttgagaacaaccaggccgacctggagaatgccacagaggtgctgagcggctacctggagcgggacatcagccaggacagcctgcaggacatcaagcagaaggtgcaggacaagtaccgctactgtgagagcagaagaagagtgctgctgcagcacgtgcatgagggctatgagaaggacctgtgggagtacatcgaggactag

SEQ ID NO: 144036 - DNA, 1689 bp, Artificial Sequence
  Description of Artificial Sequence: Synthetic coding sequence
atgagcaaccagtaccaggaggagggctgcagcgagaggcctgagtgcaagagcaagagccccaccctgctgagcagctactgcatcgacagcatcctgggcagaagaagcccctgcaagatgaggctgctgggcgccgcccagagcctgcctgcccccctgaccagcagagctgaccctgagaaggctgtgcagggcagccccaagagcagcagcgccccctttgaagctgagctgcacctgccccccaagctgcggcggctgtatggccctgggggcggccgcctgctgcagggcgctgctgctgctgctgctgctgctgctgctgctgctgctgctgctgccacagccacagctggccccagaggagaggcccctcctcctcctccacccacagcccggcctggagagaggccagatggagctggagctgctgctgctgctgctgctgctgctgctgctgcctgggacaccctgaagatcagccaggccccccaggtgtccatcagccgcagcaagagctacagagaaaatggagccccctttgtgcccccacctccagccctggatgagctgggcggccctggaggagtgacccaccctgaggagcggctgggcgtggccggcggccctggcagcgccccagctgctgggggcggcactggaacagaagatgatgaggaggagctgctggaggatgaagaagatgaagatgaggaggaggagctgctggaggatgatgaggaggagctgctggaggatgatgcccgggccctgctgaaggagccccggcgctgccctgtggccgccactggagctgtggccgctgctgctgctgctgctgtggccacagagggcggggagctgagccccaaggaggagctgctgctgcacccagaagatgctgagggcaaggatggagaggacagcgtgtgcctgtctgctggcagtgacagcgaggagggcctgctgaagaggaagcagaggcgctaccgcaccaccttcaccagctaccagctggaggagctggagcgggccttccagaagacccactacccagatgtgttcacccgggaggagctggccatgaggctggacctgacagaggcccgggtgcaggtgtggttccagaacagaagagccaagtggaggaagcgggagaaggccggggcccagacccaccccccaggcctgcccttccctggccccctgagcgccacccaccccctgagcccctacctggatgccagccccttccccccccaccacccagccctggacagcgcctggacagctgctgctgctgctgctgctgctgccttccccagcctgcccccacctcctggcagcgccagcctgccccccagcggggcccccctgggcctgagcaccttcctgggcgctgctgtgttccgccacccagccttcatcagccctgccttcggccgcctcttcagcaccatggcccccctgaccagcgccagcacagctgctgccctgctgcggcagcccaccccagctgtggagggcgctgtggccagcggggccctggccgaccctgccacagctgctgctgacagaagagccagcagcattgctgccctgcggctgaaggccaaggagcacgccgcccagctgacccagctgaacatcctgcccggcaccagcacaggcaaggaggtgtgctag

SEQ ID NO: 144037 - DNA, 1032 bp, Artificial Sequence
  Description of Artificial Sequence: Synthetic coding sequence
atgggcggccccagaggagctggctgggtggccgccggcctgctgctgggcgctggggcctgctactgcatctaccgcctgacccggggcagaagaagaggagaccgggagctgggcatccgcagcagcaagtctgctggggccctggaggagggcaccagcgagggccagctgtgtggccgcagcgcccggccccagacaggaggcacctgggagagccagtggagcaagaccagccagcctgaggacctgacagatggcagctatgatgatgtgctgaatgctgagcagctgcagaagctgctgtacctgctggagagcacagaagatcctgtgatcatcgagcgggccctgatcaccctgggcaacaatgctgccttctctgtgaaccaggccatcatccgggagctgggcggcatccccatcgtggccaacaagatcaaccacagcaaccagagcatcaaggagaaggccctgaatgccctgaacaacctgtctgtgaatgtggagaaccagatcaagatcaagatctacatcagccaggtgtgtgaagatgtgttcagcggccccctgaacagcgctgtgcagctggccggcctgaccctgctgaccaacatgacagtgaccaatgaccaccagcacatgctgcacagctacatcacagacctcttccaggtgctgctgactggaaatggaaacaccaaggtgcaggtgctgaagctgctgctgaacctgtctgaaaatcctgccatgacagagggcctgctgcgggcccaggtggacagcagcttcctgagcctgtatgacagccacgtggccaaggagatcctgctgcgggtgctgaccctcttccagaacatcaagaactgcctgaagattgagggccacctggccgtgcagcccaccttcacagagggcagcctcttcttcctgctgcatggagaggagtgtgcccagaagatccgggccctggtggaccaccatgatgctgaggtgaaggagaaggtggtgaccatcatccccaagatctag

SEQ ID NO: 144038 - DNA, 855 bp, Artificial Sequence
  Description of Artificial Sequence: Synthetic coding sequence
atgggcggccccagaggagctggctgggtggccgccggcctgctgctgggcgctggggcctgctactgcatctaccgcctgacccggggcagaagaagaggagaccgggagctgggcatccgcagcagcaagtctgctgaggacctgacagatggcagctatgatgatgtgctgaatgctgagcagctgcagaagctgctgtacctgctggagagcacagaggaccccgtcatcatcgagcgggccctgatcaccctgggcaacaatgctgccttctctgtgaaccaggccatcatccgggagctgggcggcatccccatcgtggccaacaagatcaaccacagcaaccagagcatcaaggagaaggccctgaatgccctgaacaacctgtctgtgaatgtggagaaccagatcaagatcaagatctacatcagccaggtgtgtgaagatgtgttttctggccccctgaacagcgctgtgcagctggccggcctgaccctgctgaccaacatgacagtgaccaatgaccaccagcacatgctgcacagctacatcacagacctcttccaggtgctgctgactggaaatggaaacaccaaggtggacagcagcttcctgagcctgtatgacagccacgtggccaaggagatcctgctgcgggtgctgaccctcttccagaacatcaagaactgcctgaagattgagggccacctggccgtgcagcccaccttcacagagggcagcctcttcttcctgctgcacggggaggagtgtgcccagaagatccgggccctggtggaccaccatgatgctgaggtgaaggagaaggtggtgaccatcatccccaagatctag

SEQ ID NO: 144039 - DNA, 855 bp, Artificial Sequence
  Description of Artificial Sequence: Synthetic coding sequence
atgggcggccccagaggagctggctgggtggccgccggcctgctgctgggcgctggggcctgctactgcatctaccgcctgacccggggcagaagaagaggagaccgggagctgggcatccgcagcagcaagtctgctggggccctggaggagggcaccagcgagggccagctgtgtggccgcagcgcccggccccagacaggaggcacctgggagagccagtggagcaagaccagccagcctgaggacctgacagatggcagctatgatgatgtgctgaatgctgagcagctgcagaagctgctgtacctgctggagagcacagaagatcctgtgatcatcgagcgggccctgatcaccctgggcaacaatgctgccttctctgtgaaccaggccatcatccgggagctgggcggcatccccatcgtggccaacaagatcaaccacagcaaccagagcatcaaggagaaggccctgaatgccctgaacaacctgtctgtgaatgtggagaaccagatcaagatcaaggtgcaggtgctgaagctgctgctgaacctgtctgagaacccagccatgacagagggcctgctgcgggcccaggtggacagcagcttcctgagcctgtatgacagccacgtggccaaggagatcctgctgcgggtgctgaccctcttccagaacatcaagaactgcctgaagattgagggccacctggccgtgcagcccaccttcacagagggcagcctcttcttcctgctgcacggggaggagtgtgcccagaagatccgggccctggtggaccaccatgatgctgaggtgaaggagaaggtggtgaccatcatccccaagatctag

SEQ ID NO: 144040 - DNA, 927 bp, Artificial Sequence
  Description of Artificial Sequence: Synthetic coding sequence
atgggcggccccagaggagctggctgggtggccgccggcctgctgctgggcgctggggcctgctactgcatctaccgcctgacccggggcagaagaagaggagaccgggagctgggcatccgcagcagcaagtctgctgaggacctgacagatggcagctatgatgatgtgctgaatgctgagcagctgcagaagctgctgtacctgctggagagcacagaggaccccgtcatcatcgagcgggccctgatcaccctgggcaacaatgctgccttctctgtgaaccaggccatcatccgggagctgggcggcatccccatcgtggccaacaagatcaaccacagcaaccagagcatcaaggagaaggccctgaatgccctgaacaacctgtctgtgaatgtggagaaccagatcaagatcaagatctacatcagccaggtgtgtgaagatgtgttttctggccccctgaacagcgctgtgcagctggccggcctgaccctgctgaccaacatgacagtgaccaatgaccaccagcacatgctgcacagctacatcacagacctcttccaggtgctgctgactggaaatggaaacaccaaggtgcaggtgctgaagctgctgctgaacctgtctgagaacccagccatgacagagggcctgctgcgggcccaggtggacagcagcttcctgagcctgtatgacagccacgtggccaaggagatcctgctgcgggtgctgaccctcttccagaacatcaagaactgcctgaagattgagggccacctggccgtgcagcccaccttcacagagggcagcctcttcttcctgctgcacggggaggagtgtgcccagaagatccgggccctggtggaccaccatgatgctgaggtgaaggagaaggtggtgaccatcatccccaagatctag

SEQ ID NO: 144041 - DNA, 750 bp, Artificial Sequence
  Description of Artificial Sequence: Synthetic coding sequence
atgggcggccccagaggagctggctgggtggccgccggcctgctgctgggcgctggggcctgctactgcatctaccgcctgacccggggcagaagaagaggagaccgggagctgggcatccgcagcagcaagtctgctgaggacctgacagatggcagctatgatgatgtgctgaatgctgagcagctgcagaagctgctgtacctgctggagagcacagaggaccccgtcatcatcgagcgggccctgatcaccctgggcaacaatgctgccttctctgtgaaccaggccatcatccgggagctgggcggcatccccatcgtggccaacaagatcaaccacagcaaccagagcatcaaggagaaggccctgaatgccctgaacaacctgtctgtgaatgtggagaaccagatcaagatcaaggtgcaggtgctgaagctgctgctgaacctgtctgaaaatcctgccatgacagagggcctgctgcgggcccaggtggacagcagcttcctgagcctgtatgacagccacgtggccaaggagatcctgctgcgggtgctgaccctcttccagaacatcaagaactgcctgaagattgagggccacctggccgtgcagcccaccttcacagagggcagcctcttcttcctgctgcatggagaggagtgtgcccagaagatccgggccctggtggaccaccatgatgctgaggtgaaggagaaggtggtgaccatcatccccaagatctag

SEQ ID NO: 144042 - DNA, 678 bp, Artificial Sequence
  Description of Artificial Sequence: Synthetic coding sequence
atgggcggccccagaggagctggctgggtggccgccggcctgctgctgggcgctggggcctgctactgcatctaccgcctgacccggggcagaagaagaggagaccgggagctgggcatccgcagcagcaagtctgctgaggacctgacagatggcagctatgatgatgtgctgaatgctgagcagctgcagaagctgctgtacctgctggagagcacagaggaccccgtcatcatcgagcgggccctgatcaccctgggcaacaatgctgccttctctgtgaaccaggccatcatccgggagctgggcggcatccccatcgtggccaacaagatcaaccacagcaaccagagcatcaaggagaaggccctgaatgccctgaacaacctgtctgtgaatgtggagaaccagatcaagatcaaggtggacagcagcttcctgagcctgtatgacagccacgtggccaaggagatcctgctgcgggtgctgaccctcttccagaacatcaagaactgcctgaagattgagggccacctggccgtgcagcccaccttcacagagggcagcctcttcttcctgctgcatggagaggagtgtgcccagaagatccgggccctggtggaccaccatgatgctgaggtgaaggagaaggtggtgaccatcatccccaagatctag

SEQ ID NO: 144043 - DNA, 1362 bp, Artificial Sequence
  Description of Artificial Sequence: Synthetic coding sequence
atgggccgcacccgggaggccggctgtgtggccgccggcgtggtgattggagctggggcctgctactgtgtgtaccgcctggcctggggcagagatgaaaatgagaagatctgggatgaagatgaggagagcacagacaccagcgagattggagtggagaccgtgaagggggccaagaccaatgctggggccggcagcggggccaagctgcagggcgacagcgaggtgaagccagaggtgtccctgggcctggaggactgccctggggtgaaggagaaggcccacagcggcagccacagcggcggcggcctggaggccaaggccaaggccctcttcaacaccctgaaggagcaggccagcgccaaggccgggaaaggagcccgggtgggcaccatcagcggcaacagaaccctggcccccagcctgccctgccctgggggccggggcggcggctgccaccccaccaggagcggcagcagagctgggggccgggccagcggcaagagcaagggcaaggcccggagcaagagcacccgggccccagccaccacctggcctgtgcggcggggcaagttcaacttcccctacaagattgatgacatcctgagcgccccagacctgcagaaggtgctgaacatcctggagaggaccaatgaccccttcatccaggaggtggccctggtgaccctgggcaacaatgctgcctacagcttcaaccagaatgccatccgggagctgggcggcgtgcccatcatcgccaagctgatcaagaccaaggaccccatcatccgggagaagacctacaatgccctgaacaacctgtctgtgaatgctgagaaccagggcaagatcaagacctacatcagccaggtgtgtgatgacaccatggtgtgccgcctggacagcgctgtgcagatggccggcctgcggctgctgaccaacatgacagtgaccaaccactaccagcacctgctgagctacagcttcccagacttctttgccctgctcttcctgggcaaccacttcaccaagatccagatcatgaagctgatcatcaacttcacagagaacccagccatgacccgggagctggtgtcctgcaaggtgcccagcgagctgatcagcctcttcaacaaggagtgggaccgggagatcctgctgaacatcctgaccctgtttgagaacatcaatgacaacatcaagaatgaaggcctggccagcagcaggaaggagttcagccgcagcagcctcttcttcctgttcaaggagagcggcgtgtgtgtgaagaagatcaaggccctggccaaccacaatgacctggtggtgaaggtgaaggtgctgaaggtgctgaccaagctgtag

SEQ ID NO: 144044 - DNA, 477 bp, Artificial Sequence
  Description of Artificial Sequence: Synthetic coding sequence
atggtgtgccgcctggacagcgctgtgcagatggccggcctgcggctgctgaccaacatgacagtgaccaaccactaccagcacctgctgagctacagcttcccagacttctttgccctgctcttcctgggcaaccacttcaccaagatccagatcatgaagctgatcatcaacttcacagaaaatcctgccatgacccgggagctggtgtcctgcaaggtgcccagcgagctgatcagcctcttcaacaaggagtgggaccgggagatcctgctgaacatcctgaccctgtttgagaacatcaatgacaacatcaagaatgaaggcctggccagcagcaggaaggagttcagccgcagcagcctcttcttcctgttcaaggagagcggcgtgtgtgtgaagaagatcaaggccctggccaaccacaatgacctggtggtgaaggtgaaggtgctgaaggtgctgaccaagctgtag

SEQ ID NO: 144045 - DNA, 1899 bp, Artificial Sequence
  Description of Artificial Sequence: Synthetic coding sequence
atgagccgggtgagagatgctggctgtgtggccgccggcatcgtcatcggggccggggcctggtactgtgtgtacaagtacacccggggccgggaccagaccaagaagaggatggccaagcccaagaacagagctgtggccggcactggagcccgggcccgggccggcctgcgggccggcttcaccatcgacctgggcagcggcttcagcccccccacccctgtgcgggcagaggccgaggaccgggcccaggatgaggccagcgccctggacacagtgggcgctgaggccgtggccccagctgccagcagcgctgaggcccagagcggggccggcagccaggcccaggaggctgatggagctggggtgggccccaaggccgagagcgtggtgggcgccgccatggccagcgccatcgcccctcctcctggggtgacagaggccctgggcgctgctgaggccccagccatggccggggcccccaaggtggccgaggccccccgggaggccgagaccagcagagctgctgtgcccccaggcaccgtggtgcccacagaagctgctgcccccacagaggtgacagagggccctggggtggccgcccccaccaaggtggccgaggcccctggggtggccagccccacagaagctgctgaggcccctgtgcctgccacccccactggagctgctgcccccactggagctgctgagagccctggcaccagcggcagccccaggacagctgtggtgcccggcaccagcgctgccaagaaggccacccctggggcccacactggagccatccccaaggccaccagcgccactggagctgtgcccaagggcggcggcaagggcgtgaccaggagcagaaatggaggcaagggcaagggcaagaagagcaaggtggaggtggatgagctgggcatgggcttccggcctggagatggagctgctgctgctgctgctgccagcgccaacggcggccaggccttcctggccgaggtgcctgacagcgaggagggggagagcggctggacagacacagaaagtgacagcgacagcgagcctgagacccagaggcggggccggggcagaagacctgtggccatgcagaagaggcccttcccctatgaaattgatgagatcctgggcgtgcgggacctgaggaaggtgctggccctgctgcagaagagtgatgaccccttcatccagcaggtggccctgctgaccctgagcaacaatgccaactacagctgcaaccaggagaccatcaggaagctgggcggcctgcccatcatcgccaacatgatcaacaagacagacccccacatcaaggagaaggccctgatggccatgaacaacctgtctgaaaattatgagaaccagggccgcctgcaggtgtacatgaacaaggtgatggatgacatcatggccagcaacctgaacagcgctgtgcaggtggtgggcctgaagttcctgaccaacatgaccatcaccaatgactaccagcacctgctggtgaacagcatcgccaacttcttccggctgctgagccagggcggcggcaagatcaaggtggagatcctgaagatcctgagcaactttgctgaaaatccagacatgctgaagaagctgctgagcacccaggtgcctgccagcttcagcagcctgtacaacagctatgtggagagcgagatcctgatcaatgccctgaccctgtttgagatcatctatgacaacctgcgggcagaggtgttcaactaccgggagttcaacaagggcagcctcttctacctgtgcaccaccagcggcgtgtgtgtgaagaagatccgggccctggccaaccaccacgacctgctggtgaaggtgaaggtgatcaagctggtgaacaagttctag

SEQ ID NO: 144046 - DNA, 1899 bp, Artificial Sequence; identical to SEQ ID NO: 144045
  Description of Artificial Sequence: Synthetic coding sequence

SEQ ID NO: 144047 - DNA, 1899 bp, Artificial Sequence; identical to SEQ ID NO: 144045
  Description of Artificial Sequence: Synthetic coding sequence

SEQ ID NO: 144048 - DNA, 504 bp, Artificial Sequence
  Description of Artificial Sequence: Synthetic coding sequence
atgagccgggtgagagatgctggctgtgtggccgccggcatcgtcatcggggccggggcctggtactgtgtgtacaagtacacccggggccgggaccagaccaagaagaggatggccaagcccaagaacagagctgtggccggcactggagcccgggcccgggccggcctgcgggccggcttcaccatcgacctgggcagcggcttcagcccccccacccctgtgcgggcagaggccgaggaccgggcccaggatgaggccagcgccctggacacagtgggcgctgaggccgtggccccagctgccagcagcgctgaggcccagagcggggccggcagccaggcccaggaggctgatggagctggggtgggccccaaggccgagagcgtggtgggcgccgccatggccagcgccatcgcccctcctcctggggtgacagaggccctgggcgctgctgaggccccagccatggccggggcccccaaggtggccgaggccccctag

SEQ ID NO: 144049 - DNA, 189 bp, Artificial Sequence
  Description of Artificial Sequence: Synthetic coding sequence
atgagccgggtgagagatgctggctgtgtggccgccggcatcgtcatcggggccggggcctggtactgtgtgtacaagtacacccggggccgggaccagaccaagaagaggatggccaagcccaagaacagagctgtggccggcactggagcccgggcccgggccggcctgcgggccggcttcacctag

SEQ ID NO: 144050 - DNA, 498 bp, Artificial Sequence
  Description of Artificial Sequence: Synthetic coding sequence
atgagccgggtgagagatgctggctgtgtggccgccggcatcgtcatcggggccggggcctggtactgtgtgtacaagtacacccggggccgggaccagaccaagaagaggatggccaagcccaagaacagagctgtggccggcactggagcccgggcccgggccggcctgcgggccggcttcaccatcgacctgggcagcggcttcagcccccccacccctgtgcgggcagaggccgaggaccgggcccaggatgaggccagcgccctggacacagtgggcgctgaggccgtggccccagctgccagcagcgctgaggcccagagcggggccggcagccaggcccaggaggctgatggagctggggtgggccccaaggccgagagcgtggtgggcgccgccatggccagcgccatcgcccctcctcctggggtgacagaggccctgggcgctgctgaggccccagccatggccggggcccccaaggtggccgagtag

SEQ ID NO: 144051 - DNA, 318 bp, Artificial Sequence
  Description of Artificial Sequence: Synthetic coding sequence
atgagccgggtgagagatgctggctgtgtggccgccggcatcgtcatcggggccggggcctggtactgtgtgtacaagtacacccggggccgggaccagaccaagaagaggatggccaagcccaagaacagagctgtggccggcactggagcccgggcccgggccggcctgcgggccggcttcaccatcgacctgggcagcggcttcagcccccccacccctgtgcgggcagaggccgaggaccgggcccaggatgaggccagcgccctggacacagtgggcgctgaggccgtggccccagctgccagcagcgcctag

SEQ ID NO: 144052 - DNA, 282 bp, Artificial Sequence
  Description of Artificial Sequence: Synthetic coding sequence
atgagccgggtgagagatgctggctgtgtggccgccggcatcgtcatcggggccggggcctggtactgtgtgtacaagtacacccggggccgggaccagaccaagaagaggatggccaagcccaagaacagagctgtggccggcactggagcccgggcccgggccggcctgcgggccggcttcaccatcgacctgggcagcggcttcagcccccccacccctgtgcgggcagaggccgaggaccgggcccaggatgaggccagcgccctggacacagtgtag

SEQ ID NO: 144053 - DNA, 1140 bp, Artificial Sequence
  Description of Artificial Sequence: Synthetic coding sequence
atgggctacgccaggaaggtgggctgggtgacagctggcctggtgattggagctggggcctgctactgcatctaccgcctgacccggggcaggaagcagaacaaggagaagatggccgagggcggcagcggagatgtggatgatgctggggactgcagcggggcccgctacaatgactggagcgatgatgatgatgacagcaatgaaagcaagagcatcgtgtggtacccaccctgggcccgcatcggcacagaggccggcacccgggcccgggcccgggcccgggcccgggccacccgggcccggcgggctgtgcagaagagggccagccccaacagtgatgacacagtgctgagcccccaggagctgcagaaggtgctgtgcctggtggagatgtctgagaagccctacatcctggaggccgccctgattgccctgggcaacaatgctgcctatgccttcaacagagacatcatccgggacctgggcggcctgcccatcgtggccaagatcctgaacacccgggaccccatcgtgaaggagaaggccctgattgtgctgaacaacctgtctgtgaatgctgagaaccagaggcggctgaaggtgtacatgaaccaggtgtgtgatgacaccatcaccagccggctgaacagctctgtgcagctggccggcctgcggctgctgaccaacatgacagtgaccaatgagtaccagcacatgctggccaacagcatcagtgacttcttccgcctcttctctgctggaaatgaggagaccaagctgcaggtgctgaagctgctgctgaacctggccgagaacccagccatgacccgggagctgctgcgggcccaggtgcccagcagcctgggcagcctcttcaacaagaaggagaacaaggaggtgatcctgaagctgctggtgatctttgagaacatcaatgacaacttcaagtgggaggagaatgagcccacccagaaccagtttggagagggcagcctcttcttcttcctgaaggagttccaggtgtgtgccgacaaggtgctgggcatcgagagccaccacgacttcctggtgaaggtgaaggtgggcaagttcatggccaagctggccgagcacatgttccccaagagccaggagtag

SEQ ID NO: 144054 - DNA, 1140 bp, Artificial Sequence; identical to SEQ ID NO: 144053
  Description of Artificial Sequence: Synthetic coding sequence

SEQ ID NO: 144055 - DNA, 2889 bp, Artificial Sequence
  Description of Artificial Sequence: Synthetic coding sequence
atggaggactgcaatgtgcacagcgctgccagcatcctggcctctgtgaaggagcaggaggccaggtttgagcggctgacccgggccctggagcaggagcggcggcacgtggccctgcagctggagcgggcccagcagcccggcatggtgtctgggggcatgggcagcggccagcccctgcccatggcctggcagcagctggtgctgcaggagcagagccctggcagccaggccagcctggccaccatgcctgaggccccagatgtgctggaggagaccgtgacagtggaggaggaccccggcacccccaccagccacgtgtccatcgtgaccagtgaagatggcaccaccaggagaacagagaccaaggtgaccaagacagtgaagacagtgaccaccaggacagtgcggcaggtgcctgtgggcccagatggcctgcccctgctggatggcggcccccccctgggcccctttgctgatggagccctggacagacacttcctgctgcggggcggcggccctgtggccaccctgagccgggcctacctgagcagcggcggcggcttccctgagggccctgagccccgggacagccccagctatggcagcctgagccggggcctgggcatgaggcctcccagggctggccccctgggccctggccctggagatggctgcttcaccctgcccggccaccgggaggccttccctgtgggccctgagcccggccccccaggcggccgcagcctgcctgagcgcttccaggccgagccctacggcctggaggatgacaccaggagcctggccgcagatgatgagggcggccctgagctggagccagactatggaacagccacccggcggcggccagaatgtggccggggcctgcacacccgggcctatgaggacacagcagatgatggaggagagctggctgatgagaggcctgccttccccatggtgacagcccccctggcccagcctgagcggggctccatgggcagcctggaccggctggtgagaagaagccccagcgtggacagcgccaggaaggagccccgctggagggaccctgagctgcctgaggtgctggccatgctgcggcaccctgtggaccctgtgaaggccaatgctgctgcctacctgcagcacctgtgctttgaaaatgaaggagtgaagagaagagtgcggcagctgcggggcctgcccctgctggtggccctgctggaccaccccagggctgaggtgagaagaagagcctgtggggccctgaggaacctgtcctatggccgggacacagacaacaaggccgccatccgggactgtggcggcgtgcctgccctggtgcggctgctgcgggccgcccgggacaatgaggtgcgggagctggtgacaggcaccctgtggaacctgagcagctatgagcccctgaagatggtgatcatcgaccacggcctgcagaccctgacccatgaagtcatcgtgccccacagcggctgggagcgggagcccaatgaagacagcaagcccagagatgctgagtggaccaccgtcttcaagaacaccagcggctgcctgagaaatgtgtccagtgatggagctgaggcccggcggcggctgcgggagtgtgagggcctggtggatgccctgctgcacgccctgcagagcgctgtgggcaggaaggacacagacaacaagtctgtggagaactgtgtgtgcatcatgaggaacctgagctaccacgtgcacaaggaggtgcctggagctgaccgctaccaggaggccgagcccggccccctgggcagcgctgtgggcagccagaggagaagaagagatgatgccagctgctttggaggcaagaaggccaaggaggagtggttccaccagggcaagaaggatggagagatggacaggaactttgacaccctggacctgcccaagaggacagaagctgccaagggctttgagctgctgtaccagcctgaggtggtgcggctgtacctgagcctgctgacagagagcaggaacttcaacaccctggaggccgccgccggggccctgcagaacctgtctgctggcaactggatgtgggccacctacatccgggccaccgtgaggaaggagcggggcctgcctgtgctggtggagctgctgcagagcgagacagacaaggtggtgcgggctgtggccatcgccctgaggaacctgagcctggacagaagaaacaaggacctgattggcagctatgccatggccgagctggtgagaaatgtgagaaatgcccaggccccacccaggcctggggcctgcctggaggaggacacagtggtggccgtgctgaacaccatccacgagatcgtgtctgacagcctggacaatgcccggagcctgctgcaggcccggggcgtgcctgccctggtggccctggtggccagcagccagagcgtgcgggaggccaaggccgccagccacgtgctgcagacagtgtggagctacaaggagctgcggggcaccctgcagaaggatggctggaccaaggcccgcttccagagcgctgctgccacagccaagggccccaagggggccctgagccctgggggctttgatgacagcaccctgcccctggtggacaagagcctggagggggagaagacaggcagcagagatgtgatccccatggatgccctgggcccagatggctacagcacagtggaccggcgggagcggcggcccaggggggccagcagcgctggggaggccagcgagaaggagcccctgaagctggaccccagcaggaaggcccctcctcctggccccagcaggcctgctgtgcggctggtggatgctgtgggagatgccaagccccagcctgtggacagctgggtgtag

SEQ ID NO: 144056 - DNA, 2700 bp, Artificial Sequence
  Description of Artificial Sequence: Synthetic coding sequence
atgcctgctgagctgcggcaggagcagagccctggcagccaggccagcctggccaccatgcctgaggccccagatgtgctggaggagaccgtgacagtggaggaggaccccggcacccccaccagccacgtgtccatcgtgaccagtgaagatggcaccaccaggagaacagagaccaaggtgaccaagacagtgaagacagtgaccaccaggacagtgcggcaggtgcctgtgggcccagatggcctgcccctgctggatggcggcccccccctgggcccctttgctgatggagccctggacagacacttcctgctgcggggcggcggccctgtggccaccctgagccgggcctacctgagcagcggcggcggcttccctgagggccctgagccccgggacagccccagctatggcagcctgagccggggcctgggcatgaggcctccccgggccggccccctgggccctggccctggagatggctgcttcaccctgcccggccaccgggaggccttccctgtgggccctgagcccggccccccaggcggccgcagcctgcctgagcgcttccaggccgagccctacggcctggaggatgacaccaggagcctggccgcagatgatgaaggaggccctgagctggagccagactatggaacagccaccaggagaagaccagaatgtggccggggcctgcacacccgggcctatgaggacacagcagatgatggaggagagctggctgatgagaggcctgccttccccatggtgacagcccccctggcccagcctgagcggggctccatgggcagcctggaccggctggtgcggcgcagccccagcgtggacagcgccaggaaggagccccgctggagggaccctgagctgcctgaggtgctggccatgctgcggcaccctgtggaccctgtgaaggccaatgctgctgcctacctgcagcacctgtgctttgaaaatgaaggagtgaagagaagagtgcggcagctgcggggcctgcccctgctggtggccctgctggaccaccccagggctgaggtgagaagaagagcctgtggggccctgaggaacctgtcctatggccgggacacagacaacaaggccgccatccgggactgtggcggcgtgcctgccctggtgcggctgctgcgggccgcccgggacaatgaggtgcgggagctggtgacaggcaccctgtggaacctgagcagctatgagcccctgaagatggtgatcatcgaccacggcctgcagaccctgacccatgaggtgattgtgccccacagcggctgggagcgggagcccaatgaagacagcaagcccagagatgctgagtggaccaccgtcttcaagaacaccagcggctgcctgagaaatgtgtccagtgatggagctgaggcccggcggcggctgagagaatgtgagggcctggtggatgccctgctgcacgccctgcagagcgctgtgggcaggaaggacacagacaacaagtctgtggagaactgtgtgtgcatcatgaggaacctgagctaccacgtgcacaaggaggtgcctggagctgaccgctaccaggaggccgagcccggccccctgggcagcgctgtgggcagccagaggagaagaagagatgatgccagctgcttcggcggcaagaaggccaaggaggagtggttccaccagggcaagaaggatggagagatggacaggaactttgacaccctggacctgcccaagaggacagaggccgccaagggctttgagctgctgtaccagcctgaggtggtgcggctgtacctgagcctgctgacagagagcaggaacttcaacaccctggaggccgctgctggggccctgcagaacctgtctgctggcaactggatgtgggccacctacatccgggccaccgtgaggaaggagcggggcctgcctgtgctggtggagctgctgcagagcgagacagacaaggtggtgcgggctgtggccatcgccctgaggaacctgagcctggacagaagaaacaaggacctgattggcagctatgccatggccgagctggtgagaaatgtgagaaatgcccaggccccacccaggcctggggcctgcctggaggaggacacagtggtggccgtgctgaacaccatccatgaaattgtgtctgacagcctggacaatgcccggagcctgctgcaggcccggggcgtgcctgccctggtggccctggtggccagcagccagagcgtgcgggaggccaaggccgccagccacgtgctgcagacagtgtggagctacaaggagctgcggggcaccctgcagaaggatggctggaccaaggcccgcttccagagcgctgctgccacagccaagggccccaagggggccctgagccctgggggctttgatgacagcaccctgcccctggtggacaagagcctggagggggagaagacaggcagcagagatgtgatccccatggatgccctgggcccagatggctacagcacagtggacagaagagagcggcggcccaggggggccagcagcgctggggaggccagcgagaaggagcccctgaagctggaccccagcaggaaggcccctcctcctggccccagcaggcctgctgtgcggctggtggatgctgtgggagatgccaagccccagcctgtggacagctgggtgtag

SEQ ID NO: 144057 - DNA, 2700 bp, Artificial Sequence; identical to SEQ ID NO: 144056
  Description of Artificial Sequence: Synthetic coding sequence

SEQ ID NO: 144058 - DNA, 2871 bp, Artificial Sequence
  Description of Artificial Sequence: Synthetic coding sequence
atggaggactgcaatgtgcacagcgctgccagcatcctggcctctgtgaaggagcaggaggccaggtttgagcggctgacccgggccctggagcaggagcggcggcacgtggccctgcagctggagcgggcccagcagcccggcatggtgtctgggggcatgggcagcggccagcccctgcccatggcctggcagcagctggtgctgcaggagcagagccctggcagccaggccagcctggccaccatgcctgaggccccagatgtgctggaggagaccgtgacagtggaggaggaccccggcacccccaccagccacgtgtccatcgtgaccagtgaagatggcaccaccaggagaacagagaccaaggtgaccaagacagtgaagacagtgaccaccaggacagtgcggcaggtgcctgtgggcccagatggcctgcccctgctggatggcggcccccccctgggcccctttgctgatggagccctggacagacacttcctgctgcggggcggcggccctgtggccaccctgagccgggcctacctgagcagcggcggcggcttccctgagggccctgagccccgggacagccccagctatggcagcctgagccggggcctgggcatgaggcctcccagggctggccccctgggccctggccctggagatggctgcttcaccctgcccggccaccgggaggccttccctgtgggccctgagcccggccccccaggcggccgcagcctgcctgagcgcttccaggccgagccctacggcctggaggatgacaccaggagcctggccgcagatgatgagggcggccctgagctggagccagactatggaacagccacccggcggcggccagaatgtggccggggcctgcacacccgggcctatgaggacacagcagatgatggaggagagctggctgatgagaggcctgccttccccatggtgacagcccccctggcccagcctgagcggggctccatgggcagcctggaccggctggtgagaagaagccccagcgtggacagcgccaggaaggagccccgctggagggaccctgagctgcctgaggtgctggccatgctgcggcaccctgtggaccctgtgaaggccaatgctgctgcctacctgcagcacctgtgctttgaaaatgaaggagtgaagagaagagtgcggcagctgcggggcctgcccctgctggtggccctgctggaccaccccagggctgaggtgagaagaagagcctgtggggccctgaggaacctgtcctatggccgggacacagacaacaaggccgccatccgggactgtggcggcgtgcctgccctggtgcggctgctgcgggccgcccgggacaatgaggtgcgggagctggtgacaggcaccctgtggaacctgagcagctatgagcccctgaagatggtgatcatcgaccacggcctgcagaccctgacccatgaagtcatcgtgccccacagcggctgggagcgggagcccaatgaagacagcaagcccagagatgctgagtggaccaccgtcttcaagaacaccagcggctgcctgagaaatgtgtccagtgatggagctgaggcccggcggcggctgcgggagtgtgagggcctggtggatgccctgctgcacgccctgcagagcgctgtgggcaggaaggacacagacaacaagtctgtggagaactgtgtgtgcatcatgaggaacctgagctaccacgtgcacaaggaggtgcctggagctgaccgctaccaggaggccgagcccggccccctgggcagcgctgtgggcagccagaggagaagaagagatgatgccagctgctttggaggcaagaaggccaagggcaagaaggatggagagatggacaggaactttgacaccctggacctgcccaagaggacagaagctgccaagggctttgagctgctgtaccagcctgaggtggtgcggctgtacctgagcctgctgacagagagcaggaacttcaacaccctggaggccgccgccggggccctgcagaacctgtctgctggcaactggatgtgggccacctacatccgggccaccgtgaggaaggagcggggcctgcctgtgctggtggagctgctgcagagcgagacagacaaggtggtgcgggctgtggccatcgccctgaggaacctgagcctggacagaagaaacaaggacctgattggcagctatgccatggccgagctggtgagaaatgtgagaaatgcccaggccccacccaggcctggggcctgcctggaggaggacacagtggtggccgtgctgaacaccatccacgagatcgtgtctgacagcctggacaatgcccggagcctgctgcaggcccggggcgtgcctgccctggtggccctggtggccagcagccagagcgtgcgggaggccaaggccgccagccacgtgctgcagacagtgtggagctacaaggagctgcggggcaccctgcagaaggatggctggaccaaggcccgcttccagagcgctgctgccacagccaagggccccaagggggccctgagccctgggggctttgatgacagcaccctgcccctggtggacaagagcctggagggggagaagacaggcagcagagatgtgatccccatggatgccctgggcccagatggctacagcacagtggaccggcgggagcggcggcccaggggggccagcagcgctggggaggccagcgagaaggagcccctgaagctggaccccagcaggaaggcccctcctcctggccccagcaggcctgctgtgcggctggtggatgctgtgggagatgccaagccccagcctgtggacagctgggtgtag

SEQ ID NO: 144059 - DNA, 2682 bp, Artificial Sequence
  Description of Artificial Sequence: Synthetic coding sequence
atgcctgctgagctgcggcaggagcagagccctggcagccaggccagcctggccaccatgcctgaggccccagatgtgctggaggagaccgtgacagtggaggaggaccccggcacccccaccagccacgtgtccatcgtgaccagtgaagatggcaccaccaggagaacagagaccaaggtgaccaagacagtgaagacagtgaccaccaggacagtgcggcaggtgcctgtgggcccagatggcctgcccctgctggatggcggcccccccctgggcccctttgctgatggagccctggacagacacttcctgctgcggggcggcggccctgtggccaccctgagccgggcctacctgagcagcggcggcggcttccctgagggccctgagccccgggacagccccagctatggcagcctgagccggggcctgggcatgaggcctccccgggccggccccctgggccctggccctggagatggctgcttcaccctgcccggccaccgggaggccttccctgtgggccctgagcccggccccccaggcggccgcagcctgcctgagcgcttccaggccgagccctacggcctggaggatgacaccaggagcctggccgcagatgatgaaggaggccctgagctggagccagactatggaacagccaccaggagaagaccagaatgtggccggggcctgcacacccgggcctatgaggacacagcagatgatggaggagagctggctgatgagaggcctgccttccccatggtgacagcccccctggcccagcctgagcggggctccatgggcagcctggaccggctggtgcggcgcagccccagcgtggacagcgccaggaaggagccccgctggagggaccctgagctgcctgaggtgctggccatgctgcggcaccctgtggaccctgtgaaggccaatgctgctgcctacctgcagcacctgtgctttgaaaatgaaggagtgaagagaagagtgcggcagctgcggggcctgcccctgctggtggccctgctggaccaccccagggctgaggtgagaagaagagcctgtggggccctgaggaacctgtcctatggccgggacacagacaacaaggccgccatccgggactgtggcggcgtgcctgccctggtgcggctgctgcgggccgcccgggacaatgaggtgcgggagctggtgacaggcaccctgtggaacctgagcagctatgagcccctgaagatggtgatcatcgaccacggcctgcagaccctgacccatgaggtgattgtgccccacagcggctgggagcgggagcccaatgaagacagcaagcccagagatgctgagtggaccaccgtcttcaagaacaccagcggctgcctgagaaatgtgtccagtgatggagctgaggcccggcggcggctgagagaatgtgagggcctggtggatgccctgctgcacgccctgcagagcgctgtgggcaggaaggacacagacaacaagtctgtggagaactgtgtgtgcatcatgaggaacctgagctaccacgtgcacaaggaggtgcctggagctgaccgctaccaggaggccgagcccggccccctgggcagcgctgtgggcagccagaggagaagaagagatgatgccagctgcttcggcggcaagaaggccaagggcaagaaggatggagagatggacaggaactttgacaccctggacctgcccaagaggacagaggccgccaagggctttgagctgctgtaccagcctgaggtggtgcggctgtacctgagcctgctgacagagagcaggaacttcaacaccctggaggccgctgctggggccctgcagaacctgtctgctggcaactggatgtgggccacctacatccgggccaccgtgaggaaggagcggggcctgcctgtgctggtggagctgctgcagagcgagacagacaaggtggtgcgggctgtggccatcgccctgaggaacctgagcctggacagaagaaacaaggacctgattggcagctatgccatggccgagctggtgagaaatgtgagaaatgcccaggccccacccaggcctggggcctgcctggaggaggacacagtggtggccgtgctgaacaccatccatgaaattgtgtctgacagcctggacaatgcccggagcctgctgcaggcccggggcgtgcctgccctggtggccctggtggccagcagccagagcgtgcgggaggccaaggccgccagccacgtgctgcagacagtgtggagctacaaggagctgcggggcaccctgcagaaggatggctggaccaaggcccgcttccagagcgctgctgccacagccaagggccccaagggggccctgagccctgggggctttgatgacagcaccctgcccctggtggacaagagcctggagggggagaagacaggcagcagagatgtgatccccatggatgccctgggcccagatggctacagcacagtggacagaagagagcggcggcccaggggggccagcagcgctggggaggccagcgagaaggagcccctgaagctggaccccagcaggaaggcccctcctcctggccccagcaggcctgctgtgcggctggtggatgctgtgggagatgccaagccccagcctgtggacagctgggtgtag

SEQ ID NO: 144060 - DNA, 1131 bp, Artificial Sequence
  Description of Artificial Sequence: Synthetic coding sequence
atggagagctatgacatcatcgccaaccagcctgtggtgattgacaatggcagcggggtcatcaaggccggctttgctggggaccagatccccaagtactgcttccccaactacgtgggccggcccaagcacatgagggtgatggccggggccctggagggggacctcttcatcggccccaaggccgaggagcaccggggcctgctgaccatccgctaccccatggagcacggcgtggtgcgggactggaatgacatggagcgcatctggcagtatgtgtacagcaaggaccagctgcagaccttcagcgaggagcaccctgtgctgctgacagaggcccccctgaaccccagcaagaaccgggagaaggctgctgaggtgttctttgagaccttcaacgtgcctgccctcttcatctccatgcaggccgtgctgagcctgtatgccaccggccgcaccaccggggtggtgctggacagcggagatggagtgacccatgctgtgcccatctatgagggctttgccatgccccacagcatcatgagggtggacattgctggaagagatgtgagccgctacctgcggctgctgctgaggaaggagggcgtggacttccacaccagcgctgagtttgaggtggtgaggaccatcaaggagcgggcctgctacctgagcatcaacccccagaaggatgaggccctggagacagagaaggtgcagtacaccctgcctgatggcagcaccctggatgtgggccctgcccgcttccgggcccctgagctgctcttccagcctgacctggtgggagatgagagcgagggcctgcacgaggtggtggcctttgccatccacaagagtgacatggacctgcggaggaccctgtttgccaacatcgtgctgagcggcggcagcaccctcttcaagggctttggagaccggctgctgtctgaggtgaagaagctggcccccaaggacatcaagatcaagatcagcgccccccaggagcggctgtacagcacctggattggaggcagcatcctggccagcctggacaccttcaagaagatgtgggtgtccaagaaggagtatgaagaagatggcagccgggccatccacaggaagaccttctag

SEQ ID NO: 144061 - DNA, 1167 bp, Artificial Sequence
  Description of Artificial Sequence: Synthetic coding sequence
atgagcaaggtgttcaagaagaccagcagcaatggcaagctgagcatctacctgggcaagagggactttgtggaccacgtggacacagtggagcccattgatggagtggtgctggtggaccctgagtacctgaagtgcaggaagctgtttgtgatgctgacctgtgccttccgctatggaagagatgacctggaggtgattggcctgaccttcaggaaggacctgtatgtgcagaccctgcaggtggtgcctgctgagagcagcagcccccagggccccctgactgtgctgcaggagcggctgctgcacaagctgggggacaatgcctaccccttcaccctgcagatggtgaccaacctgccctgcagcgtgaccctgcagcccggcccagaagatgctgggaagccctgtggcatcgactttgaggtgaagagcttctgtgctgaaaatcctgaggagaccgtgtccaagagggactatgtgcggctggtggtgaggaaggtgcagtttgcccctcctgaggccggccctggccccagcgcccagaccatccgccgcttcctgctgagcgcccagcccctgcagctgcaggcctggatggaccgggaggtgcactaccatggagagcccatctctgtgaatgtgtccatcaacaactgcaccaacaaggtgatcaagaagatcaagatctctgtggaccagatcacagatgtggtgctgtacagcctggacaagtacaccaagacagtgttcatccaggagttcacagagaccgtggccgccaacagcagcttcagccagagctttgctgtgacccccatcctggccgccagctgccagaagaggggcctggccctggatggcaagctgaagcatgaggacaccaacctggccagcagcaccatcatccggcccggcatggacaaggagctgctgggcatcctggtgtcctacaaggtgcgggtgaacctgatggtgtcctgtggcggcatcctgggggacctgacagccagtgatgtgggcgtggagctgcccctggtgctgatccaccccaagcccagccatgaagctgccagcagtgaagatattgtgattgaggagttcaccaggaaaggagaggaggagagccagaaggctgtggaggccgagggagatgagggcagctag

SEQ ID NO: 144062 - DNA, 1167 bp, Artificial Sequence
  Description of Artificial Sequence: Synthetic coding sequence
atgagcaaggtgttcaagaagaccagcagcaatggcaagctgagcatctacctgggcaagagggactttgtggaccacgtggacacagtggagcccattgatggagtggtgctggtggaccctgagtacctgaagtgcaggaagctgtttgtgatgctgacctgtgccttccgctatggaagagatgacctggaggtgattggcctgaccttcaggaaggacctgtatgtgcagaccctgcaggtggtgcctgctgagagcagcagcccccagggccccctgactgtgctgcaggagcggctgctgcacaagctgggggacaatgcctaccccttcaccctgcagatggtgaccaacctgccctgcagcgtgaccctgcagcccggcccagaagatgctgggaagccctgtggcatcgactttgaggtgaagagcttctgtgctgaaaatcctgaggagaccgtgtccaagagggactatgtgcggctggtggtgaggaaggtgcagtttgcccctcctgaggccggccctggccccagcgcccagaccatccgccgcttcctgctgagcgcccagcccctgcagctgcaggcctggatggaccgggaggtgcactaccatggagagcccatctctgtgaatgtgtccatcaacaactgcaccaacaaggtgatcaagaagatcaagatctctgtggaccagatcacagatgtggtgctgtacagcctggacaagtacaccaagacagtgttcatccaggagttcacagagaccgtggccgccaacagcagcttcagccagagctttgctgtgacccccatcctggccgccagctgccagaagaggggcctggccctggatggcaagctgaagcatgaggacaccaacctggccagcagcaccatcatccggcccggcatggacaaggagctgctgggcatcctggtgtcctacaaggtgcgggtgaacctgatggtgtcctgtggcggcatcctgggggacctgacagccagtgatgtgggcgtggagctgcccctggtgctgatccaccccaagcccagccacgccagcgccagcagtgaagatattgtgattgaggagttcaccaggaaaggagaggaggagagccagaaggctgtggaggccgagggagatgagggcagctag

SEQ ID NO: 144063 - DNA, 1080 bp, Artificial Sequence
  Description of Artificial Sequence: Synthetic coding sequence
atgagcaaggtgttcaagaagaccagcagcaatggcaagctgagcatctacctgggcaagagggactttgtggaccacgtggacacagtggagcccattgatggagtggtgctggtggaccctgagtacctgaagtgcaggaagctgtttgtgatgctgacctgtgccttccgctatggaagagatgacctggaggtgattggcctgaccttcaggaaggacctgtatgtgcagaccctgcaggtggtgcctgctgagagcagcagcccccagggccccctgactgtgctgcaggagcggctgctgcacaagctgggggacaatgcctaccccttcaccctgcagatggtgaccaacctgccctgcagcgtgaccctgcagcccggcccagaagatgctgggaagccctgtggcatcgactttgaggtgaagagcttctgtgctgaaaatcctgaggagaccgtgtccaagagggactatgtgcggctggtggtgaggaaggtgcagtttgcccctcctgaggccggccctggccccagcgcccagaccatccgccgcttcctgctgagcgcccagcccctgcagctgcaggcctggatggaccgggaggtgcactaccatggagagcccatctctgtgaatgtgtccatcaacaactgcaccaacaaggtgatcaagaagatcaagatctctgtggaccagatcacagatgtggtgctgtacagcctggacaagtacaccaagacagtgttcatccaggagttcacagagaccgtggccgccaacagcagcttcagccagagctttgctgtgacccccatcctggccgccagctgccagaagaggggcctggccctggatggcaagctgaagcatgaggacaccaacctggccagcagcaccatcatccggcccggcatggacaaggagctgctgggcatcctggtgtcctacaaggtgcgggtgaacctgatggtgtcctgtggcggcatcctgggggacctgacagccagtgatgtgggcgtggagctgcccctggtgctgatccaccccaagcccagccatgaagctgccaggtag

SEQ ID NO: 144064 - DNA, 993 bp, Artificial Sequence
  Description of Artificial Sequence: Synthetic coding sequence
atgggagagaagccaggcaccagggtcttcaagaagagcagccccaactgcaagctgactgtgtacctgggcaagagggactttgtggaccacctggacaaggtggaccctgtggatggagtggtgctggtggaccctgactacctgaaggacaggaaggtgtttgtgaccctgacctgtgccttccgctatggaagagaggacctggatgtgctgggcctgtccttcaggaaggacctcttcatcgccacctaccaggccttcccccctgtgcccaacccccccaggcctcccacccggctgcaggaccggctgctgaggaagctgggccagcacgcccaccccttcttcttcaccatcccccagaacctgccctgcagcgtgaccctgcagcccggcccagaagatactgggaaggcctgtggggtggactttgagatccgggccttctgtgccaagagcctggaggagaagagccacaagaggaacagcgtgcggctggtgatcaggaaggtgcagtttgcccctgagaagccaggcccccagcccagcgctgagaccaccaggcacttcctgatgtctgacaggagcctgcacctggaggccagcctggacaaggagctgtactaccatggagagcccctgaatgtgaatgtgcacgtgaccaacaacagcaccaagacagtgaagaagatcaaggtgtctgtgcggcagtatgctgacatctgcctcttcagcacagcccagtacaagtgccctgtggcccagctggagcaggatgaccagcgggagggcggctgccagcagggcggggccggcaaccctggggtgctgcagggccagggcgaggccggcggcgtgtccagaagaggctgcctgtgtggggccgccttctgcagctatgccccccaggccccccggccccaccccccaccccagacccctgtgagccgcagcggggaccgctgcccctgtggccaccagccccactag

SEQ ID NO: 144065 - DNA, 1245 bp, Artificial Sequence
  Description of Artificial Sequence: Synthetic coding sequence
atggtgctgggcaaggtgaagagcctgaccatcagctttgactgcctgaatgacagcaatgtgcctgtgtacagcagcggggacacagtgtctggccgggtgaacctggaggtgactggagagatccgggtgaagagcctgaagatccacgcccggggccacgccaaggtgcgctggacagagagcagaaatgccggcagcaacacagcctacacccagaactacacagaggaggtggagtacttcaaccacaaggacatcctgattggacatgaaagagatgatgacaacagcgaggagggcttccacaccatccacagcggcagacatgaatatgccttctcctttgagctgccccagacccccctggccaccagctttgagggcagacatggctctgtgcgctactgggtgaaggccgagctgcaccggccctggctgctgcctgtgaagctgaagaaggagttcaccgtgtttgagcacatcgacatcaacacccccagcctgctgagcccccaggccggcaccaaggagaagaccctgtgctgctggttctgcaccagcggccccatcagcctgagcgccaagattgaaaggaagggctacaccccaggagagagcatccagatctttgctgagattgagaactgcagcagcaggatggtggtgcccaaggccgccatctaccagacccaggccttctacgccaagggcaagatgaaggaggtgaagcagctggtggccaacctgcggggggagagcctgagcagcggcaagacagagacctggaatggcaagctgctgaagatcccccctgtgagccccagcatcctggactgcagcatcatccgggtggagtacagcctgatggtgtatgtggacatccctggggccatggacctcttcctgaacctgcccctggtgattggcaccatccccctgcaccccttcggcagcaggaccagctctgtgagcagccagtgcagcatgaacatgaactggctgagcctgagcctgcctgagaggcctgaggccccacccagctatgcagaggtggtgacagaggagcagaggaggaacaacctggcccctgtgtctgcctgtgatgactttgagcgggccctgcagggccccctgtttgcctacatccaggagttccgcttcctgcccccacccctgtacagcgagattgaccccaacccagaccagagcgcagatgaccggcccagctgccccagcaggtag

SEQ ID NO: 144066 - DNA, 1233 bp, Artificial Sequence
  Description of Artificial Sequence: Synthetic coding sequence
atgggagacaagggcaccagggtcttcaagaaggccagccccaacgggaagctgactgtgtacctgggcaagagggactttgtggaccacatcgacctggtggaccctgtggatggagtggtgctggtggaccctgagtacctgaaggagaggagagtgtatgtgaccctgacctgtgccttccgctatggccgggaggacctggatgtgctgggcctgaccttcaggaaggacctgtttgtggccaacgtgcagagcttccccccagcccctgaggacaagaagcccctgacccggctgcaggagcggctcatcaagaagctgggggagcacgcctaccccttcacctttgagatcccccccaacctgccctgcagcgtgaccctgcagcccggccctgaggacaccgggaaggcctgtggggtggactatgaggtgaaggccttctgtgccgagaacctggaggagaagatccacaagagaaattctgtgcggctggtgatcaggaaggtgcagtatgcccctgagcggcccggcccccagcccacagctgagaccacccggcagttcctgatgtctgacaagcccctgcacctggaggccagcctggacaaggagatctactaccacggggagcccatctctgtgaatgtgcacgtgaccaacaacaccaacaagacagtgaagaagatcaagatctctgtgcggcagtatgctgacatctgcctcttcaacacagcccagtacaagtgccctgtggccatggaggaggctgatgacacagtggcccccagcagcaccttctgcaaggtgtacaccctgacccccttcctggccaacaaccgggagaagaggggcctggccctggatggcaagctgaagcatgaggacaccaacctggccagcagcaccctgctgcgggagggcgccaaccgggagatcctgggcatcatcgtgtcctacaaggtgaaggtgaagctggtggtgtccagaggaggagatgtggccgtggagctgcccttcaccctgatgcaccccaagcccaaggaggagcccccccaccgggaggtgcctgaaaatgagacccctgtggacaccaacctgattgagctggacaccaatgatgatgacatcgtgtttgaagattttgcccggcagaggctgaagggcatgaaggatgacaaggaggaggaggaggatggcaccggcagcccccagctgaacaacagatag

SEQ ID NO: 144067 - DNA, 1257 bp, Artificial Sequence
  Description of Artificial Sequence: Synthetic coding sequence
atgggagacaagggcaccagggtcttcaagaaggccagccccaacgggaagctgactgtgtacctgggcaagagggactttgtggaccacatcgacctggtggaccctgtggatggagtggtgctggtggaccctgagtacctgaaggagaggagagtgtatgtgaccctgacctgtgccttccgctatggccgggaggacctggatgtgctgggcctgaccttcaggaaggacctgtttgtggccaacgtgcagagcttccccccagcccctgaggacaagaagcccctgacccggctgcaggagcggctcatcaagaagctgggggagcacgcctaccccttcacctttgagatcccccccaacctgccctgcagcgtgaccctgcagcccggccctgaggacaccgggaaggcctgtggggtggactatgaggtgaaggccttctgtgccgagaacctggaggagaagatccacaagagaaattctgtgcggctggtgatcaggaaggtgcagtatgcccctgagcggcccggcccccagcccacagctgagaccacccggcagttcctgatgtctgacaagcccctgcacctggaggccagcctggacaaggagatctactaccacggggagcccatctctgtgaatgtgcacgtgaccaacaacaccaacaagacagtgaagaagatcaagatctctgtgcggcagtatgctgacatctgcctcttcaacacagcccagtacaagtgccctgtggccatggaggaggctgatgacacagtggcccccagcagcaccttctgcaaggtgtacaccctgacccccttcctggccaacaaccgggagaagaggggcctggccctggatggcaagctgaagcatgaggacaccaacctggccagcagcaccctgctgcgggagggcgccaaccgggagatcctgggcatcatcgtgtcctacaaggtgaaggtgaagctggtggtgtcccggggcggcctgctgcggggcctgtgcttcagtgatgtggccgtggagctgcccttcaccctgatgcaccccaagcccaaggaggagcccccccaccgggaggtgcctgaaaatgagacccctgtggacaccaacctgattgagctggacaccaatgatgatgacatcgtgtttgaagattttgcccggcagaggctgaagggcatgaaggatgacaaggaggaggaggaggatggcaccggcagcccccagctgaacaacagatag

SEQ ID NO: 144068 - DNA, 1257 bp, Artificial Sequence
  Description of Artificial Sequence: Synthetic coding sequence
atgggagacaagggcaccagggtcttcaagaaggccagccccaacgggaagctgactgtgtacctgggcaagagggactttgtggaccacatcgacctggtggaccctgtggatggagtggtgctggtggaccctgagtacctgaaggagaggagagtgtatgtgaccctgacctgtgccttccgctatggccgggaggacctggatgtgctgggcctgaccttcaggaaggacctgtttgtggccaacgtgcagagcttccccccagcccctgaggacaagaagcccctgacccggctgcaggagcggctcatcaagaagctgggggagcacgcctaccccttcacctttgagatcccccccaacctgccctgcagcgtgaccctgcagcccggccctgaggacaccgggaaggcctgtggggtggactatgaggtgaaggccttctgtgccgagaacctggaggagaagatccacaagagaaattctgtgcggctggtgatcaggaaggtgcagtatgcccctgagcggcccggcccccagcccacagctgagaccacccggcagttcctgatgtctgacaagcccctgcacctggaggccagcctggacaaggagatctactaccacggggagcccatctctgtgaatgtgcacgtgaccaacaacaccaacaagacagtgaagaagatcaagatctctgtgcggcagtatgctgacatctgcctcttcaacacagcccagtacaagtgccctgtggccatggaggaggctgatgacacagtggcccccagcagcaccttctgcaaggtgtacaccctgacccccttcctggccaacaaccgggagaagaggggcctggccctggatggcaagctgaagcatgaggacaccaacctggccagcagcaccctgctgcgggagggcgccaaccgggagatcctgggcatcatcgtgtcctacaaggtgaaggtgaagctggtggtgtcccggggcggcctgctgggggacctggccagcagtgatgtggccgtggagctgcccttcaccctgatgcaccccaagcccaaggaggagcccccccaccgggaggtgcctgaaaatgagacccctgtggacaccaacctgattgagctggacaccaatgatgatgacatcgtgtttgaagattttgcccggcagaggctgaagggcatgaaggatgacaaggaggaggaggaggatggcaccggcagcccccagctgaacaacagatag

SEQ ID NO: 144069 - DNA, 1230 bp, Artificial Sequence
  Description of Artificial Sequence: Synthetic coding sequence
atgggagagaagccaggcaccagggtcttcaagaagagcagccccaactgcaagctgactgtgtacctgggcaagagggactttgtggaccacctggacaaggtggaccctgtggatggagtggtgctggtggaccctgactacctgaaggacaggaaggtgtttgtgaccctgacctgtgccttccgctatggaagagaggacctggatgtgctgggcctgtccttcaggaaggacctcttcatcgccacctaccaggccttcccccctgtgcccaacccccccaggcctcccacccggctgcaggaccggctgctgaggaagctgggccagcacgcccaccccttcttcttcaccatcccccagaacctgccctgcagcgtgaccctgcagcccggcccagaagatactgggaaggcctgtggggtggactttgagatccgggccttctgtgccaagagcctggaggagaagagccacaagaggaacagcgtgcggctggtgatcaggaaggtgcagtttgcccctgagaagccaggcccccagcccagcgctgagaccaccaggcacttcctgatgtctgacaggagcctgcacctggaggccagcctggacaaggagctgtactaccatggagagcccctgaatgtgaatgtgcacgtgaccaacaacagcaccaagacagtgaagaagatcaaggtgtctgtgcggcagtatgctgacatctgcctcttcagcacagcccagtacaagtgccctgtggcccagctggagcaggatgaccaggtgagccccagcagcaccttctgcaaggtgtacaccatcacccccctgctgagtgacaaccgggagaagaggggcctggccctggatggcaagctgaagcatgaggacaccaacctggccagcagcaccatcgtgaaggagggcgccaacaaggaggtgctgggcatcctggtgtcctacagagtgaaggtgaagctggtggtgtccagaggaggagatgtgtctgtggagctgccctttgtgctgatgcaccccaagccccatgaccacatccccctgccccggccccagagcgctgcccctgagacagatgtgcctgtggacaccaacctgattgaatttgacaccaactatgccacagatgatgacatcgtgtttgaagattttgcccggctgcggctgaagggcatgaaggatgatgattatgatgaccagctgtgctag

SEQ ID NO: 144070 - DNA, 1185 bp, Artificial Sequence
  Description of Artificial Sequence: Synthetic coding sequence
atgggagagaagccaggcaccagggtcttcaagaagagcagccccaactgcaagctgactgtgtacctgggcaagagggactttgtggaccacctggacaaggtggaccctgtggtgtttgtgaccctgacctgtgccttccgctatggccgggaggacctggatgtgctgggcctgtccttcaggaaggacctcttcatcgccacctaccaggccttcccccctgtgcccaaccccccccggccccccacccggctgcaggaccggctgctgaggaagctgggccagcacgcccaccccttcttcttcaccatcccccagaacctgccctgcagcgtgaccctgcagcccggccctgaggacaccgggaaggcctgtggggtggactttgagatccgggccttctgtgccaagagcctggaggagaagagccacaagagaaattctgtgcggctggtgatcaggaaggtgcagtttgcccctgagaagccaggcccccagcccagcgctgagaccaccaggcacttcctgatgtctgacaggagcctgcacctggaggccagcctggacaaggagctgtactaccacggggagcccctgaatgtgaatgtgcacgtgaccaacaacagcaccaagacagtgaagaagatcaaggtgtctgtgcggcagtatgctgacatctgcctcttcagcacagcccagtacaagtgccctgtggcccagctggagcaggatgaccaggtgagccccagcagcaccttctgcaaggtgtacaccatcacccccctgctgagtgacaaccgggagaagaggggcctggccctggatggcaagctgaagcatgaggacaccaacctggccagcagcaccatcgtgaaggagggcgccaacaaggaggtgctgggcatcctggtgtcctacagagtgaaggtgaagctggtggtgtccagaggaggagatgtgtctgtggagctgccctttgtgctgatgcaccccaagccccatgaccacatccccctgccccggccccagagcgctgcccctgagacagatgtgcctgtggacaccaacctgattgaatttgacaccaactatgccacagatgatgacatcgtgtttgaggactttgcccggctgcggctgaagggcatgaaggatgatgattatgatgaccagctgtgctag

SEQ ID NO: 144071 - DNA, 1266 bp, Artificial Sequence
  Description of Artificial Sequence: Synthetic coding sequence
atgggagagaagccaggcaccagggtcttcaagaagagcagccccaactgcaagctgactgtgtacctgggcaagagggactttgtggaccacctggacaaggtggaccctgtggatggagtggtgctggtggaccctgactacctgaaggacaggaaggtgtttgtgaccctgacctgtgccttccgctatggaagagaggacctggatgtgctgggcctgtccttcaggaaggacctcttcatcgccacctaccaggccttcccccctgtgcccaacccccccaggcctcccacccggctgcaggaccggctgctgaggaagctgggccagcacgcccaccccttcttcttcaccatcccccagaacctgccctgcagcgtgaccctgcagcccggcccagaagatactgggaaggcctgtggggtggactttgagatccgggccttctgtgccaagagcctggaggagaagagccacaagaggaacagcgtgcggctggtgatcaggaaggtgcagtttgcccctgagaagccaggcccccagcccagcgctgagaccaccaggcacttcctgatgtctgacaggagcctgcacctggaggccagcctggacaaggagctgtactaccatggagagcccctgaatgtgaatgtgcacgtgaccaacaacagcaccaagacagtgaagaagatcaaggtgtctgtgcggcagtatgctgacatctgcctcttcagcacagcccagtacaagtgccctgtggcccagctggagcaggatgaccaggtgagccccagcagcaccttctgcaaggtgtacaccatcacccccctgctgagtgacaaccgggagaagaggggcctggccctggatggcaagctgaagcatgaggacaccaacctggccagcagcaccatcgtgaaggagggcgccaacaaggaggtgctgggcatcctggtgtcctacagagtgaaggtgaagctggtggtgtccagaggaggagatgtgtctgtggagctgccctttgtgctgatgcaccccaagccccatgaccacatccccctgccccggccccagagcgcccccacccccaccccacccctgcctgtgcccccagctgcccctgagacagatgtgcctgtggacaccaacctgattgaatttgacaccaactatgccacagatgatgacatcgtgtttgaagattttgcccggctgcggctgaagggcatgaaggatgatgattatgatgaccagctgtgctag

SEQ ID NO: 144072 - DNA, 1233 bp, Artificial Sequence
  Description of Artificial Sequence: Synthetic coding sequence
gctgccaacagagctgggggcggccgggcccaccacggcggggagacccgggaccagctgactgtgtacctgggcaagagggactttgtggaccacctggacaaggtggaccctgtggatggagtggtgctggtggaccctgactacctgaaggacaggaaggtgtttgtgaccctgacctgtgccttccgctatggccgggaggacctggatgtgctgggcctgtccttcaggaaggacctcttcatcgccacctaccaggccttcccccctgtgcccaaccccccccggccccccacccggctgcaggaccggctgctgaggaagctgggccagcacgcccaccccttcttcttcaccatcccccagaacctgccctgcagcgtgaccctgcagcccggccctgaggacaccgggaaggcctgtggggtggactttgagatccgggccttctgtgccaagagcctggaggagaagagccacaagagaaattctgtgcggctggtgatcaggaaggtgcagtttgcccctgagaagccaggcccccagcccagcgctgagaccaccaggcacttcctgatgtctgacaggagcctgcacctggaggccagcctggacaaggagctgtactaccacggggagcccctgaatgtgaatgtgcacgtgaccaacaacagcaccaagacagtgaagaagatcaaggtgtctgtgcggcagtatgctgacatctgcctcttcagcacagcccagtacaagtgccctgtggcccagctggagcaggatgaccaggtgagccccagcagcaccttctgcaaggtgtacaccatcacccccctgctgagtgacaaccgggagaagaggggcctggccctggatggcaagctgaagcatgaggacaccaacctggccagcagcaccatcgtgaaggagggcgccaacaaggaggtgctgggcatcctggtgtcctacagagtgaaggtgaagctggtggtgtccagaggaggagatgtgtctgtggagctgccctttgtgctgatgcaccccaagccccatgaccacatccccctgccccggccccagagcgctgcccctgagacagatgtgcctgtggacaccaacctgattgaatttgacaccaactatgccacagatgatgacatcgtgtttgaggactttgcccggctgcggctgaagggcatgaaggatgatgattatgatgaccagctgtgctag

SEQ ID NO: 144073 - DNA, 1047 bp, Artificial Sequence
  Description of Artificial Sequence: Synthetic coding sequence
atggctgctggggtggccggctggggcgtggaggccgaggagtttgaagatgccccagatgtggagcccctggagcccaccctgagcaacatcatcgagcagaggagcctgaagtggatctttgtgggcggcaaaggaggagtgggcaagaccacctgcagctgcagcctggccgtgcagctgagcaagggccgggagagcgtgctgatcatcagcacagatcctgcccacaacatcagtgatgcctttgaccagaagttcagcaaggtgcccaccaaggtgaagggctatgacaacctgtttgccatggagattgaccccagcctgggcgtggccgagctgcctgatgagttctttgaggaggacaacatgctgtccatgggcaagaagatgatgcaggaggccatgtctgccttccctggcattgatgaggccatgtcctatgcagaggtgatgaggctggtgaagggcatgaacttctctgtggtggtgtttgacacagcccccaccggccacaccctgcggctgctgaacttccccaccatcgtggagcggggcctgggccgcctgatgcagatcaagaaccagatcagccccttcatcagccagatgtgcaacatgctgggcctgggggacatgaatgctgaccagctggccagcaagctggaggagaccctgcctgtgatccgctctgtgtctgagcagttcaaggaccctgagcagaccaccttcatctgtgtgtgcatcgccgagttcctgagcctgtatgaaacagagcggctcatccaggagctggccaagtgcaagattgacacccacaacatcatcgtgaaccagctggtgtttcctgaccctgagaagccctgcaagatgtgtgaggcccggcacaagatccaggccaagtacctggaccagatggaggacctgtatgaggacttccacatcgtgaagctgcccctgctgccccatgaggtgagaggagctgacaaggtgaacaccttcagcgccctgctgctggagccctacaagccacccagcgcccagtag

SEQ ID NO: 144074 - DNA, 1047 bp, Artificial Sequence; identical to SEQ ID NO: 144073
  Description of Artificial Sequence: Synthetic coding sequence

SEQ ID NO: 144075 - DNA, 1128 bp, Artificial Sequence
  Description of Artificial Sequence: Synthetic coding sequence
atggccgccctgagagatgctgagatccagaaggatgtgcagacctactacggccaggtgctgaagaggtctgctgacctgcagaccaacggctgtgtgaccacagcccggcctgtgcccaagcacatccgggaggccctgcagaatgtgcatgaggaggtggccctgcgctactacggctgcggcctggtgattcctgagcacctggagaactgctggatcctggacctgggcagcggcagcggccgggactgctacgtgctgagccagctggtgggggagaagggccacgtgactggaattgacatgaccaagggccaggtggaggtggccgagaagtacctggactaccacatggagaagtatggcttccaggccagcaatgtgaccttcatccacggctacatcgagaagctgggggaggccggcatcaagaatgaaagccatgacatcgtggtgagcaactgtgtgatcaacctggtgcctgacaagcagcaggtgctgcaggaggcctacagagtgctgaagcatggaggagagctgtacttcagtgatgtgtacaccagcctggagctgcctgaggagatccgcacccacaaggtgctgtggggagaatgtctgggcggggccctgtactggaaggagctggccgtgctggcccagaagattggcttctgccccccccggctggtgacagccaacctgatcaccatccagaacaaggagctggagcgggtgattggagactgccgctttgtgtctgccaccttccgcctcttcaagcacagcaagacaggccccaccaagcgctgccaggtgatctacaacggcggcatcaccggccacgagaaggagctgatgtttgatgccaacttcaccttcaaggagggggagatcgtggaggtggatgaggagacagctgccatcctgaagaacagcagatttgcccaggacttcctgatccggcccatcggggagaagctgcccaccagcggcggctgcagcgccctggagctgaaggacatcatcacagaccccttcaagctggccgaggagagtgacagcatgaagagccgctgtgtgcctgatgctgctgggggctgctgcggcaccaagaagagctgctag

SEQ ID NO: 144076 - DNA, 816 bp, Artificial Sequence
  Description of Artificial Sequence: Synthetic coding sequence
atgggaaatggaggccgcagcggcctgcagcagggcaaaggaaatgtggatggagtggccgccacccccacagctgccagcgccagctgccagtaccgctgcatcgagtgcaaccaggaggccaaggagctgtacagagactacaaccacggcgtgctgaagatcaccatctgcaagagctgccagaagcctgtggacaagtacattgaatatgaccctgtgatcatcctgatcaatgccatcctgtgcaaggcccaggcctaccgccacatcctcttcaacacccagatcaacatccacggcaagctgtgcatcttctgcctgctgtgtgaggcctacctgcgctggtggcagctgcaggacagcaaccagaacacagccccagatgacctgatccgctatgccaaggagtgggacttctacaggatgtttgccatcgccgccctggagcagacagcctacttcatcggcatcttcaccttcctgtgggtggagcggcccatgacagccaagaagaagcccaacttcatcctgctgctgaaggccctgctgctgagcagctatggcaagctgctgctgatcccagctgtgatctgggagcatgactacacctctgtgtgcctgaagctgatcaaggtgtttgtgctgaccagcaacttccaggccatccgggtgaccctgaacatcaacaggaagctgtccttcctggccgtgctgagcggcctgctgctggagagcatcatggtgtacttcttccagagcatggagtgggatgtgggcagtgactatgccatcttcaagagccaggacttctag

SEQ ID NO: 144077 - DNA, 807 bp, Artificial Sequence
  Description of Artificial Sequence: Synthetic coding sequence
tgaggaagaagtggcctgcagcagggcaaaggaaatgtggatggagtggccgccacccccacagctgccagcgccagctgccagtaccgctgcatcgagtgcaaccaggaggccaaggagctgtacagagactacaaccacggcgtgctgaagatcaccatctgcaagagctgccagaagcctgtggacaagtacatcgagtatgaccccgtcatcatcctgatcaatgccatcctgtgcaaggcccaggcctaccgccacatcctcttcaacacccagatcaacatccacggcaagctgtgcatcttctgcctgctgtgtgaggcctacctgcgctggtggcagctgcaggacagcaaccagaacacagccccagatgacctgatccgctatgccaaggagtgggacttctacaggatgtttgccatcgccgccctggagcagacagcctacttcatcggcatcttcaccttcctgtgggtggagcggcccatgacagccaagaagaagcccaacttcatcctgctgctgaaggccctgctgctgagcagctatggcaagctgctgctgatcccagctgtgatctgggagcatgactacacctctgtgtgcctgaagctgatcaaggtgtttgtgctgaccagcaacttccaggccatccgggtgaccctgaacatcaacaggaagctgtccttcctggccgtgctgagcggcctgctgctggagagcatcatggtgtacttcttccagagcatggagtgggatgtgggcagtgactatgccatcttcaagagccaggacttctag

SEQ ID NO: 144078 - DNA, 2547 bp, Artificial Sequence
  Description of Artificial Sequence: Synthetic coding sequence
atgaacagcagcagcgccaacatcacctacgccagcaggaagaggaggaagcctgtgcagaagacagtgaagcccatcccagctgagggcatcaagagcaaccccagcaagaggcaccgggaccggctgaacacagagctggaccggctggccagcctgctgcccttcccccaggatgtgatcaacaagctggacaagctgtctgtgctgcggctgtctgtgtcctacctgcgggccaagagcttctttgatgtggccctgaagagcagccccacagaaagaaatggaggccaggacaactgcagagctgccaacttccgggagggcctgaacctgcaggagggggagttcctgctgcaggccctgaatggatttgtgctggtggtgaccacagatgccctggtgttctacgccagcagcaccatccaggactacctgggcttccagcagagtgatgtgatccaccagagcgtgtatgagctgatccacacagaagatagagctgagttccagaggcagctgcactgggccctgaaccccagccagtgcacagagagcggccagggcatcgaggaggccaccggcctgccccagacagtggtgtgctacaacccagaccagatccccccagagaacagccccctgatggagcgctgcttcatctgccgcctgcgctgcctgctggacaacagcagcggcttcctggccatgaacttccagggcaagctgaagtacctgcacggccagaagaagaagggcaaggatggcagcatcctgcccccccagctggccctgtttgccatcgccacccccctgcagccccccagcatcctggagatccgcaccaagaacttcatcttccgcaccaagcacaagctggacttcacccccatcggctgtgatgccaagggccgcatcgtgctgggctacacagaagctgagctgtgcacccggggcagcggctaccagttcatccatgctgctgacatgctgtactgtgccgagagccacatccgcatgatcaagacaggagagagcggcatgattgtgttccggctgctgaccaagaacaaccgctggacctgggtgcagagcaatgcccggctgctgtacaagaatggccgcccagactacatcatcgtgacccagaggcccctgacagatgaggagggcacagagcacctgaggaagaggaacaccaagctgcccttcatgttcaccaccggggaggccgtgctgtatgaggccaccaaccccttccctgccatcatggaccccctgcccctgcggaccaagaatggcaccagcggcaaggacagcgccaccaccagcaccctgagcaaggacagcctgaaccccagcagcctgctggccgccatgatgcagcaggatgagagcatctacctgtacccagccagcagcaccagcagcacagccccctttgagaacaacttcttcaatgaatccatgaatgaatgtagaaactggcaggacaacacagcccccatgggaaatgacaccatcctgaagcatgagcagattgaccagccccaggatgtgaacagctttgctgggggccaccctggcctcttccaggacagcaagaacagcgacctgtacagcatcatgaagaacctgggcatcgactttgaggacatccgccacatgcagaatgagaagttcttcagaaatgacttctctggagaggtggacttccgggacatcgacctgacagatgagatcctgacctacgtgcaggacagcctgagcaagagccccttcatccccagcgactaccagcagcagcagagcctggccctgaacagcagctgcatggtgcaggagcacctgcacctggagcagcagcagcagcaccaccagaagcaggtggtggtggagccccagcagcagctgtgccagaagatgaagcacatgcaggtgaatggcatgtttgagaactggaacagcaaccagtttgtgcccttcaactgcccccagcaggacccccagcagtacaacgtgttcacagacctgcacggcatcagccaggagttcccctacaagtctgagatggacagcatgccctacacccagaacttcatcagctgcaaccagcctgtgctgccccagcacagcaaatgtacagagctggactaccccatgggcagctttgagcccagcccctaccccaccaccagcagcctggaggactttgtgacctgcctgcagctgcctgagaaccagaagcacggcctgaacccccagagcgccatcatcaccccccagacctgctacgccggggctgtgtccatgtaccagtgccagcctgagccccagcacacccacgtgggccagatgcagtacaaccctgtgctgcccggccagcaggccttcctgaacaagttccagaatggagtgctgaatgagacctacccagctgagctgaacaacatcaacaacacccagaccaccacccacctgcagcccctgcaccaccccagcgaggcccggcccttcccagacctgaccagcagcggcttcctgtag

SEQ ID NO: 144079 - DNA, 2547 bp, Artificial Sequence; identical to SEQ ID NO: 144078
  Description of Artificial Sequence: Synthetic coding sequence

SEQ ID NO: 144080 - DNA, 993 bp, Artificial Sequence
  Description of Artificial Sequence: Synthetic coding sequence
atggctgacatcatcgcccggctgcgggaggatggcatccagaagagggtcatccaggagggccgcggggagctgcctgacttccaggacggcaccaaggccaccttccactaccgcaccctgcacagtgatgatgagggcaccgtgctggatgacagccgggcccggggcaagcccatggagctgatcatcggcaagaagttcaagctgcctgtgtgggagaccatcgtgtgcaccatgagggagggggagatcgcccagttcctgtgtgacatcaagcacgtggtgctgtaccccctggtggccaagagcctgaggaacattgctgtgggcaaggaccccctggagggccagaggcactgctgcggcgtggcccagatgagggagcacagcagcctgggccacgccgacctggatgccctgcagcagaacccccagcccctcatcttccacatggagatgctgaaggtggagagccctggcacctaccagcaggacccctgggccatgacagatgaggagaaggccaaggctgtgcccctcatccaccaggagggcaacagactctaccgggagggccacgtgaaggaggccgccgccaagtactatgatgccatcgcctgcctgaagaacctgcagatgaaggagcagcccggcagccctgagtggatccagctggaccagcagatcacccccctgctgctgaactactgccagtgcaagctggtggtggaggagtactatgaggtgctggaccactgcagcagcatcctgaacaagtatgatgacaacgtgaaggcctacttcaagaggggcaaggcccacgccgctgtgtggaatgcccaggaggcccaggccgactttgccaaggtgctggagctggaccctgccctggcccctgtggtgtcccgggagctgcaggccctggaggcccgcatccggcagaaggatgaggaggacaaggcccgcttccggggcatcttcagccactag

SEQ ID NO: 144081 - DNA, 966 bp, Artificial Sequence
  Description of Artificial Sequence: Synthetic coding sequence
atggatgctgccctgctgctgaatgtggagggcgtgaagaagaccatcctgcacggcggcactggagagctgcccaacttcatcaccggcagcagggtcatcttccacttccgcaccatgaagtgtgatgaggagaggacagtgattgatgacagccggcaggtgggccagcccatgcacatcatcatcggcaacatgttcaagctggaggtgtgggagatcctgctgacctccatgagggtgcatgaggtggccgagttctggtgtgacaccatcgtggatgcccccagcgactaccagcgggagacctggaacctgagcaaccacgagaagatgaaggctgtgcctgtgctgcatggagagggcaacagactcttcaagctgggccgctatgaggaggccagcagcaagtaccaggaggccatcatctgcctgaggaacctgcagaccaaggagaagccctgggaggtgcagtggctgaagctggagaagatgatcaacaccctcatcctgaactactgccagtgcctgctgaagaaggaggagtactatgaggtgctggagcacaccagtgacatcctgcggcaccaccctggcatcgtgaaggcctactacgtgcgggcccgggcccacgccgaggtgtggaatgaggccgaggccaaggctgacctgcagaaggtgctggagctggagcccagcatgcagaaggctgtgagaagagagctgcggctgctggagaacaggatggccgagaagcaggaggaggagcggctgcgctgcaggaacatgctgagccagggcgccacccagcccccagctgagcccccaacagagcccccagcccagagcagcacagagcccccagctgagcccccaacagcccccagcgctgagctgtctgctggccccccagctgagcccgccacagagcccccacccagccctggccacagcctgcagcactag

SEQ ID NO: 144082 - DNA, 975 bp, Artificial Sequence
  Description of Artificial Sequence: Synthetic coding sequence
atggatgctgccctgctgctgaatgtggagggcgtgaagaagaccatcctgcacggcggcactggagagctgcccaacttcatcaccggcagccgccacactggagtgtaccccatcctgagccgcagcctgcggcagatggcccagggcaaggaccccacagagtggcacgtgcacacctgtggcctggccaacatgtttgcctaccacaccctgggctatgaggacctggatgagctgcagaaggagccccagcccctggtgtttgtgattgagctgctgcaggtggatgcccccagcgactaccagcgggagacctggaacctgagcaaccacgagaagatgaaggctgtgcctgtgctgcacggggagggcaacagactcttcaagctgggccgctatgaggaggccagcagcaagtaccaggaggccatcatctgcctgaggaacctgcagaccaaggagaagccctgggaggtgcagtggctgaagctggagaagatgatcaacaccctcatcctgaactactgccagtgcctgctgaagaaggaggagtactatgaggtgctggagcacaccagtgacatcctgcggcaccaccctggcatcgtgaaggcctactacgtgcgggcccgggcccatgctgaggtgtggaatgaagctgaggccaaggctgacctgcagaaggtgctggagctggagcccagcatgcagaaggctgtgcggcgggagctgcggctgctggagaacaggatggccgagaagcaggaggaggagcggctgcgctgcaggaacatgctgagccagggcgccacccagcccccagctgagcccccaacagagcccccagcccagagcagcacagagcccccagctgagcccccaacagcccccagcgctgagctgtctgctggccccccagctgagcccgccacagagcccccacccagccctggccacagcctgcagcactag

SEQ ID NO: 144083 - DNA, 1155 bp, Artificial Sequence
  Description of Artificial Sequence: Synthetic coding sequence
atggatgctgccctgctgctgaatgtggagggcgtgaagaagaccatcctgcacggcggcactggagagctgcccaacttcatcaccggcagcagggtcatcttccacttccgcaccatgaagtgtgatgaggagaggacagtgattgatgacagccggcaggtgggccagcccatgcacatcatcatcggcaacatgttcaagctggaggtgtgggagatcctgctgacctccatgagggtgcatgaggtggccgagttctggtgtgacaccatccacactggagtgtaccccatcctgagccgcagcctgcggcagatggcccagggcaaggaccccacagagtggcacgtgcacacctgtggcctggccaacatgtttgcctaccacaccctgggctatgaggacctggatgagctgcagaaggagccccagcccctggtgtttgtgattgagctgctgcaggtggatgcccccagcgactaccagcgggagacctggaacctgagcaaccacgagaagatgaaggctgtgcctgtgctgcacggggagggcaacagactcttcaagctgggccgctatgaggaggccagcagcaagtaccaggaggccatcatctgcctgaggaacctgcagaccaaggagaagccctgggaggtgcagtggctgaagctggagaagatgatcaacaccctcatcctgaactactgccagtgcctgctgaagaaggaggagtactatgaggtgctggagcacaccagtgacatcctgcggcaccaccctggcatcgtgaaggcctactacgtgcgggcccgggcccatgctgaggtgtggaatgaagctgaggccaaggctgacctgcagaaggtgctggagctggagcccagcatgcagaaggctgtgcggcgggagctgcggctgctggagaacaggatggccgagaagcaggaggaggagcggctgcgctgcaggaacatgctgagccagggcgccacccagcccccagctgagcccccaacagagcccccagcccagagcagcacagagcccccagctgagcccccaacagcccccagcgctgagctgtctgctggccccccagctgagcccgccacagagcccccacccagccctggccacagcctgcagcactag

SEQ ID NO: 144084 - DNA, 981 bp, Artificial Sequence
  Description of Artificial Sequence: Synthetic coding sequence
atggatgctgccctgctgctgaatgtggagggcgtgaagaagaccatcctgcacggcggcactggagagctgcccaacttcatcaccggcagcagggtcatcttccacttccgcaccatgaagtgtgatgaggagaggacagtgattgatgacagccggcaggtgggccagcccatgcacatcatcatcggcaacatgttcaagctggaggtgtgggagatcctgctgacctccatgagggtgcatgaggtggccgagttctggtgtgacaccatccacactggagtgtaccccatcctgagccgcagcctgcggcagatggcccagggcaaggaccccacagagtggcacgtgcacacctgtggcctggccaacatgtttgcctaccacaccctgggctatgaggacctggatgagctgcagaaggagccccagcccctggtgtttgtgattgagctgctgcaggtggatgcccccagcgactaccagcgggagacctggaacctgagcaaccacgagaagatgaaggctgtgcctgtgctgcacggggagggcaacagactcttcaagctgggccgctatgaggaggccagcagcaagtaccaggaggccatcatctgcctgaggaacctgcagaccaaggagaagccctgggaggtgcagtggctgaagctggagaagatgatcaacaccctcatcctgaactactgccagtgcctgctgaagaaggaggagtactatgaggtgctggagcacaccagtgacatcctgcggcaccaccctggcatcgtgaaggcctactacgtgcgggcccgggcccatgctgaggtgtggaatgaagctgaggccaaggctgacctgcagaaggtgctggagctggagcccagcatgcagaaggctgtgcggcgggagctgcggctgctggagaatgcctggaggaggagcagaagaagaagtggctgtgccgccggcacctgctag

SEQ ID NO: 144085 - DNA, 975 bp, Artificial Sequence; identical to SEQ ID NO: 144082
  Description of Artificial Sequence: Synthetic coding sequence

SEQ ID NO: 144086 - DNA, 1251 bp, Artificial Sequence
  Description of Artificial Sequence: Synthetic coding sequence
atggccgccaccacagccaaccctgagatgaccagtgatgtgcccagcctgggccctgccatcgccagcggcaacagcggccctggcatccagggcggcggggccatcgtgcagagggccatcaagagaagacctggcctggactttgatgatgatggagagggcaacagcaagttcctgcgctgtgatgatgaccagatgagcaatgacaaggagagatttgcccggagtgatgatgagcagagcagcgctgacaaggagcggctggcccgggagaaccacagcgagattgaaagaagaagaagaaacaagatgacagcctacatcacagagctgagtgacatggtgcccacctgcagcgccctggccaggaagccagacaagctgaccatcctgaggatggctgtgagccacatgaagagcctgcggggcactggaaacaccagcacagatggcagctacaagcccagcttcctgacagaccaggagctgaagcacctgatcctggaggccgcagatggcttcctgttcatcgtgtcctgtgaaacaggccgggtggtgtatgtgtctgacagcgtgacccctgtgctgaaccagccccagagcgagtggtttggcagcaccctgtatgaccaggtgcacccagatgatgtggacaagctgcgggagcagctgagcaccagtgaaaatgccctgaccggccgcatcctggacctgaagacaggaacagtgaagaaggagggccagcagagctccatgaggatgtgcatgggcagccgccgctccttcatctgcaggatgagatgtggcagcagctctgtggaccctgtgtctgtgaaccggctgagctttgtgaggaaccgctgcagaaatggcctgggctctgtgaaggatggagagccccactttgtggtggtgcactgcaccggctacatcaaggcctggcccccagctggggtgtccctgcctgatgatgatcctgaggccggccagggcagcaagttctgcctggtggccatcggccgcctgcaggtgaccagcagccccaactgcacagacatgagcaatgtgtgccagcccacagagttcatcagccgccacaacatcgagggcatcttcacctttgtggaccaccgctgtgtggccaccgtgggctaccagccccaggagctgctgggcaagaacatcgtggagttctgccaccctgaggaccagcagctgctgcgggacagcttccagcaggagctgtag

SEQ ID NO: 144087 - DNA, 2223 bp, Artificial Sequence
  Description of Artificial Sequence: Synthetic coding sequence
atgtaccaccactgggtgcagcccctgcccctggagaccctggacctggagttcaaggtggaggagcccctgagccggggcctgctgagcggggaccaggccggcctgaagtacctgctgctggccttcctgcggctggactttgatgatgatggagagggcaacagcaagttcctgcgctgtgatgatgaccagatgagcaatgacaaggagagatttgcccgggagaaccacagcgagattgaaagaagaagaagaaacaagatgacagcctacatcacagagctgagtgacatggtgcccacctgcagcgccctggccaggaagccagacaagctgaccatcctgaggatggctgtgagccacatgaagagcctgcggggcactggaaacaccagcacagatggcagctacaagcccagcttcctgacagaccaggagctgaagcacctgatcctggaggccgcagatggcttcctgttcatcgtgtcctgtgaaacaggccgggtggtgtatgtgtctgacagcgtgacccctgtgctgaaccagccccagagcgagtggtttggcagcaccctgtatgaccaggtgcacccagatgatgtggacaagctgcgggagcagctgagcaccagtgaaaatgccctgaccggccgcatcctggacctgaagacaggaacagtgaagaaggagggccagcagagctccatgaggatgtgcatgggcagccgccgctccttcatctgcaggatgagatgtggcagcagctctgtggaccctgtgtctgtgaaccggctgagctttgtgaggaaccgctgcagaaatggcctgggctctgtgaaggatggagagccccactttgtggtggtgcactgcaccggctacatcaaggcctggcccccagctggggtgtccctgcctgatgatgatcctgaggccggccagggcagcaagttctgcctggtggccatcggccgcctgcaggtgaccagcagccccaactgcacagacatgagcaatgtgtgccagcccacagagttcatcagccgccacaacatcgagggcatcttcacctttgtggaccaccgctgtgtggccaccgtgggctaccagccccaggagctgctgggcaagaacatcgtggagttctgccaccctgaggaccagcagctgctgcgggacagcttccagcaggtggtgaagctgaagggccaggtgctgtctgtgatgttccgcttccgcagcaagaaccaggagtggctgtggatgaggaccagcagcttcaccttccagaacccctacagtgatgaaattgagtacatcatctgcaccaacaccaacgtgaagcccctgacctaccggcagcagcagcagcagacagagctggacatggtgcccggcagagatggcctggccagctacaaccacagccaggtggtgcagcctgtgaccaccaccggccctgagcacagcaagcccctggagaagagtgatggcctgtttgcccaggaccgggacccccgcttcagcgagatctaccacaacatcaatgctgaccagagcaagggcatcagcagcagcacagtgcctgccacccagcagctgttcagccagggcaacaccttcccccccacccccaggcctgctgagaacttcagaaattctggcctggcccctcctgtgaccatcgtgcagcccagcgccagcgctggccagatgctggcccagatcagccgccacagcaaccccacccagggcgccacccccacctggacccccaccaccaggagcggcttcagcgcccaggtggccacccaggccacagccaagaccaggaccagccagtttggagtgggcagcttccagacccccagcagcttcagctccatgagcctgcccggggcccccacagccagccctggagctgctgcctaccccagcctgaccaacagaggcagcaactttgcccctgagaccggccagacagctggccagttccagaccaggacagctgagggcgtgggcgtgtggccccagtggcagggccagcagccccaccacaggagcagcagcagcgagcagcacgtgcagcagcccccagcccagcagcccggccagcctgaggtgttccaggagatgctgtccatgctgggggaccagagcaacagctacaacaatgaggagttcccagacctgaccatgttcccccccttcagcgagtag

SEQ ID NO: 144088 - DNA, 1251 bp, Artificial Sequence; identical to SEQ ID NO: 144086
  Description of Artificial Sequence: Synthetic coding sequence

SEQ ID NO: 144089 - DNA, 2325 bp, Artificial Sequence
  Description of Artificial Sequence: Synthetic coding sequence
atggccgccaccacagccaaccctgagatgaccagtgatgtgcccagcctgggccctgccatcgccagcggcaacagcggccctggcatccagggcggcggggccatcgtgcagagggccatcaagagaagacctggcctggactttgatgatgatggagagggcaacagcaagttcctgcgctgtgatgatgaccagatgagcaatgacaaggagagatttgcccgggagaaccacagcgagattgaaagaagaagaagaaacaagatgacagcctacatcacagagctgagtgacatggtgcccacctgcagcgccctggccaggaagccagacaagctgaccatcctgaggatggctgtgagccacatgaagagcctgcggggcaccggcaacaccagcacagatggcagctacaagcccagcttcctgacagaccaggagctgaagcacctgatcctggaggccgcagatggcttcctgttcatcgtgtcctgtgagaccggccgggtggtgtatgtgtctgattctgtgacccctgtgctgaaccagccccagagcgagtggtttggcagcaccctgtatgaccaggtgcacccagatgatgtggacaagctgcgggagcagctgagcaccagtgaaaatgccctgaccggccgcatcctggacctgaagacaggcaccgtgaagaaggagggccagcagagctccatgaggatgtgcatgggcagcagaagaagcttcatctgcaggatgagatgtggcagcagctctgtggaccctgtgtctgtgaaccggctgagctttgtgaggaaccgctgcagaaatggcctgggctctgtgaaggatggagagccccactttgtggtggtgcactgcaccggctacatcaaggcctggcccccagctggggtgtccctgcctgatgatgatcctgaggccggccagggcagcaagttctgcctggtggccatcggccgcctgcaggtgaccagcagccccaactgcacagacatgagcaatgtgtgccagcccacagagttcatcagccgccacaacatcgagggcatcttcacctttgtggaccaccgctgtgtggccaccgtgggctaccagccccaggagctgctgggcaagaacatcgtggagttctgccaccctgaggaccagcagctgctgcgggacagcttccagcaggtggtgaagctgaagggccaggtgctgtctgtgatgttccgcttccgcagcaagaaccaggagtggctgtggatgaggaccagcagcttcaccttccagaacccctacagtgatgaaattgagtacatcatctgcaccaacaccaacgtgaagaacagcagccaggagccccggcccaccctgagcaacaccatccagaggccccagctgggccccacagccaacctgcccctggagatgggcagcggccagctggccccccggcagcagcagcagcagacagagctggacatggtgcccggcagagatggcctggccagctacaaccacagccaggtggtgcagcctgtgaccaccactggacctgagcacagcaagcccctggagaagagtgatggcctgtttgcccaggaccgggacccccgcttcagcgagatctaccacaacatcaatgctgaccagagcaagggcatcagcagcagcacagtgcctgccacccagcagctgttcagccagggcaacaccttcccccccacccccaggcctgctgagaacttcaggaacagcggcctggcccctcctgtgaccatcgtgcagcccagcgccagcgctggccagatgctggcccagatcagccgccacagcaaccccacccagggcgccacccccacctggacccccaccaccaggagcggcttcagcgcccagcaggtggccacccaggccacagccaagaccaggaccagccagtttggagtgggcagcttccagacccccagcagcttcagctccatgagcctgcccggggcccccacagccagccctggagctgctgcctaccccagcctgaccaacagaggcagcaactttgcccctgagaccggccagacagctggccagttccagaccaggacagctgagggcgtgggcgtgtggccccagtggcagggccagcagccccaccacaggagcagcagcagcgagcagcacgtgcagcagcccccagcccagcagcccggccagcctgaggtgttccaggagatgctgtccatgctgggggaccagagcaacagctacaacaatgaggagttcccagacctgaccatgttcccccccttcagcgagtag

SEQ ID NO: 144090 - DNA, 2328 bp, Artificial Sequence
  Description of Artificial Sequence: Synthetic coding sequence
atgaccagtgatgtgcccagcctgggccctgccatcgccagcggcaacagcggccctggcatccagggcggcggggccatcgtgcagagggccatcaagaggcggcccggcctggactttgatgatgatggagagggcaacagcaagttcctgcgctgtgatgatgaccagatgagcaatgacaaggagagatttgcccggagtgatgatgagcagagcagcgctgacaaggagcggctggcccgggagaaccacagcgagattgaaagaagaagaagaaacaagatgacagcctacatcacagagctgagtgacatggtgcccacctgcagcgccctggccaggaagccagacaagctgaccatcctgaggatggctgtgagccacatgaagagcctgcggggcaccggcaacaccagcacagatggcagctacaagcccagcttcctgacagaccaggagctgaagcacctgatcctggaggccgcagatggcttcctgttcatcgtgtcctgtgagaccggccgggtggtgtatgtgtctgattctgtgacccctgtgctgaaccagccccagagcgagtggtttggcagcaccctgtatgaccaggtgcacccagatgatgtggacaagctgcgggagcagctgagcaccagtgaaaatgccctgaccggccgcatcctggacctgaagacaggcaccgtgaagaaggagggccagcagagctccatgaggatgtgcatgggcagcagaagaagcttcatctgcaggatgagatgtggcagcagctctgtggaccctgtgtctgtgaaccggctgagctttgtgaggaaccgctgcagaaatggcctgggctctgtgaaggatggagagccccactttgtggtggtgcactgcaccggctacatcaaggcctggcccccagcagatgatgatcctgaggccggccagggcagcaagttctgcctggtggccatcggccgcctgcaggtgaccagcagccccaactgcacagacatgagcaatgtgtgccagcccacagagttcatcagccgccacaacatcgagggcatcttcacctttgtggaccaccgctgtgtggccaccgtgggctaccagccccaggagctgctgggcaagaacatcgtggagttctgccaccctgaggaccagcagctgctgcgggacagcttccagcaggtggtgaagctgaagggccaggtgctgtctgtgatgttccgcttccgcagcaagaaccaggagtggctgtggatgaggaccagcagcttcaccttccagaacccctacagtgatgaaattgagtacatcatctgcaccaacaccaacgtgaagaacagcagccaggagccccggcccaccctgagcaacaccatccagaggccccagctgggccccacagccaacctgcccctggagatgggcagcggccagctggccccccggcagcagcagcagcagacagagctggacatggtgcccggcagagatggcctggccagctacaaccacagccaggtggtgcagcctgtgaccaccaccggccctgagcacagcaagcccctggagaagagtgatggcctgtttgcccaggaccgggacccccgcttcagcgagatctaccacaacatcaatgctgaccagagcaagggcatcagcagcagcacagtgcctgccacccagcagctgttcagccagggcaacaccttcccccccacccccaggcctgctgagaacttcagaaattctggcctggcccctcctgtgaccatcgtgcagcccagcgccagcgctggccagatgctggcccagatcagccgccacagcaaccccacccagggcgccacccccacctggacccccaccaccaggagcggcttcagcgcccagcaggtggccacccaggccacagccaagaccaggaccagccagtttggagtgggcagcttccagacccccagcagcttcagctccatgagcctgcccggggcccccacagccagccctggagctgctgcctaccccagcctgaccaacagaggcagcaactttgcccctgagaccggccagacagctggccagttccagaccaggacagctgagggcgtgggcgtgtggccccagtggcagggccagcagccccaccacaggagcagcagcagcgagcagcacgtgcagcagcccccagcccagcagcccggccagcctgaggtgttccaggagatgctgtccatgctgggggaccagagcaacagctacaacaatgaggagttcccagacctgaccatgtttcctcccttcagcgagtag

SEQ ID NO: 144091 - DNA, 1428 bp, Artificial Sequence
  Description of Artificial Sequence: Synthetic coding sequence
atgtctgccacagctgctgccaggaagaggggcaagccagccagcggggccggggccggggccggggccggcaagagaagaaggaaggctgacagcgctggggaccggggcaagagcaagggcggcggcaagatgaatgaggagatcagcagtgacagcgagagcgagagcctggcccccaggaagccagaggaggaggaggaggaggagctggaggagacagcccaggagaagaagctgcggctggccaagctgtacctggagcagctgcggcagcaggaggaggagaaggccgaggcccgggcctttgaggaggaccaggtggccggccgcctgaaggaggatgtgctggagcagaggggccgcctgcagaagctggtggccaaggagatccaggccccagccagcgctgacatccgggtgctgcggggccaccagctgagcatcacctgcctggtggtgaccccagatgattctgccatcttctctgctgccaaggactgcagcatcatcaagtggagcgtggagagcggcaggaagctgcacgtgatcccccgggccaagaagggagctgagggcaagcccccaggccacagcagccacgtgctgtgcatggccatcagcagtgatggcaagtacctggccagcggggacaggagcaagctgatcctgatctgggaggcccagagctgccagcacctgtacaccttcaccggccacagagatgctgtgtctggcctggccttccggcggggcacccaccagctgtacagcaccagccatgacagatctgtgaaggtgtggaatgtggccgagaacagctatgtggagaccctgtttggccaccaggatgctgtggccgccctggatgccctgagccgggagtgctgcgtgacagctgggggcagagatggcaccgtgcgggtgtggaagatccctgaggagagccagctggtgttctacggccaccagggcagcattgactgcatccacctgatcaatgaggagcacatggtgtctggagcagatgatggctctgtggccctgtggggcctgagcaagaagaggcccctggccctgcagcgggaggcccacggcctgcggggggagcccggcctggagcagcccttctggatcagctctgtggccgccctgctgaacacagacctggtggccaccggcagccacagcagctgtgtgcggctgtggcagtgtggggagggcttccggcagctggacctgctgtgtgacatccccctggtgggcttcatcaacagcctgaagttcagcagcagcggggacttcctggtggccggcgtgggccaggagcaccggctgggccgctggtggaggatcaaggaggccaggaacagcgtgtgcatcatccccctgcggcgggtgcctgtgcccccagctgctggcagctag

SEQ ID NO: 144092 - DNA, 2154 bp, Artificial Sequence
  Description of Artificial Sequence: Synthetic coding sequence
atggccaccccagctgctgtgaaccccccagagatggccagtgacatccctggctctgtgaccctgcctgtggcccccatggccgccaccggccaggtgaggatggccggggccatgcctgcccggggcggcaagaggaggagcggcatggactttgatgatgaagatggagagggccccagcaagttcagccgggagaaccacagcgagattgaaagaagaagaagaaacaagatgacccagtacatcacagagctgagtgacatggtgcccacctgcagcgccctggccaggaagccagacaagctgaccatcctgaggatggctgtgagccacatgaagtccatgaggggcactggaaacaagagcacagatggagcctacaagcccagcttcctgacagagcaggagctgaagcacctgatcctggaggccgcagatggcttcctgtttgtggtggccgctgagaccggccgggtcatctacgtgtctgacagcgtgacccctgtgctgaaccagccccagagcgagtggtttggcagcaccctgtatgagcaggtgcacccagatgatgtggagaagctgcgggagcagctgtgcaccagtgaaaattccatgacaggccgcatcctggacctgaagacaggaacagtgaagaaggagggccagcagagctccatgaggatgtgcatgggcagccgccgctccttcatctgcaggatgagatgtggaaatgcccccctggaccacctgcccctgaaccgcatcaccaccatgaggaagcgcttcagaaatggcctgggccctgtgaaggagggggaggcccagtatgctgtggtgcactgcaccggctacatcaaggcctggcccccagctggcatgaccatcccagaagaagatgctgatgtgggccagggcagcaagtactgcctggtggccatcggccgcctgcaggtgaccagcagccctgtgtgcatggacatgaatggcatgtctgtgcccacagagttcctgagccgccacaacagtgatggcatcatcacctttgtggacccccgctgcatcagcgtcatcggctaccagccccaggacctgctgggcaaggacatcctggagttctgccaccctgaggaccagagccacctgcgggagagcttccagcaggtggtgaagctgaagggccaggtgctgtctgtgatgtaccgcttccgcaccaagaaccgggagtggatgctgatccgcaccagcagcttcaccttccagaacccctacagtgatgaaattgagtacatcatctgcaccaacaccaacgtgaagcagctgcagcagcagcaggccgagctggaggtgcaccagagagatggcctgagcagctatgacctgagccaggtgcctgtgcccaacctgcctgctggggtgcatgaggccggcaagtctgtggagaaggcagatgccatcttcagccaggagcgggaccccaggtttgctgagatgtttgctggcatcagcgccagcgagaagaagatgatgagcagcgccagcgctgctggcacccagcagatctacagccagggcagccccttccccagcggccacagcggcaaggccttcagcagctctgtggtgcacgtgcctggggtgaatgacatccagagcagcagcagcacaggccagaacatgagccagatcagccggcagctgaaccagagccaggtggcctggacaggcagcaggcctcccttccctggccagcagatccccagccagagcagcaagacccagagcagccccttcggcatcggcaccagccacacctacccagctgaccccagcagctacagccccctgagcagccctgccaccagcagccccagcggaaatgcctacagcagcctggccaacagaacacctggctttgctgagagcggccagagcagcggccagttccagggccggcccagcgaggtgtggagccagtggcagagccagcaccacggccagcagagcggggagcagcacagccaccagcagcccggccagacagaggtgttccaggacatgctgcccatgcctggggaccccacccagggcaccggcaactacaacatcgaggactttgctgacctgggcatgtttcctcccttcagcgagtag

SEQ ID NO: 144093 - DNA, 2118 bp, Artificial Sequence
  Description of Artificial Sequence: Synthetic coding sequence
atggccagtgacatccctggctctgtgaccctgcctgtggcccccatggccgccaccggccaggtgaggatggccggggccatgcctgcccggggcggcaagagaagaagtggcatggactttgatgatgaagatggagagggccccagcaagttcagccgggagaaccacagcgagattgaaagaagaagaagaaacaagatgacccagtacatcacagagctgagtgacatggtgcccacctgcagcgccctggccaggaagccagacaagctgaccatcctgaggatggctgtgagccacatgaagtccatgaggggcaccggcaacaagagcacagatggagcctacaagcccagcttcctgacagagcaggagctgaagcacctgatcctggaggccgcagatggcttcctgtttgtggtggccgctgagaccggccgggtcatctacgtgtctgattctgtgacccctgtgctgaaccagccccagagcgagtggtttggcagcaccctgtatgagcaggtgcacccagatgatgtggagaagctgcgggagcagctgtgcaccagcgagaacagcatgacaggccgcatcctggacctgaagacaggcaccgtgaagaaggagggccagcagagctccatgaggatgtgcatgggcagcagaagaagcttcatctgcaggatgagatgtggaaatgcccccctggaccacctgcccctgaaccgcatcaccaccatgaggaagcgcttcagaaatggcctgggccctgtgaaggagggggaggcccagtatgctgtggtgcactgcaccggctacatcaaggcctggcccccagctggcatgaccatccctgaggaggatgctgatgtgggccagggcagcaagtactgcctggtggccatcggccgcctgcaggtgaccagcagccctgtgtgcatggacatgaatggcatgtctgtgcccacagagttcctgagccgccacaacagtgatggcatcatcacctttgtggacccccgctgcatctctgtgattggctaccagccccaggacctgctgggcaaggacatcctggagttctgccaccctgaggaccagagccacctgcgggagagcttccagcaggtggtgaagctgaagggccaggtgctgtctgtgatgtaccgcttccgcaccaagaaccgggagtggatgctgatccgcaccagcagcttcaccttccagaacccctacagtgatgaaattgagtacatcatctgcaccaacaccaacgtgaagcagctgcagcagcagcaggccgagctggaggtgcaccagagagatggcctgagcagctatgacctgagccaggtgcctgtgcccaacctgcctgctggggtgcatgaagctgggaagtctgtggagaaggcagatgccatcttcagccaggagcgggaccccaggtttgctgagatgtttgctggcatcagcgccagcgagaagaagatgatgagcagcgccagcgctgctggcacccagcagatctacagccagggcagccccttccccagcggccacagcggcaaggccttcagcagctctgtggtgcacgtgcctggggtgaatgacatccagagcagcagcagcacaggccagaacatgagccagatcagccggcagctgaaccagagccaggtggcctggacaggcagccggccccccttccctggccagcagatccccagccagagcagcaagacccagagcagcccctttggaattggcaccagccacacctacccagctgaccccagcagctacagccccctgagcagccctgccaccagcagccccagcggaaatgcctacagcagcctggccaacagaacacctggctttgctgagagcggccagagcagcggccagttccagggccggcccagcgaggtgtggagccagtggcagagccagcaccacggccagcagagcggggagcagcacagccaccagcagcccggccagacagaggtgttccaggacatgctgcccatgcctggggaccccagaaatgagtggtggagcccccacagccggcagcacttccggcagcccatctcctatgccaggatgtag

SEQ ID NO: 144094 - DNA, 2121 bp, Artificial Sequence
  Description of Artificial Sequence: Synthetic coding sequence
atggccagtgacatccctggctctgtgaccctgcctgtggcccccatggccgccaccggccaggtgaggatggccggggccatgcctgcccggggcggcaagagaagaagtggcatggactttgatgatgaagatggagagggccccagcaagttcagccgggagaaccacagcgagattgaaagaagaagaagaaacaagatgacccagtacatcacagagctgagtgacatggtgcccacctgcagcgccctggccaggaagccagacaagctgaccatcctgaggatggctgtgagccacatgaagtccatgaggggcaccggcaacaagagcacagatggagcctacaagcccagcttcctgacagagcaggagctgaagcacctgatcctggaggccgcagatggcttcctgtttgtggtggccgctgagaccggccgggtcatctacgtgtctgattctgtgacccctgtgctgaaccagccccagagcgagtggtttggcagcaccctgtatgagcaggtgcacccagatgatgtggagaagctgcgggagcagctgtgcaccagcgagaacagcatgacaggccgcatcctggacctgaagacaggcaccgtgaagaaggagggccagcagagctccatgaggatgtgcatgggcagcagaagaagcttcatctgcaggatgagatgtggaaatgcccccctggaccacctgcccctgaaccgcatcaccaccatgaggaagcgcttcagaaatggcctgggccctgtgaaggagggggaggcccagtatgctgtggtgcactgcaccggctacatcaaggcctggcccccagctggcatgaccatccctgaggaggatgctgatgtgggccagggcagcaagtactgcctggtggccatcggccgcctgcaggtgaccagcagccctgtgtgcatggacatgaatggcatgtctgtgcccacagagttcctgagccgccacaacagtgatggcatcatcacctttgtggacccccgctgcatctctgtgattggctaccagccccaggacctgctgggcaaggacatcctggagttctgccaccctgaggaccagagccacctgcgggagagcttccagcaggtggtgaagctgaagggccaggtgctgtctgtgatgtaccgcttccgcaccaagaaccgggagtggatgctgatccgcaccagcagcttcaccttccagaacccctacagtgatgaaattgagtacatcatctgcaccaacaccaacgtgaagcagctgcagcagcagcaggccgagctggaggtgcaccagagagatggcctgagcagctatgacctgagccaggtgcctgtgcccaacctgcctgctggggtgcatgaagctgggaagtctgtggagaaggcagatgccatcttcagccaggagcgggaccccaggtttgctgagatgtttgctggcatcagcgccagcgagaagaagatgatgagcagcgccagcgctgctggcacccagcagatctacagccagggcagccccttccccagcggccacagcggcaaggccttcagcagctctgtggtgcacgtgcctggggtgaatgacatccagagcagcagcagcacaggccagaacatgagccagatcagccggcagctgaaccagagccaggtggcctggacaggcagccggccccccttccctggccagcagatccccagccagagcagcaagacccagagcagcccctttggaattggcaccagccacacctacccagctgaccccagcagctacagccccctgagcagccctgccaccagcagccccagcggaaatgcctacagcagcctggccaacagaacacctggctttgctgagagcggccagagcagcggccagttccagggccggcccagcgaggtgtggagccagtggcagagccagcaccacggccagcagagcggggagcagcacagccaccagcagcccggccagacagaggtgttccaggacatgctgcccatgcctggggaccccacccagggcactggaaactacaacattgaagattttgctgacctgggcatgttcccccccttcagcgagtag

SEQ ID NO: 144095 - DNA, 2121 bp, Artificial Sequence; identical to SEQ ID NO: 144094
  Description of Artificial Sequence: Synthetic coding sequence

SEQ ID NO: 144096 - DNA, 1701 bp, Artificial Sequence
  Description of Artificial Sequence: Synthetic coding sequence
atggccaccccagctgctgtgaaccccccagagatggccagtgacatccctggctctgtgaccctgcctgtggcccccatggccgccaccggccaggtgaggatggccggggccatgcctgcccggggcggcaagaggaggagcggcatggactttgatgatgaagatggagagggccccagcaagttcagccgggagaaccacagcgagattgaaagaagaagaagaaacaagatgacccagtacatcacagagctgagtgacatggtgcccacctgcagcgccctggccaggaagccagacaagctgaccatcctgaggatggctgtgagccacatgaagtccatgaggggcactggaaacaagagcacagatggagcctacaagcccagcttcctgacagagcaggagctgaagcacctgatcctggaggccgcagatggcttcctgtttgtggtggccgctgagaccggccgggtcatctacgtgtctgacagcgtgacccctgtgctgaaccagccccagagcgagtggtttggcagcaccctgtatgagcaggtgcacccagatgatgtggagaagctgcgggagcagctgtgcaccagtgaaaattccatgacaggccgcatcctggacctgaagacaggaacagtgaagaaggagggccagcagagctccatgaggatgtgcatgggcagccgccgctccttcatctgcaggatgagatgtggaaatgcccccctggaccacctgcccctgaaccgcatcaccaccatgaggaagcgcttcagaaatggcctgggccctgtgaaggagggggaggcccagtatgctgtggtgcactgcaccggctacatcaaggcctggcccccagctggcatgaccatcccagaagaagatgctgatgtgggccagggcagcaagtactgcctggtggccatcggccgcctgcaggtgaccagcagccctgtgtgcatggacatgaatggcatgtctgtgcccacagagttcctgagccgccacaacagtgatggcatcatcacctttgtggacccccgctgcatcagcgtcatcggctaccagccccaggacctgctgggcaaggacatcctggagttctgccaccctgaggaccagagccacctgcgggagagcttccagcaggtggtgaagctgaagggccaggtgctgtctgtgatgtaccgcttccgcaccaagaaccgggagtggatgctgatccgcaccagcagcttcaccttccagaacccctacagtgatgaaattgagtacatcatctgcaccaacaccaacgtgaagcagctgcagcagcagcaggccgagctggaggtgcaccagagagatggcctgagcagctatgacctgagccaggtgcctgtgcccaacctgcctgctggggtgcatgaggccggcaagtctgtggagaaggcagatgccatcttcagccaggagcgggaccccaggtttgctgagatgtttgctggcatcagcgccagcgagaagaagatgatgagcagcgccagcgctgctggcacccagcagatctacagccagggcagccccttccccagcggccacagcggcaaggccttcagcagctctgtggtgcacgtgcctggggtgaatgacatccagagcagcagcagcacaggccagaacatgagccagatcagcggcagctag

SEQ ID NO: 144097 - DNA, 2160 bp, Artificial Sequence
  Description of Artificial Sequence: Synthetic coding sequence
atgcccaggaccatgatccccccaggagagtgcacctacgccggcaggaagagaagaagacccctgcagaagcagaggcctgctgtgggcgctgagaagagcaaccccagcaagaggcaccgggaccggctgaatgctgagctggaccacctggccagcctgctgcccttccccccagacatcatcagcaagctggacaagctgtctgtgctgcggctgtctgtgtcctacctgcgggtgaagagcttcttccaggtggtgcaggagcagagcagccggcagcctgctgctggggcccccagccctggggacagctgccccctggccggcagcgctgtgctggagggccgcctgctgctggagagcctgaatggatttgccctggtggtgtctgctgagggcaccatcttctacgccagcgccaccatcgtggactacctgggcttccaccagacagatgtgatgcaccagaacatctatgactacatccacgtggatgaccggcaggacttctgccggcagctgcactgggccatggaccccccccaggtggtgtttggccagcccccacccctggagactggagatgatgccatcctgggccgcctgctgcgggcccaggagtggggcaccggcacccccacagagtacagcgccttcctgacccgctgcttcatctgccgggtgcgctgcctgctggacagcaccagcggcttcctggcccggggcagccaggcctggcagctgcggctgtgctgcccagagcccctgatgaccatgcagttccagggcaagctgaagttcctgtttggccagaagaagaaggcccccagcggggccatgctgcccccccggctgagcctcttctgcatcgccgcccctgtgctgctgcccagcgctgctgagatgaagatgaggtctgccctgctgcgggccaagcccagggctgacacagctgccacagcagatgccaaggtgaaggccaccaccagcctgtgtgagagcgagctgcacggcaagcccaactacagcgctggccgcagcagccgggagagcggcgtgctggtgctgcgggagcagacagatgctggccgctgggcccaggtgcctgcccgggccccctgcctgtgcctgcggggcggccctgacctggtgctggaccccaagggcggcagcggggaccgggaggaggagcagcacaggatgctgagccgggccagcggcgtgacaggccggcgggagaccccaggccccaccaagcccctgccctggacagctgggaagcacagtgaagatggagcccggccccggctgcagcccagcaagaatgacccccccagcctgcggcccatgccccggggcagctgcctgccctgcccctgtgtgcagggcaccttcaggaacagccccatcagccacccccccagccccagccccagcgcctacagcagcaggaccagccggcccatgagagatgtgggggaggaccaggtgcacccccccctgtgccacttcccccagaggagcctgcagcaccagctgccccagcccggggcccagagatttgccacccggggctaccccatggaggacatgaagctgcagggcgtgcccatgcctcctggggacctgtgtggccccaccctgctgctggatgtgtccatcaagatggagaaggacagcggctgtgagggcgctgctgatggctgtgtgcccagccaggtgtggctgggcgccagtgacaggagccacccagccaccttccccaccaggatgcacctgaagacagagccagacagccggcagcaggtgtacatcagccacctgggccatggagtgcggggggcccagccccacggccgggccacagctggccgcagccgggagctgacccccttccacccagcccactgtgcctgcctggagcccacagatggcctgccccagagcgagcccccccaccagctgtgtgcccggggccgcggggagcagagctgcacctgcagagctgctgaggccgcccctgtggtgaagcgggagcccctggacagcccccagtgggccacccacagccagggcatggtgcccggcatgctgcccaagagcgccctggccaccctggtgcccccccaggccagcggctgcaccttcctgccctag

SEQ ID NO: 144098 - DNA, 2106 bp, Artificial Sequence
  Description of Artificial Sequence: Synthetic coding sequence
atgcccaggaccatgatccccccaggagagtgcacctacgccggcaggaagagaagaagacccctgcagaagcagaggcctgctgtgggcgctgagaagagcaaccccagcaagaggcaccgggaccggctgaatgctgagctggaccacctggccagcctgctgcccttccccccagacatcatcagcaagctggacaagctgtctgtgctgcggctgtctgtgtcctacctgcgggtgaagagcttcttccaggtggtgcaggagcagagcagccggcagcctgctgctggggcccccagccctggggacagctgccccctggccggcagcgctgtgctggagggccgcctgctgctggagagcctgaatggatttgccctggtggtgtctgctgagggcaccatcttctacgccagcgccaccatcgtggactacctgggcttccaccagacagatgtgatgcaccagaacatctatgactacatccacgtggatgaccggcaggacttctgccggcagctgcactgggccatggaccccccccaggtggtgtttggccagcccccacccctggagactggagatgatgccatcctgggccgcctgctgcgggcccaggagtggggcaccggcacccccacagagtacagcgccttcctgacccgctgcttcatctgccgggtgcgctgcctgctggacagcaccagcggcttcctgaccatgcagttccagggcaagctgaagttcctgtttggccagaagaagaaggcccccagcggggccatgctgcccccccggctgagcctcttctgcatcgccgcccctgtgctgctgcccagcgctgctgagatgaagatgaggtctgccctgctgcgggccaagcccagggctgacacagctgccacagcagatgccaaggtgaaggccaccaccagcctgtgtgagagcgagctgcacggcaagcccaactacagcgctggccgcagcagccgggagagcggcgtgctggtgctgcgggagcagacagatgctggccgctgggcccaggtgcctgcccgggccccctgcctgtgcctgcggggcggccctgacctggtgctggaccccaagggcggcagcggggaccgggaggaggagcagcacaggatgctgagccgggccagcggcgtgacaggccggcgggagaccccaggccccaccaagcccctgccctggacagctgggaagcacagtgaagatggagcccggccccggctgcagcccagcaagaatgacccccccagcctgcggcccatgccccggggcagctgcctgccctgcccctgtgtgcagggcaccttcaggaacagccccatcagccacccccccagccccagccccagcgcctacagcagcaggaccagccggcccatgagagatgtgggggaggaccaggtgcacccccccctgtgccacttcccccagaggagcctgcagcaccagctgccccagcccggggcccagagatttgccacccggggctaccccatggaggacatgaagctgcagggcgtgcccatgcctcctggggacctgtgtggccccaccctgctgctggatgtgtccatcaagatggagaaggacagcggctgtgagggcgctgctgatggctgtgtgcccagccaggtgtggctgggcgccagtgacaggagccacccagccaccttccccaccaggatgcacctgaagacagagccagacagccggcagcaggtgtacatcagccacctgggccatggagtgcggggggcccagccccacggccgggccacagctggccgcagccgggagctgacccccttccacccagcccactgtgcctgcctggagcccacagatggcctgccccagagcgagcccccccaccagctgtgtgcccggggccgcggggagcagagctgcacctgcagagctgctgaggccgcccctgtggtgaagcgggagcccctggacagcccccagtgggccacccacagccagggcatggtgcccggcatgctgcccaagagcgccctggccaccctggtgcccccccaggccagcggctgcaccttcctgccctag

SEQ ID NO: 144099 - DNA, 2205 bp, Artificial Sequence
  Description of Artificial Sequence: Synthetic coding sequence
atgagcggctttgatgatcctggcatcttctacagcgacagctttggaggagatgcccaggctgatgagggccaggccaggaagagccagctgcagaggcgcttcaaggagttcctgcggcagtacagagtgggcacagacagaacaggcttcaccttcaagtacagagatgagctgaagaggcactacaacctgggggagtactggattgaggtggagatggaggacctggccagctttgatgaggacctggccgactacctgtacaagcagcctgctgagcacctgcagctgctggaggaggccgccaaggaggtggctgatgaggtgacccggccccggcccagcggggaggaggtgctgcaggacatccaggtgatgctgaagagtgatgccagccccagcagcatccgcagcctgaagagtgacatgatgagccacctggtgaagatccctggcatcatcatcgccgccagcgctgtgcgggccaaggccacccgcatcagcatccagtgccgcagctgcaggaacaccctgaccaacatcgccatgaggcctggcctggagggctacgccctgcccaggaagtgcaacacagaccaggccggccggcccaagtgccccctggacccctacttcatcatgccagacaagtgcaagtgtgtggacttccagaccctgaagctgcaggagctgcctgatgctgtgccccacggggagatgcccaggcacatgcagctgtactgtgaccgctacctgtgtgacaaggtggtgcccggcaacagagtgaccatcatgggcatctacagcatcaagaagtttggcctgaccaccagccggggccgggacagagtgggcgtgggcatccgcagcagctacatccgggtgctgggcatccaggtggacacagatggcagcggccgcagctttgctggagctgtgagcccccaggaggaggaggagttccggcggctggccgccctgcccaacgtgtatgaggtgatcagcaagagcatcgcccccagcatctttggaggaacagacatgaagaaggccatcgcctgcctgctgtttggaggcagcaggaagaggctgcctgatggcctgaccaggagaggagacatcaacctgctgatgctgggggaccctggaacagccaagagccagctgctgaagtttgtggagaagtgcagccccatcggcgtgtacaccagcggcaagggcagcagcgctgctggcctgacagcctctgtgatgagggaccccagcagcaggaacttcatcatggagggcggggccatggtgctggctgatggcggcgtggtgtgcattgatgaatttgacaagatgagagaagatgacagagtggccatccacgaggccatggagcagcagaccatcagcatcgccaaggccggcatcaccaccaccctgaacagccgctgcagcgtgctggccgccgccaacagcgtgtttggccgctgggatgagaccaagggggaggacaacatcgacttcatgcccaccatcctgagcagatttgacatgatcttcatcgtgaaggatgagcacaatgaggagagagatgtgatgctggccaagcacgtgatcaccctgcacgtgtctgccctgacccagacccaggccgtggagggggagattgacctggccaagctgaagaagttcatcgcctactgccgggtgaagtgtggcccccggctgtctgctgaggccgctgagaagctgaagaaccgctacatcatcatgaggtctggggcccggcagcacgagcgggacagcgaccggcgcagcagcatccccatcaccgtgcggcagctggaggccatcgtgagaattgctgaggccctgagcaagatgaagctgcagccctttgccacagaagcagatgtggaggaggccctgcggctcttccaggtgtccaccctggatgctgccctgagcggcaccctgagcggcgtggagggcttcaccagccaggaggaccaggagatgctgagcagaattgagaagcagctgaagagaagatttgccatcggcagccaggtgtctgagcacagcatcatcaaggacttcaccaagcagaagtacccagagcacgccatccacaaggtgctgcagctgatgctgcggcggggggagatccagcacaggatgcagaggaaggtgctgtaccgcctgaagtag

SEQ ID NO: 144100 - DNA, 1530 bp, Artificial Sequence
  Description of Artificial Sequence: Synthetic coding sequence
atgtccatgggcgcccccaggagcctgctgctggccctggccgccggcctggccgtggcccggccccccaacatcgtgctgatctttgctgatgacctgggctatggagacctgggctgctacggccaccccagcagcaccacccccaacctggaccagctggccgccggcggcctgcgcttcacagacttctacgtgcctgtgtccctgtgcacccccagccgggccgccctgctgaccggccgcctgcctgtgaggatgggcatgtacccaggagtgctggtgcccagcagccggggcggcctgcccctggaggaggtgacagtggccgaggtgctggccgcccggggctacctgaccggcatggccggcaagtggcacctgggcgtgggccctgagggcgccttcctgcccccccaccagggcttccaccgcttcctgggcatcccctacagccatgaccagggcccctgccagaacctgacctgcttccccccagccaccccctgtgatggcggctgtgaccagggcctggtgcccatccccctgctggccaacctgtctgtggaggcccagcccccctggctgcccggcctggaggcccgctacatggcctttgcccatgacctgatggctgatgcccagaggcaggaccggcccttcttcctgtactatgccagccaccacacccactacccccagttcagcggccagagctttgctgagaggagcggccggggcccctttggagacagcctgatggagctggatgctgctgtgggcaccctgatgacagccatcggggacctgggcctgctggaggagaccctggtgatcttcaccgctgacaatggacctgagaccatgaggatgagccggggcggctgcagcggcctgctgcgctgtgggaagggcaccacctatgagggcggcgtgcgggagcccgccctggccttctggccaggccacatcgcccctggggtgacccatgagctggccagcagcctggacctgctgcccaccctggccgccctggccggggcccccctgcccaacgtgaccctggatggctttgacctgagccccctgctgctgggcaccgggaagagcccccggcagagcctcttcttctaccccagctacccagatgaggtgcggggcgtgtttgctgtgaggacaggcaagtacaaggcccacttcttcacccagggcagcgcccacagcgacaccacagctgaccctgcctgccacgccagcagcagcctgacagcccacgagccccccctgctgtatgacctgagcaaggaccctggagagaactacaacctgctgggcggcgtggccggggccaccccagaggtgctgcaggccctgaagcagctgcagctgctgaaggcccagctggatgctgctgtgaccttcggccccagccaggtggcccggggagaagatcctgccctgcagatctgctgccaccctggctgcacccccaggcctgcctgctgccactgcccagacccccacgcctag

SEQ ID NO: 144101 - DNA, 1530 bp, Artificial Sequence; identical to SEQ ID NO: 144100
  Description of Artificial Sequence: Synthetic coding sequence

SEQ ID NO: 144102 - DNA, 1530 bp, Artificial Sequence; identical to SEQ ID NO: 144100
  Description of Artificial Sequence: Synthetic coding sequence

SEQ ID NO: 144103 - DNA, 1272 bp, Artificial Sequence
  Description of Artificial Sequence: Synthetic coding sequence
atgggcatgtacccaggagtgctggtgcccagcagccggggcggcctgcccctggaggaggtgacagtggccgaggtgctggccgcccggggctacctgaccggcatggccggcaagtggcacctgggcgtgggccctgagggcgccttcctgcccccccaccagggcttccaccgcttcctgggcatcccctacagccatgaccagggcccctgccagaacctgacctgcttccccccagccaccccctgtgatggcggctgtgaccagggcctggtgcccatccccctgctggccaacctgtctgtggaggcccagcccccctggctgcccggcctggaggcccgctacatggcctttgcccatgacctgatggctgatgcccagaggcaggaccggcccttcttcctgtactatgccagccaccacacccactacccccagttcagcggccagagctttgctgagaggagcggccggggcccctttggagacagcctgatggagctggatgctgctgtgggcaccctgatgacagccatcggggacctgggcctgctggaggagaccctggtgatcttcaccgctgacaatggacctgagaccatgaggatgagccggggcggctgcagcggcctgctgcgctgtgggaagggcaccacctatgagggcggcgtgcgggagcccgccctggccttctggccaggccacatcgcccctggggtgacccatgagctggccagcagcctggacctgctgcccaccctggccgccctggccggggcccccctgcccaacgtgaccctggatggctttgacctgagccccctgctgctgggcaccgggaagagcccccggcagagcctcttcttctaccccagctacccagatgaggtgcggggcgtgtttgctgtgaggacaggcaagtacaaggcccacttcttcacccagggcagcgcccacagcgacaccacagctgaccctgcctgccacgccagcagcagcctgacagcccacgagccccccctgctgtatgacctgagcaaggaccctggagagaactacaacctgctgggcggcgtggccggggccaccccagaggtgctgcaggccctgaagcagctgcagctgctgaaggcccagctggatgctgctgtgaccttcggccccagccaggtggcccggggagaagatcctgccctgcagatctgctgccaccctggctgcacccccaggcctgcctgctgccactgcccagacccccacgcctag

SEQ ID NO: 144104 - DNA, 1524 bp, Artificial Sequence
  Description of Artificial Sequence: Synthetic coding sequence
atgggcgcccccaggagcctgctgctggccctggccgccggcctggccgtggcccggccccccaacatcgtgctgatctttgctgatgacctgggctatggagacctgggctgctacggccaccccagcagcaccacccccaacctggaccagctggccgccggcggcctgcgcttcacagacttctacgtgcctgtgtccctgtgcacccccagccgggccgccctgctgaccggccgcctgcctgtgaggatgggcatgtacccaggagtgctggtgcccagcagccggggcggcctgcccctggaggaggtgacagtggccgaggtgctggccgcccggggctacctgaccggcatggccggcaagtggcacctgggcgtgggccctgagggcgccttcctgcccccccaccagggcttccaccgcttcctgggcatcccctacagccatgaccagggcccctgccagaacctgacctgcttccccccagccaccccctgtgatggcggctgtgaccagggcctggtgcccatccccctgctggccaacctgtctgtggaggcccagcccccctggctgcccggcctggaggcccgctacatggcctttgcccatgacctgatggctgatgcccagaggcaggaccggcccttcttcctgtactatgccagccaccacacccactacccccagttcagcggccagagctttgctgagaggagcggccggggcccctttggagacagcctgatggagctggatgctgctgtgggcaccctgatgacagccatcggggacctgggcctgctggaggagaccctggtgatcttcaccgctgacaatggacctgagaccatgaggatgagccggggcggctgcagcggcctgctgcgctgtgggaagggcaccacctatgagggcggcgtgcgggagcccgccctggccttctggccaggccacatcgcccctggggtgacccatgagctggccagcagcctggacctgctgcccaccctggccgccctggccggggcccccctgcccaacgtgaccctggatggctttgacctgagccccctgctgctgggcaccgggaagagcccccggcagagcctcttcttctaccccagctacccagatgaggtgcggggcgtgtttgctgtgaggacaggcaagtacaaggcccacttcttcacccagggcagcgcccacagcgacaccacagctgaccctgcctgccacgccagcagcagcctgacagcccacgagccccccctgctgtatgacctgagcaaggaccctggagagaactacaacctgctgggcggcgtggccggggccaccccagaggtgctgcaggccctgaagcagctgcagctgctgaaggcccagctggatgctgctgtgaccttcggccccagccaggtggcccggggagaagatcctgccctgcagatctgctgccaccctggctgcacccccaggcctgcctgctgccactgcccagacccccacgcctag

SEQ ID NO: 144105 - DNA, 1524 bp, Artificial Sequence; identical to SEQ ID NO: 144104
  Description of Artificial Sequence: Synthetic coding sequence

SEQ ID NO: 144106 - DNA, 1782 bp, Artificial Sequence
  Description of Artificial Sequence: Synthetic coding sequence
atgaggtctgctgcccggcggggccgggccgccccagctgcccgggacagcctgcctgtgctgctcttcctgtgcctgctgctgaagacctgtgagcccaagacagccaatgccttcaagcccaacatcctgctgatcatggctgatgacctgggcactggagacctgggctgctacggcaacaacaccctgcggacccccaacatcgaccagctggccgaggagggcgtgcggctgacccagcacctggccgccgcccccctgtgcacccccagccgggccgccttcctgaccggccgccacagcttccgcagcggcatggatgccagcaatggctaccgggccctgcagtggaatgccggcagcggcggcctgcctgaaaatgagaccacctttgcccgcatcctgcagcagcacggctacgccaccggcctcatcggcaagtggcaccagggcgtgaactgtgccagcagaggagaccactgccaccaccccctgaaccacggctttgactacttctacggcatgcccttcaccctgaccaatgactgtgaccccggccggcccccagaggtggatgctgccctgcgggcccagctgtggggctacacccagttcctggccctgggcatcctgaccctggccgccggccagacctgtggcttcttctctgtgtctgcccgggctgtgacaggcatggccggcgtgggctgcctcttcttcatctcctggtacagcagctttggatttgtgcggcgctggaactgcatcctgatgaggaaccatgatgtgacagagcagcccatggtgctggagaagacagccagcctgatgctgaaggaggccgtgtcctacatcgagcggcacaagcacggccccttcctgctcttcctgagcctgctgcacgtgcacatccccctggtgaccaccagcgccttcctgggcaagagccagcacggcctgtatggagacaacgtggaggagatggactggctgattggcaaggtgctgaatgccattgaagataatggcctgaagaacagcaccttcacctacttcaccagtgaccatggaggccacctggaggccagagatggccacagccagctgggcggctggaatggcatctacaagggcggcaagggcatgggcggctgggagggcggcatccgggtgcccggcatcttccactggccaggagtgctgcctgctggccgggtcatcggggagcccaccagcctgatggatgtgttccccaccgtggtgcagctggtgggcggggaggtgccccaggacagagtgattgatggccacagcctggtgcccctgctgcagggcgctgaggcccggagcgcccacgagttcctgttccactactgcggccagcacctgcacgccgcccgctggcaccagaaggacagcggctctgtgtggaaggtgcactacaccaccccccagttccaccctgagggcgctggggcctgctacggccggggcgtgtgcccctgcagcggggagggcgtgacccaccacaggcctcccctgctgtttgacctgagccgggaccccagcgaggcccggcccctgaccccagattctgagcccctgtaccacgctgtgattgcccgggtgggcgctgctgtgtctgagcaccggcagaccctgagccctgtgccccagcagttctccatgagcaacatcctgtggaagccctggctgcagccctgctgcggccacttccccttctgcagctgccatgaagatggagatggcaccccctag

SEQ ID NO: 144107 - DNA, 1770 bp, Artificial Sequence
  Description of Artificial Sequence: Synthetic coding sequence
atgctgcacctgcaccacagctgcctgtgcttccgctcctggctgcctgccatgctggccgtgctgctgagcctggcccccagcgccagcagtgacatcagcgccagccggcccaacatcctgctgctgatggctgatgacctgggcatcggggacatcggctgctacggcaacaacaccatgaggacccccaacatcgaccggctggctgaagatggagtgaagctgacccagcacatctctgctgccagcctgtgcacccccagcagagctgccttcctgaccggccgctaccctgtgcgcagcggcatggtgagcagcatcggctacagagtgctgcagtggacaggagccagcggcggcctgcccaccaatgagaccacctttgccaagatcctgaaggagaagggctacgccaccggcctgattggcaagtggcacctgggcctgaactgtgagagcgccagtgaccactgccaccaccccctgcaccacggctttgaccacttctacggcatgcccttcagcctgatgggagactgtgcccgctgggagctgtctgagaagagggtgaacctggagcagaagctgaacttcctgttccaggtgctggccctggtggccctgaccctggtggccggcaagctgacccacctgatccctgtgtcctggatgcctgtgatctggagcgccctgtctgctgtgctgctgctggccagcagctactttgtgggcgccctgattgtgcatgctgactgcttcctgatgaggaaccacaccatcacagagcagcccatgtgcttccagaggaccacccccctcatcctgcaggaggtggccagcttcctgaagaggaacaagcacggccccttcctgctgtttgtgtccttcctgcacgtgcacatccccctcatcaccatggagaacttcctgggcaagagcctgcacggcctgtatggagacaacgtggaggagatggactggatggtgggccgcatcctggacaccctggatgtggagggcctgagcaacagcaccctcatctacttcaccagtgaccacggcggcagcctggagaaccagctgggcaacacccagtatggaggctggaatggcatctacaagggcggcaagggcatgggcggctgggagggcggcatccgggtgcccggcatcttccgctggccaggagtgctgcctgctggccgggtgattggagagcccaccagcctgatggatgtgttccccaccgtggtgcggctggccggcggggaggtgccccaggacagagtgattgatggccaggacctgctgcccctgctgctgggcacagcccagcacagcgaccacgagttcctgatgcactactgtgagcgcttcctgcatgctgcccgctggcaccagagggaccggggcaccatgtggaaggtgcactttgtgacccctgtgttccagcctgagggcgctggggcctgctacggcaggaaggtgtgcccctgctttggagagaaggtggtgcaccacgacccccccctgctgtttgacctgagccgggaccccagcgagacccacatcctgaccccagccagcgagcccgtcttctaccaggtgatggagcgggtgcagcaggccgtgtgggagcaccagaggaccctgagccctgtgcccctgcagctggaccggctgggcaacatctggaggccctggctgcagccctgctgcggccccttccccctgtgctggtgcctgagagaagatgacccccagtag

SEQ ID NO: 144108 - DNA, 537 bp, Artificial Sequence
  Description of Artificial Sequence: Synthetic coding sequence
atgctgcacctgcaccacagctgcctgtgcttccgctcctggctgcctgccatgctggccgtgctgctgagcctggcccccagcgccagcagtgacatcagcgccagccggcccaacatcctgctgctgatggctgatgacctgggcatcggggacatcggctgctacggcaacaacaccatgaggacccccaacatcgaccggctggctgaagatggagtgaagctgacccagcacatctctgctgccagcctgtgcacccccagcagagctgccttcctgaccggccgctaccctgtgcgcagcggcatggtgagcagcatcggctacagagtgctgcagtggacaggagccagcggcggcctgcccaccaatgagaccacctttgccaagatcctgaaggagaagggctacgccaccggcctgattggcaagtggcacctgggcctgaactgtgagagcgccagtgaccactgccaccaccccctgcaccacggctttgaccacttctacggcatgcccttcagcctgatgtag

SEQ ID NO: 144109 - DNA, 1635 bp, Artificial Sequence
  Description of Artificial Sequence: Synthetic coding sequence
atgagcggcagccgggagcgggacaacatgctgcacctgcaccacagctggacccccaacatcgaccggctggccgaggatggagtgaagctgacccagcacatctctgctgccagcctgtgcacccccagccgggccgccttcctgaccggccgctaccctgtgcgcagcggcatggtgagcagcatcggctacagagtgctgcagtggacaggagccagcggcggcctgcccaccaatgagaccacctttgccaagatcctgaaggagaagggctacgccaccggcctcatcggcaagtggcacctgggcctgaactgtgagagcgccagtgaccactgccaccaccccctgcaccacggctttgaccacttctacggcatgcccttcagcctgatgggagactgtgcccgctgggagctgtctgagaagagggtgaacctggagcagaagctgaacttcctgttccaggtgctggccctggtggccctgaccctggtggccggcaagctgacccacctgatccctgtgtcctggatgcctgtgatctggagcgccctgtctgctgtgctgctgctggccagcagctactttgtgggcgccctgattgtgcacgccgactgcttcctgatgaggaaccacaccatcacagagcagcccatgtgcttccagaggaccacccccctcatcctgcaggaggtggccagcttcctgaagaggaacaagcacggccccttcctgctgtttgtgtccttcctgcacgtgcacatccccctcatcaccatggagaacttcctgggcaagagcctgcacggcctgtatggagacaacgtggaggagatggactggatggtgggccgcatcctggacaccctggatgtggagggcctgagcaacagcaccctcatctacttcaccagtgaccatggaggcagcctggagaaccagctgggcaacacccagtatggaggctggaatggcatctacaagggcggcaagggcatgggcggctgggagggcggcatccgggtgcccggcatcttccgctggccaggagtgctgcctgctggccgggtcatcggggagcccaccagcctgatggatgtgttccccaccgtggtgcggctggccggcggggaggtgccccaggacagagtgattgatggccaggacctgctgcccctgctgctgggcacagcccagcacagcgaccacgagttcctgatgcactactgtgagcgcttcctgcacgccgcccgctggcaccagagggaccggggcaccatgtggaaggtgcactttgtgacccctgtgttccagcctgagggcgctggggcctgctacggcaggaaggtgtgcccctgcttcggggagaaggtggtgcaccacgacccccccctgctgtttgacctgagccgggaccccagcgagacccacatcctgaccccagccagcgagcctgtgttctaccaggtgatggagcgggtgcagcaggccgtgtgggagcaccagaggaccctgagccctgtgcccctgcagctggaccggctgggcaacatctggaggccctggctgcagccctgctgcggccccttccccctgtgctggtgcctgcgggaggatgacccccagtag

SEQ ID NO: 144110 - DNA, 1845 bp, Artificial Sequence
  Description of Artificial Sequence: Synthetic coding sequence
atgaggcctgtgatcaacagatgtgcccctggcagcctggacctgatgctgccccaggccgccagcgagggcatcgtgttccacagcctgcagatcagcctgtgcttccgctcctggctgcctgccatgctggccgtgctgctgagcctggcccccagcgccagcagtgacatcagcgccagccggcccaacatcctgctgctgatggctgatgacctgggcattggagacatcggctgctacggcaacaacaccatgaggacccccaacatcgaccggctggccgaggatggagtgaagctgacccagcacatctctgctgccagcctgtgcacccccagccgggccgccttcctgaccggccgctaccctgtgcgcagcggcatggtgagcagcatcggctacagagtgctgcagtggacaggagccagcggcggcctgcccaccaatgagaccacctttgccaagatcctgaaggagaagggctacgccaccggcctcatcggcaagtggcacctgggcctgaactgtgagagcgccagtgaccactgccaccaccccctgcaccacggctttgaccacttctacggcatgcccttcagcctgatgggagactgtgcccgctgggagctgtctgagaagagggtgaacctggagcagaagctgaacttcctgttccaggtgctggccctggtggccctgaccctggtggccggcaagctgacccacctgatccctgtgtcctggatgcctgtgatctggagcgccctgtctgctgtgctgctgctggccagcagctactttgtgggcgccctgattgtgcacgccgactgcttcctgatgaggaaccacaccatcacagagcagcccatgtgcttccagaggaccacccccctcatcctgcaggaggtggccagcttcctgaagaggaacaagcacggccccttcctgctgtttgtgtccttcctgcacgtgcacatccccctcatcaccatggagaacttcctgggcaagagcctgcacggcctgtatggagacaacgtggaggagatggactggatggtgggccgcatcctggacaccctggatgtggagggcctgagcaacagcaccctcatctacttcaccagtgaccatggaggcagcctggagaaccagctgggcaacacccagtatggaggctggaatggcatctacaagggcggcaagggcatgggcggctgggagggcggcatccgggtgcccggcatcttccgctggccaggagtgctgcctgctggccgggtcatcggggagcccaccagcctgatggatgtgttccccaccgtggtgcggctggccggcggggaggtgccccaggacagagtgattgatggccaggacctgctgcccctgctgctgggcacagcccagcacagcgaccacgagttcctgatgcactactgtgagcgcttcctgcacgccgcccgctggcaccagagggaccggggcaccatgtggaaggtgcactttgtgacccctgtgttccagcctgagggcgctggggcctgctacggcaggaaggtgtgcccctgcttcggggagaaggtggtgcaccacgacccccccctgctgtttgacctgagccgggaccccagcgagacccacatcctgaccccagccagcgagcctgtgttctaccaggtgatggagcgggtgcagcaggccgtgtgggagcaccagaggaccctgagccctgtgcccctgcagctggaccggctgggcaacatctggaggccctggctgcagccctgctgcggccccttccccctgtgctggtgcctgcgggaggatgacccccagtag

SEQ ID NO: 144111 - DNA, 1773 bp, Artificial Sequence
  Description of Artificial Sequence: Synthetic coding sequence
atgaggccccggcggcccctggtgttcatgagcctggtgtgtgccctgctgaacacctgccaggcccaccgggtgcatgatgacaagcccaacatcgtgctgatcatggtggatgacctgggcatcggggacctgggctgctatggaaatgacaccatgaggaccccccacatcgaccggctggcccgggagggcgtgcggctgacccagcacatctctgctgccagcctgtgcagccccagccgcagcgccttcctgaccggccgctaccccatccgcagcggcatggtgagcagcggcaacagaagagtcatccagaacctggccgtgcctgctggcctgcccctgaatgagaccaccctggccgccctgctgaagaagcagggctacagcacaggcctgattggcaagtggcaccagggcctgaactgtgacagcagaagtgaccagtgccaccacccctacaactacggctttgactactactacggcatgcccttcaccctggtggacagctgctggccagaccccagcaggaacacagagctggcctttgagagccagctgtggctgtgtgtgcagctggtggccatcgccatcctgaccctgaccttcggcaagctgagcggctgggtgtctgtgccctggctgctgatcttctccatgatcctcttcatcttcctgctgggctacgcctggttcagcagccacaccagccccctgtactgggactgcctgctgatgaggggccacgagatcacagagcagcccatgaaggccgagagagctggcagcatcatggtgaaggaggccatctccttcctggagcggcacagcaaggagaccttcctgctcttcttctccttcctgcacgtgcacacccccctgcccaccacagatgacttcaccggcaccagcaagcacggcctgtatggagacaacgtggaggagatggacagcatggtgggcaagatcctggatgccattgatgactttggcctgaggaacaacaccctggtgtacttcaccagtgaccacggcggccacctggaggcccggcggggccacgcccagctgggcggctggaatggcatctacaagggcggcaagggcatgggcggctgggagggcggcatccgggtgcccggcatcgtgcgctggccaggcaaggtgcctgctggccgcctcatcaaggagcccaccagcctgatggacatcctgcccaccgtggcctctgtgtctgggggcagcctgccccaggacagagtgattgatggccgggacctgatgcccctgctgcagggcaatgtgcgccacagcgagcacgagttcctgttccactactgcggcagctacctgcatgctgtgcgctggatccccaaggatgacagcggctctgtgtggaaggcccactacgtgacccctgtgttccagcccccagccagcggcggctgctacgtgaccagcctgtgccgctgcttcggggagcaggtgacctaccacaacccccccctgctgtttgacctgagccgggaccccagcgagagcacccccctgaccccagccacagagcccctgcatgactttgtgatcaagaaggtggccaatgccctgaaggagcaccaggagaccatcgtgcctgtgacctaccagctgtctgagctgaaccagggccgcacctggctgaagccctgctgcggggtcttccccttctgcctgtgtgacaaggaggaggaggtgtcccagccccggggccccaatgagaagaggtag

SEQ ID NO: 144112 - DNA, 1773 bp, Artificial Sequence; identical to SEQ ID NO: 144111
  Description of Artificial Sequence: Synthetic coding sequence

SEQ ID NO: 144113 - DNA, 1773 bp, Artificial Sequence; identical to SEQ ID NO: 144111
  Description of Artificial Sequence: Synthetic coding sequence

SEQ ID NO: 144114 - DNA, 1689 bp, Artificial Sequence
  Description of Artificial Sequence: Synthetic coding sequence
atgaccagaaatgcccggcccaacatcgtgctgctgatggctgatgacctgggcgtgggggacctgtgctgctacggcaacaacagcgtgtccacccccaacatcgaccggctggccagcgagggcgtgcggctgacccagcacctggccgccgcctccatgtgcacccccagccgggccgccttcctgaccggccgctaccccatccgcagcggcatggtgtctgcctacaacctgaacagagccttcacctggctgggcggcagcggcggcctgcccaccaatgagaccacctttgccaagctgctgcagcaccggggctacagaacaggcctgattggcaagtggcacctgggcctgagctgtgccagcagaaatgaccactgctaccaccccctgaaccacggcttccactacttctatggagtgcccttcggcctgctgagtgactgccaggccagcaagaccccagagctgcaccgctggctgcgcatcaagctgtggatcagcacagtggccctggccctggtgcccttcctgctgctgatccccaagtttgcccgctggttctctgtgccctggaaggtgatctttgtgtttgccctgctggccttcctgttcttcacctcctggtacagcagctatggcttcacccggcgctggaactgcatcctgatgagaaatcatgagatcatccagcagcccatgaaggaggagaaggtggccagcctgatgctgaaggaggccctggccttcatcgagcgctacaagcgggagcccttcctgctcttcttctccttcctgcacgtgcacacccccctcatcagcaagaagaagtttgtgggccgcagcaaatatggccgctatggagacaacgtggaggagatggactggatggtgggcaagatcctggatgccctggaccaggagcggctggccaaccacaccctggtgtacttcaccagtgacaatggaggccacctggagcccctggatggagctgtgcagctgggcggctggaatggcatctacaagggcggcaagggcatgggcggctgggagggcggcatccgggtgcccggcatcttccgctggcccagcgtgctggaggccggccgggtcatcaatgagcccaccagcctgatggacatctaccccaccctgagctacatcggcggcggcatcctgagccaggacagagtgattgatggccagaacctgatgcccctgctggagggccgggccagccacagcgaccacgagttcctgttccactactgcggcgtgtacctgcacacagtgcgctggcaccagaaggactgtgccaccgtgtggaaggcccactacgtgacccccaagttctacccagagggcactggagcctgctacggcagcggcatctgcagctgcagcggagatgtgacctaccatgacccccccctgctgtttgacatcagccgggaccccagcgaggccctgcccctgaacccagacaatgagcccctgtttgattctgtcatcaagaagatggaggccgccatccgggagcacaggaggaccctgacccctgtgccccagcagttctctgtgttcaacaccatctggaagccctggctgcagccctgctgcggcaccttccccttctgtggctgtgacaaggaggatgacatcctgcccatggccccctag

SEQ ID NO: 144115 - DNA, 1710 bp, Artificial Sequence
  Description of Artificial Sequence: Synthetic coding sequence
atgcacaccctgaccggcttcagcctggtgtccctgctgagctttggctacctgtcctgggactgggccaagcccagctttgtggctgatggccctggagaggccggggagcagcccagcgctgccccaccccagcccccccacatcatcttcatcctgacagatgaccagggctaccatgatgtgggctaccacggcagtgacatcgagacccccaccctggaccggctggccgccaagggcgtgaagctggagaactactacatccagcccatctgcacccccagccgcagccagctgctgaccggccgctaccagatccacacaggcctgcagcacagcatcatccggccccagcagcccaactgcctgcccctggaccaggtgaccctgccccagaagctgcaggaggccggctacagcacccacatggtgggcaagtggcacctgggcttctacaggaaggagtgcctgcccacccggcggggctttgacaccttcctgggcagcctgactggaaatgtggactactacacctatgacaactgtgatggccctggggtgtgtggctttgacctgcacgagggagaaaatgtggcctggggcctgagcggccagtacagcaccatgctgtatgcccagagggccagccacatcctggccagccacagcccccagaggcccctcttcctgtatgtggccttccaggccgtgcacacccccctgcagagcccccgggagtacctgtaccgctaccgcaccatgggaaatgtggcccggaggaaatatgctgccatggtgacctgcatggatgaagctgtgaggaacatcacctgggccctgaagagatatggcttctacaacaacagcgtcatcatcttcagcagtgacaatggaggccagaccttcagcggcggcagcaactggcccctgcggggcaggaagggcacctactgggagggcggcgtgcggggcctgggctttgtgcacagccccctgctgaagaggaagcagaggaccagccgggccctgatgcacatcacagactggtaccccaccctggtgggcctggccggcggcaccaccagcgctgctgatggcctggatggctatgatgtgtggccagccatcagcgagggccgggccagccccaggacagagatcctgcacaacatcgaccccctgtacaaccacgcccagcacggcagcctggagggcggcttcggcatctggaacacagctgtgcaggccgccatccgggtgggggagtggaagctgctgaccggggaccccggctatggagactggatccccccccagaccctggccaccttccctggctcctggtggaacctggagaggatggcctctgtgcggcaggccgtgtggctgttcaacatctctgctgacccctatgaaagagaggacctggccggccagaggccagatgtggtgaggaccctgctggcccggctggccgagtacaacagaacagccatccctgtgcgctacccagctgagaacccccgggcccacccagacttcaacggcggggcctggggcccctgggccagtgatgaggaggaggaggaggaggagggccgggcccggagcttcagccggggccgcaggaagaagaagtgcaagatctgcaagctgcgctccttcttcaggaagctgaacacccggctgatgagccagaggatctag

SEQ ID NO: 144116 - DNA, 261 bp, Artificial Sequence
  Description of Artificial Sequence: Synthetic coding sequence
atggtgggcaagtggcacctgggcttctacagaaaagaatgtctgcccacccggcggggctttgacaccttcctgggcagcctgactggaaatgtggactactacacctatgacaactgtgatggccctggggtgtgtggctttgacctgcatgaaggagaaaatgtggcctggggcctgagcggccagtacagcaccatgctgtatgcccagagggccagccacatcctggccagccacagcccccagaggcccctgtag

SEQ ID NO: 144117 - DNA, 1281 bp, Artificial Sequence
  Description of Artificial Sequence: Synthetic coding sequence
atggtgggcaagtggcacctgggcttctacagaaaagaatgtctgcccacccggcggggctttgacaccttcctgggcagcctgactggaaatgtggactactacacctatgacaactgtgatggccctggggtgtgtggctttgacctgcatgaaggagaaaatgtggcctggggcctgagcggccagtacagcaccatgctgtatgcccagagggccagccacatcctggccagccacagcccccagaggcccctcttcctgtatgtggccttccaggccgtgcacacccccctgcagagcccccgggagtacctgtaccgctaccgcaccatgggaaatgtggcccggaggaaatatgctgccatggtgacctgcatggatgaggccgtgaggaacatcacctgggccctgaagagatatggcttctacaacaacagcgtcatcatcttcagcagtgacaatggaggccagaccttcagcggcggcagcaactggcccctgcggggcaggaagggcacctactgggagggcggcgtgcggggcctgggctttgtgcacagccccctgctgaagaggaagcagaggaccagccgggccctgatgcacatcacagactggtaccccaccctggtgggcctggccggcggcaccaccagcgctgctgatggcctggatggctatgatgtgtggccagccatcagcgagggccgggccagccccaggacagagatcctgcacaacatcgaccccctgtacaaccacgcccagcacggcagcctggagggcggcttcggcatctggaacacagctgtgcaggccgccatccgggtgggggagtggaagctgctgactggagaccccggctacggggactggatccccccccagaccctggccaccttccctggctcctggtggaacctggagaggatggcctctgtgcggcaggccgtgtggctgttcaacatctctgctgacccctatgagcgggaggacctggccggccagaggccagatgtggtgaggaccctgctggcccggctggccgagtacaacagaacagccatccctgtgcgctacccagctgagaacccccgggcccacccagacttcaatggaggagcctggggcccctgggccagtgatgaggaggaggaggaggaggagggccgggcccgctccttcagccggggccgcaggaagaagaagtgcaagatctgcaagctgcggagcttcttcaggaagctgaacacccggctgatgagccagaggatctag

SEQ ID NO: 144118 - DNA, 1800 bp, Artificial Sequence
  Description of Artificial Sequence: Synthetic coding sequence
atggccccccggggctgtgccggccaccccccaccacccagcccccaggcctgtgtgtgccctgggaagatgctggccatgggcgccctggccggcttctggatcctgtgcctgctgacctacggctacctgtcctggggccaggccctggaggaggaggaggagggcgccctgctggcccaggccggggagaagctggagcccagcaccaccagcaccagccagccccacctgatcttcatcctggctgatgaccagggcttcagagatgtgggctaccacggcagcgagatcaagacccccaccctggacaagctggccgctgagggcgtgaagctggagaactactacgtgcagcccatctgcacccccagccgcagccagttcatcaccgggaagtaccagatccacacaggcctgcagcacagcatcatccggcccacccagcccaactgcctgcccctggacaatgccaccctgccccagaagctgaaggaggtgggctacagcacccacatggtgggcaagtggcacctgggcttctacagaaaagaatgcatgcccacccggcggggctttgacaccttcttcggcagcctgctgggcagcggggactactacacccactacaagtgtgacagccctggcatgtgtggctatgacctgtatgaaaatgacaatgctgcctgggactatgacaatggcatctacagcacccagatgtacacccagagggtgcagcagatcctggccagccacaaccccaccaagcccatcttcctgtacatcgcctaccaggccgtgcacagccccctgcaggcccctggccgctactttgagcactaccgcagcatcatcaacatcaacagaagaagatatgctgccatgctgagctgcctggatgaggccatcaacaacgtgaccctggccctgaagacctacggcttctacaacaacagcatcatcatctacagcagtgacaatggaggccagcccacagctgggggcagcaactggcccctgcggggcagcaagggcacctactgggagggcggcatccgggctgtgggctttgtgcacagccccctgctgaagaacaagggcaccgtgtgcaaggagctggtgcacatcacagactggtaccccaccctcatcagcctggccgagggccagattgatgaggacatccagctggatggctatgacatctgggagaccatcagcgagggcctgcggagcccccgggtggacatcctgcacaacatcgaccccatctacaccaaggccaagaatggctcctgggccgccggctacggcatctggaacacagccatccagagcgccatccgggtgcagcactggaagctgctgaccggcaaccctggctacagcgactgggtgcccccccagagcttcagcaacctgggccccaaccgctggcacaatgaaagaatcaccctgagcacaggcaagtctgtgtggctgttcaacatcacagctgacccctatgagcgggtggacctgagcaaccgctacccaggcatcgtgaagaagctgctgcggcggctgagccagttcaacaagacagctgtgcctgtgcgctacccacccaaggaccccaggagcaacccccggctgaatggaggagtgtggggcccctggtacaaggaggagaccaagaagaagaagcccagcaagaaccaggccgagaagaagcagaagaagagcaagaagaagaagaagaagcagcagaaggctgtgtctggcagcacctgccacagcggcgtgacctgtggctag

SEQ ID NO: 144119 - DNA, 1791 bp, Artificial Sequence
  Description of Artificial Sequence: Synthetic coding sequence
atggccccccggggctgtgccggccaccccccaccacccagcccccaggcctgtgtgtgccctgggaagatgctggccatgggcgccctggccggcttctggatcctgtgcctgctgacctacggctacctgtcctggggccaggccctggaggaggaggaggagggcgccctgctggcccaggccggggagaagctggagcccagcaccaccagcaccagccagccccacctgatcttcatcctggctgatgaccagggcttcagagatgtgggctaccacggcagcgagatcaagacccccaccctggacaagctggccgctgagggcgtgaagctggagaactactacgtgcagcccatctgcacccccagccgcagccagttcatcaccgggaagtaccagatccacacaggcctgcagcacagcatcatccggcccacccagcccaactgcctgcccctggacaatgccaccctgccccagaagctgaaggaggtgggctacagcacccacatggtgggcaagtggcacctgggcttctacagaaaagaatgcatgcccacccggcggggctttgacaccttcttcggcagcctgctgggcagcggggactactacacccactacaagtgtgacagccctggcatgtgtggctatgacctgtatgaaaatgacaatgctgcctgggactatgacaatggcatctacagcacccagatgtacacccagagggtgcagcagatcctggccagccacaaccccaccaagcccatcttcctgtacatcgcctaccaggccgtgcacagccccctgcaggcccctggccgctactttgagcactaccgcagcatcatcaacatcaacagaagaagatatgctgccatgctgagctgcctggatgaggccatcaacaacgtgaccctggccctgaagacctacggcttctacaacaacagcatcatcatctacagcagtgacaatggaggccagcccacagctgggggcagcaactggcccctgcggggcagcaagggcacctactgggagggcggcatccgggctgtgggctttgtgcacagccccctgctgaagaacaagggcaccgtgtgcaaggagctggtgcacatcacagactggtaccccaccctcatcagcctggccgagggccagattgatgaggacatccagctggatggctatgacatctgggagaccatcagcgagggcctgcggagcccccgggtggacatcctgcacaacatcgaccccatctacaccaaggccaagaatggctcctgggccgccggctacggcatctggaacacagccatccagagcgccatccgggtgcagcactggaagctgctgaccggcaaccctggctacagcgactgggtgcccccccagagcttcagcaacctgggccccaaccgctggcacaatgaaagaatcaccctgagcacaggcaagtctgtgtggctgttcaacatcacagctgacccctatgagcgggtggacctgagcaaccgctacccaggcatcgtgaagaagctgctgcggcggctgagccagttcaacaagacagctgtgcctgtgcgctacccacccaaggaccccaggagcaacccccggctgaatggaggagtgtggggcccctggtacaaggaggagaccaagaagaagaagcccagcaagaaccaggccgagaagaagcagaagaagagcaagaagaagaagaagaagcagcagaaggctgtgtctgggaagccagccaacctggccaggtag

SEQ ID NO: 144120 - DNA, 507 bp, Artificial Sequence
  Description of Artificial Sequence: Synthetic coding sequence
atggcccctggccagcaggccatgggcagcggcaccctgcagagcagccagcccagcgagtgcagcacaggcctgctgactggaaatcctggctacagcgactgggtgcccccccagagcttcagcaacctgggccccaaccgctggcacaatgaaagaatcaccctgagcacaggcaagtctgtgtggctgttcaacatcacagctgacccctatgaaagagtggacctgagcaaccgctacccaggcatcgtgaagaagctgctgcggcggctgagccagttcaacaagacagctgtgcctgtgcgctacccacccaaggaccccaggagcaacccccggctgaatggaggagtgtggggcccctggtacaaggaggagaccaagaagaagaagcccagcaagaaccaggccgagaagaagcagaagaagagcaagaagaagaagaagaagcagcagaaggctgtgtctggcagcacctgccacagcggcgtgacctgtggctag

SEQ ID NO: 144121 - DNA, 1611 bp, Artificial Sequence
  Description of Artificial Sequence: Synthetic coding sequence
atgctgctgctgtgggtgtctgtggtggccgccctggccctggccgtgctggcccctggagctggggagcagaggcggcgggccgccaaggccccaaatgtggtgctggtggtgtctgacagctttgatggccgcctgaccttccaccctggcagccaggtggtgaagctgcccttcatcaacttcatgaagacccggggcaccagcttcctgaatgcctacaccaacagccccatctgctgccccagcagagctgccatgtggagcggcctcttcacccacctgacagagagctggaacaacttcaagggcctggaccccaactacaccacctggatggatgtgatggagagacatggctaccgcacccagaagtttgggaagctggactacaccagcggccaccacagcatcagcaacagagtggaggcctggaccagagatgtggccttcctgctgcggcaggagggccggcccatggtgaacctgatccggaacagaaccaaggtgcgggtgatggagcgggactggcagaacacagacaaggctgtgaactggctgaggaaggaggccatcaactacacagagcccttcgtcatctacctgggcctgaacctgccccacccctaccccagccccagcagtggagaaaattttggcagcagcaccttccacaccagcctgtactggctggagaaggtgtcccatgatgccatcaagatccccaagtggagccccctgtctgagatgcaccctgtggactactacagcagctacaccaagaactgcaccggccgcttcaccaagaaggagatcaagaacatccgggccttctactatgccatgtgtgccgagacagatgccatgctgggggagatcatcctggccctgcaccagctggacctgctgcagaagaccatcgtcatctacagcagtgaccacggggagctggccatggagcaccggcagttctacaagatgtccatgtatgaggccagcgcccacgtgcccctgctgatgatgggccctggcatcaaggccggcctgcaggtgtccaatgtggtgtccctggtggacatctaccccaccatgctggacattgctggcatccccctgccccagaacctgagcggctacagcctgctgcccctgagcagcgagaccttcaagaatgagcacaaggtgaagaacctgcaccccccctggatcctgtctgagttccacggctgcaatgtgaatgccagcacctacatgctgcggaccaaccactggaagtacatcgcctacagtgatggagccagcatcctgccccagctgtttgacctgagcagtgaccctgatgagctgaccaacgtggccgtgaagtttcctgagatcacctacagcctggaccagaagctgcacagcatcatcaactaccccaaggtgtctgcctctgtgcaccagtacaacaaggagcagttcatcaagtggaagcagagcatcggccagaactacagcaatgtgattgccaacctgcgctggcaccaggactggcagaaggagcccaggaaatatgaaaatgccatcgaccagtggctgaagacccacatgaaccccagggctgtgtag

SEQ ID NO: 144122 - DNA, 561 bp, Artificial Sequence
  Description of Artificial Sequence: Synthetic coding sequence
atgctgctgctgtgggtgtctgtggtggccgccctggccctggccgtgctggcccctggagctggggagcagaggcggcgggccgccaaggccccaaatgtggtgctggtggtgtctgacagctttgatggccgcctgaccttccaccctggcagccaggtggtgaagctgcccttcatcaacttcatgaagacccggggcaccagcttcctgaatgcctacaccaacagccccatctgctgccccagcagagctgccatgtggagcggcctcttcacccacctgacagagagctggaacaacttcaagggcctggaccccaactacaccacctggatggatgtgatggagagacatggctaccgcacccagaagtttgggaagctggactacaccagcggccaccacagcatcagcaacagagtggaggcctggaccagagatgtggccttcctgctgcggcaggagggccggcccatggtgaacctgatccggaacagaaccaaggtgcgggtgatggagcgggactggcagaacacagacaaggctgtgactggatag

SEQ ID NO: 144123 - DNA, 1275 bp, Artificial Sequence
  Description of Artificial Sequence: Synthetic coding sequence
atgtggggctgctgcgtgtgtggggccctgtttgagggccagaggctgcggctgctgcgggcccctggagatggcctgagcagccccttcaccgtggtgtccaggaagtggcacctgggccaccacggcagctaccaccccaacttccggggctttgactactacttcggcatcccctacagccatgacatgggctgcacagacaccccaggctacaaccaccccccctgcccagcctgcccccagggagatggccccagcaggaacctgcagagggactgctacacagatgtggccctgcccctgtatgagaacctgaacatcgtggagcagcctgtgaacctgagcagcctggcccagaagtatgcagagaaggccacccagttcatccagagggccagcaccagcggccggcccttcctgctgtatgtggccctggcccacatgcacgtgcccctgcctgtgacccagctgcctgctgccccccggggccgcagcctgtatggagctggcctgtgggagatggacagcctggtgggccagatcaaggacaaggtggaccacacagtgaaggagaacaccttcctgtggttcaccggggacaatggcccctgggcccagaagtgtgagctggccggctctgtgggccccttcaccggcttctggcagacccggcagggcggcagccctgccaagcagaccacctgggagggcggccaccgggtgcctgccctggcctactggccaggccgggtgcctgtgaatgtgaccagcacagccctgctgtctgtgctggacatcttccccaccgtggtggccctggcccaggccagcctgccccagggcagaagatttgatggagtggatgtgtctgaggtgctgtttggccgcagccagcccggccaccgggtgctcttccaccccaacagcggggctgctggggagtttggagccctgcagacagtgcggctggagcgctacaaggccttctacatcactggaggagcccgggcctgtgatggcagcactggacctgagctgcagcacaagttccccctcatcttcaacctggaggatgacacagctgaggccgtgcccctggagcggggcggcgctgagtaccaggccgtgctgcctgaggtgaggaaggtgctggctgatgtgctgcaggacatcgccaatgacaacatcagcagcgctgactacacccaggaccccagcgtgaccccctgctgcaacccctaccagatcgcctgccgctgccaggccgcctag

SEQ ID NO: 144124 - DNA, 1578 bp, Artificial Sequence
  Description of Artificial Sequence: Synthetic coding sequence
atgggctggctgttcctgaaggtgctgctggccggcgtgtccttcagcggcttcctgtaccccctggtggacttctgcatcagcggcaagacccggggccagaagcccaacttcgtcatcatcctggctgatgacatgggctggggagacctgggcgccaactgggccgagaccaaggacacagccaacctggacaagatggccagcgagggcatgagatttgtggacttccacgccgccgccagcacctgcagccccagccgggccagcctgctgaccggccgcctgggcctgagaaatggagtgaccaggaactttgctgtgacctctgtgggcggcctgcccctgaatgagaccaccctggccgaggtgctgcagcaggccggctacgtgacaggcatcatcggcaagtggcacctgggccaccacggcagctaccaccccaacttccggggctttgactactacttcggcatcccctacagccatgacatgggctgcacagacaccccaggctacaaccaccccccctgcccagcctgcccccagggagatggccccagcaggaacctgcagagggactgctacacagatgtggccctgcccctgtatgagaacctgaacatcgtggagcagcctgtgaacctgagcagcctggcccagaagtatgcagagaaggccacccagttcatccagagggccagcaccagcggccggcccttcctgctgtatgtggccctggcccacatgcacgtgcccctgcctgtgacccagctgcctgctgccccccggggccgcagcctgtatggagctggcctgtgggagatggacagcctggtgggccagatcaaggacaaggtggaccacacagtgaaggagaacaccttcctgtggttcaccggggacaatggcccctgggcccagaagtgtgagctggccggctctgtgggccccttcaccggcttctggcagacccggcagggcggcagccctgccaagcagaccacctgggagggcggccaccgggtgcctgccctggcctactggccaggccgggtgcctgtgaatgtgaccagcacagccctgctgtctgtgctggacatcttccccaccgtggtggccctggcccaggccagcctgccccagggccgccgctttgatggagtggatgtgtctgaggtgctgtttggccgcagccagcccggccaccgggtgctcttccaccccaacagcggggccgccggggagtttggagccctgcagacagtgcggctggagcgctacaaggccttctacatcaccggcggggcccgggcctgtgatggcagcacaggccctgagctgcagcacaagttccccctcatcttcaacctggaggatgacacagctgaggccgtgcccctggagcggggcggcgctgagtaccaggccgtgctgcctgaggtgaggaaggtgctggctgatgtgctgcaggacatcgccaatgacaacatcagcagcgctgactacacccaggaccccagcgtgaccccctgctgcaacccctaccagatcgcctgccgctgccaggccgcctag

SEQ ID NO: 144125 - DNA, 747 bp, Artificial Sequence
  Description of Artificial Sequence: Synthetic coding sequence
atgaccaagaccagcacctgcatctaccacttcctggtgctgtcctggtacaccttcctgaactactacatcagccaggagggcaaggatgaggtgaagcccaagatcctggccaatggagcccgctggaagtacatgaccctgctgaacctgctgaagaacagaacagctggctttgacatctaccagcccggcagcttccggcagctgctgcagaccatcttctacggcgtgacctgcctggatgatgtgctgaagaggaccaagggcggcaaggacatcaagttcctgacagccttccgggacctgctcttcaccaccctggccttccctgtgtccacctttgtgttcctggccttctggatcctcttcctgtacaacagagacctgatctaccccaaggtgctggacaccgtcatccctgtgtggctgaaccacgccatgcacaccttcatcttccccatcaccctggccgaggtggtgctgcggccccacagctaccccagcaagaagacaggcctgaccctgctggccgccgccagcatcgcctacatcagccgcatcctgtggctgtactttgaaacaggcacctgggtgtaccctgtgtttgccaagctgagcctgctgggcctggccgccttcttcagcctgtcctatgtgttcatcgccagcatctacctgctgggggagaagctgaaccactggaagtggggagacatgaggcagcccaggaagaagaggaagtag

SEQ ID NO: 144126 - DNA, 609 bp, Artificial Sequence
  Description of Artificial Sequence: Synthetic coding sequence
atggccaaggtgtctgtgctgaatgtggccgtgctggagaaccccagccccttccacagccccttccgctttgagatcagctttgaatgttctgaggccctggctgatgacctggagtggaagatcatctacgtgggcagcgctgagagcgaggagtttgaccagatcctggacagcgtgctggtgggccctgtgcctgctggccgccacatgtttgtgttccaggctgatgcccccaaccccagcctcatccctgagacagatgctgtgggcgtgacagtggtgctgatcacctgcacctaccacggccaggagttcatccgggtgggctactacgtgaacaatgagtacctgaaccctgagctgcgggagaacccccccatgaagccagacttcagccagctgcagaggaacatcctggccagcaacccccgggtgacccgcttccacatcaactgggacaacaacatggaccggctggaggccatcgagacccaggaccccagcctgggctgcggcctgcccctgaactgcacccccatcaagggcctgggcctgcccggctgcatccctggcctgctgcctgagaacagcatggactgcatctag

SEQ ID NO: 144127 - DNA, 1506 bp, Artificial Sequence
  Description of Artificial Sequence: Synthetic coding sequence
atggacacccaggccggctctgtggatgaagaaaatggccggcagctgggggaggtggagctgcagtgtggcatctgcaccaagtggttcaccgctgacacctttggaattgacaccagcagctgcctgcccttcatgaccaactacagcttccactgcaatgtgtgccaccacagcggcaacacctacttcctgaggaagcaggccaacctgaaggagatgtgcctgagcgccctggccaacctgacctggcagagcaggacccaggatgagcaccccaagaccatgttcagcaaggacaaggacatcatccccttcatcgacaagtactgggagtgcatgaccacccggcagaggcctgggaagatgacctggcccaacaacatcgtgaagaccatgagcaaggagagagatgtgttcctggtgaaggagcacccagaccccggcagcaaggaccctgaggaggactaccccaagtttggcctgctggaccaggacctgagcaacatcggccctgcctatgacaaccagaagcagagcagcgctgtgtccaccagcggcaacctgaatggaggcattgctgctggcagcagcggcaagggccgcggggccaagaggaagcagcaggacggcggcaccaccggcaccaccaagaaggcccggagtgaccccctcttcagcgcccagaggctgcccccccacggctaccccctggagcaccccttcaacaaggatggctaccgctacatcctggccgagccagacccccacgccccagaccctgagaagctggagctggactgctgggccggcaagcccatccctggggacctgtaccgggcctgcctgtatgaaagagtgctgctggccctgcatgaccgggccccccagctgaagatcagtgatgaccggctgactgtggtgggggagaagggctacagcatggtgcgggccagccacggcgtgaggaagggggcctggtactttgagatcaccgtggatgagatgcccccagacacagctgcccggctgggctggagccagcccctgggcaacctgcaggcccccctgggctatgacaagttctcctacagctggaggagcaagaagggcaccaagttccaccagagcatcggcaagcactacagcagcggctacggccagggagatgtgctgggcttctacatcaacctgcctgaggacacagaaacagccaagagcctgcctgacacctacaaggacaaggccctgatcaagttcaagagctacctgtactttgaggagaaggactttgtggacaaggccgagaagagcctgaagcagaccccccacagcgaggtgtccatcaactttggcccctgcttcaagtacccacccaaggacctgacctaccggcccatgtctgacatgggctggggcgctgtggtggagcacaccctggctgatgtgctgtaccacgtggagacagaggtggatggccgccgcagccccccctgggagccctag

SEQ ID NO: 144128 - DNA, 1887 bp, Artificial Sequence
  Description of Artificial Sequence: Synthetic coding sequence
atggctgctgctggggccggccctggccaggaggccggggccggccctggccctggagctgtggccaatgccactggagctgaggagggggagatgaagcctgtggccgccggggccgccgcccctcctggagagggcatctctgctgcccccaccgtggagcccagcagtggagaggccgagggcggggaggccaacctggtggatgtgtctgggggcctggagacagagagcagcaatggcaaggacaccctggagggcgctggggacaccagcgaggtgatggacacccaggccggctctgtggatgaagaaaatggccggcagctgggggaggtggagctgcagtgtggcatctgcaccaagtggttcaccgctgacacctttggaattgacaccagcagctgcctgcccttcatgaccaactacagcttccactgcaatgtgtgccaccacagcggcaacacctacttcctgaggaagcaggccaacctgaaggagatgtgcctgagcgccctggccaacctgacctggcagagcaggacccaggatgagcaccccaagaccatgttcagcaaggacaaggacatcatccccttcatcgacaagtactgggagtgcatgaccacccggcagaggcctgggaagatgacctggcccaacaacatcgtgaagaccatgagcaaggagagagatgtgttcctggtgaaggagcacccagaccccggcagcaaggaccctgaggaggactaccccaagtttggcctgctggaccaggacctgagcaacatcggccctgcctatgacaaccagaagcagagcagcgctgtgtccaccagcggcaacctgaatggaggcattgctgctggcagcagcggcaagggccgcggggccaagaggaagcagcaggacggcggcaccaccggcaccaccaagaaggcccggagtgaccccctcttcagcgcccagaggctgcccccccacggctaccccctggagcaccccttcaacaaggatggctaccgctacatcctggccgagccagacccccacgccccagaccctgagaagctggagctggactgctgggccggcaagcccatccctggggacctgtaccgggcctgcctgtatgaaagagtgctgctggccctgcatgaccgggccccccagctgaagatcagtgatgaccggctgactgtggtgggggagaagggctacagcatggtgcgggccagccacggcgtgaggaagggggcctggtactttgagatcaccgtggatgagatgcccccagacacagctgcccggctgggctggagccagcccctgggcaacctgcaggcccccctgggctatgacaagttctcctacagctggaggagcaagaagggcaccaagttccaccagagcatcggcaagcactacagcagcggctacggccagggagatgtgctgggcttctacatcaacctgcctgaggacacagaaacagccaagagcctgcctgacacctacaaggacaaggccctgatcaagttcaagagctacctgtactttgaggagaaggactttgtggacaaggccgagaagagcctgaagcagaccccccacagcgagatcatcttctacaagaatggagtgaaccagggcgtggcctacaaggacatctttgagggcgtgtacttccctgccatcagcctgtacaagagctgcaccgtgtccatcaactttggcccctgcttcaagtacccacccaaggacctgacctaccggcccatgtctgacatgggctggggcgctgtggtggagcacaccctggctgatgtgctgtaccacgtggagacagaggtggatggaagaagaagccccccctgggagccctag

SEQ ID NO: 144129 - DNA, 1605 bp, Artificial Sequence
  Description of Artificial Sequence: Synthetic coding sequence
atggacacccaggccggctctgtggatgaagaaaatggccggcagctgggggaggtggagctgcagtgtggcatctgcaccaagtggttcaccgctgacacctttggaattgacaccagcagctgcctgcccttcatgaccaactacagcttccactgcaatgtgtgccaccacagcggcaacacctacttcctgaggaagcaggccaacctgaaggagatgtgcctgagcgccctggccaacctgacctggcagagcaggacccaggatgagcaccccaagaccatgttcagcaaggacaaggacatcatccccttcatcgacaagtactgggagtgcatgaccacccggcagaggcctgggaagatgacctggcccaacaacatcgtgaagaccatgagcaaggagagagatgtgttcctggtgaaggagcacccagaccccggcagcaaggaccctgaggaggactaccccaagtttggcctgctggaccaggacctgagcaacatcggccctgcctatgacaaccagaagcagagcagcgctgtgtccaccagcggcaacctgaatggaggcattgctgctggcagcagcggcaagggccgcggggccaagaggaagcagcaggacggcggcaccaccggcaccaccaagaaggcccggagtgaccccctcttcagcgcccagaggctgcccccccacggctaccccctggagcaccccttcaacaaggatggctaccgctacatcctggccgagccagacccccacgccccagaccctgagaagctggagctggactgctgggccggcaagcccatccctggggacctgtaccgggcctgcctgtatgaaagagtgctgctggccctgcatgaccgggccccccagctgaagatcagtgatgaccggctgactgtggtgggggagaagggctacagcatggtgcgggccagccacggcgtgaggaagggggcctggtactttgagatcaccgtggatgagatgcccccagacacagctgcccggctgggctggagccagcccctgggcaacctgcaggcccccctgggctatgacaagttctcctacagctggaggagcaagaagggcaccaagttccaccagagcatcggcaagcactacagcagcggctacggccagggagatgtgctgggcttctacatcaacctgcctgaggacacagaaacagccaagagcctgcctgacacctacaaggacaaggccctgatcaagttcaagagctacctgtactttgaggagaaggactttgtggacaaggccgagaagagcctgaagcagaccccccacagcgagatcatcttctacaagaatggagtgaaccagggcgtggcctacaaggacatctttgagggcgtgtacttccctgccatcagcctgtacaagagctgcaccgtgtccatcaactttggcccctgcttcaagtacccacccaaggacctgacctaccggcccatgtctgacatgggctggggcgctgtggtggagcacaccctggctgatgtgctgtaccacgtggagacagaggtggatggaagaagaagccccccctgggagccctag

SEQ ID NO: 144130 - DNA, 1506 bp, Artificial Sequence; identical to SEQ ID NO: 144127
  Description of Artificial Sequence: Synthetic coding sequence

SEQ ID NO: 144131 - DNA, 1470 bp, Artificial Sequence
  Description of Artificial Sequence: Synthetic coding sequence
atgaccaactacagcttccactgcaatgtgtgccaccacagcggcaacacctacttcctgaggaagcaggccaacctgaaggagatgtgcctgagcgccctggccaacctgacctggcagagcaggacccaggatgagcaccccaagaccatgttcagcaaggacaaggacatcatccccttcatcgacaagtactgggagtgcatgaccacccggcagaggcctgggaagatgacctggcccaacaacatcgtgaagaccatgagcaaggagagagatgtgttcctggtgaaggagcacccagaccccggcagcaaggaccctgaggaggactaccccaagtttggcctgctggaccaggacctgagcaacatcggccctgcctatgacaaccagaagcagagcagcgctgtgtccaccagcggcaacctgaatggaggcattgctgctggcagcagcggcaagggccgcggggccaagaggaagcagcaggacggcggcaccaccggcaccaccaagaaggcccggagtgaccccctcttcagcgcccagaggctgccccctcatggctaccccctggagcaccccttcaacaaggatggctaccgctacatcctggccgagccagacccccacgccccagaccctgagaagctggagctggactgctgggccggcaagcccatccctggggacctgtaccgggcctgcctgtatgagcgggtgctgctggccctgcatgaccgggccccccagctgaagatcagtgatgaccggctgactgtggtgggggagaagggctacagcatggtgcgggccagccatggagtgaggaaaggagcctggtactttgagatcaccgtggatgagatgcccccagacacagctgcccggctgggctggagccagcccctgggcaacctgcaggcccccctgggctatgacaagttctcctacagctggaggagcaagaagggcaccaagttccaccagagcatcggcaagcactacagcagcggctacggccagggagatgtgctgggcttctacatcaacctgcctgaggacacagaaacagccaagagcctgcctgacacctacaaggacaaggccctgatcaagttcaagagctacctgtactttgaggagaaggactttgtggacaaggccgagaagagcctgaagcagaccccccacagcgagatcatcttctacaagaatggagtgaaccagggcgtggcctacaaggacatctttgaaggagtgtacttccctgccatcagcctgtacaagagctgcaccgtgtccatcaactttggcccctgcttcaagtacccacccaaggacctgacctaccggcccatgtctgacatgggctggggcgctgtggtggagcacaccctggctgatgtgctgtaccacgtggagacagaggtggatggccgccgcagccccccctgggagccctag

SEQ ID NO: 144132 - DNA, 876 bp, Artificial Sequence
  Description of Artificial Sequence: Synthetic coding sequence
atgaccaaggagtaccaggacctgcagcacctggacaatgaggagagtgaccaccaccagctgaggaaaggacctcctccaccccagcccctgctgcagaggctgtgcagcggcccccggctgctgctgctgagcctgggcctgagcctgctgctgctggtggtggtgtgtgtgattggcagccagaacagccagctgcaggaggagctgcggggcctgcgggagaccttcagcaacttcaccgccagcacagaggcccaggtgaagggcctgagcacccagggcggcaatgtgggcaggaagatgaagagcctggagagccagctggagaagcagcagaaggacctgtctgaggaccacagcagcctgctgctgcacgtgaagcagtttgtgtctgacctgcggagcctgagctgccagatggccgccctgcagggcaatggaagtgagaggacctgctgccctgtgaactgggtggagcacgagaggagctgctactggttcagccgcagcggcaaggcctgggcagatgctgacaactactgccgcctggaggatgcccacctggtggtggtgacctcctgggaggagcagaagtttgtgcagcaccacatcggccctgtgaacacctggatgggcctgcatgaccagaatggcccctggaagtgggtggatggaacagattatgaaacaggcttcaagaactggaggcctgagcagccagatgactggtacggccacggcctgggcggcggggaggactgtgcccacttcacagatgatggccgctggaatgatgatgtgtgccagaggccctaccgctgggtgtgtgaaacagagctggacaaggccagccaggagccccccctgctgtag

SEQ ID NO: 144133 - DNA, 759 bp, Artificial Sequence
  Description of Artificial Sequence: Synthetic coding sequence
atgaccaaggagtaccaggacctgcagcacctggacaatgaggagagtgaccaccaccagctgaggaaggacagccagctgcaggaggagctgcggggcctgcgggagaccttcagcaacttcaccgccagcacagaggcccaggtgaagggcctgagcacccagggcggcaatgtgggcaggaagatgaagagcctggagagccagctggagaagcagcagaaggacctgtctgaggaccacagcagcctgctgctgcacgtgaagcagtttgtgtctgacctgcggagcctgagctgccagatggccgccctgcagggcaatggcagcgagaggacctgctgccctgtgaactgggtggagcacgagaggagctgctactggttcagccgcagcggcaaggcctgggcagatgctgacaactactgccgcctggaggatgcccacctggtggtggtgacctcctgggaggagcagaagtttgtgcagcaccacatcggccctgtgaacacctggatgggcctgcatgaccagaatggcccctggaagtgggtggatggaacagattatgagaccggcttcaagaactggaggcctgagcagccagatgactggtacggccacggcctgggcggcggggaggactgtgcccacttcacagatgatggccgctggaatgatgatgtgtgccagaggccctaccgctgggtgtgtgaaacagagctggacaaggccagccaggagccccccctgctgtag

SEQ ID NO: 144134 - DNA, 759 bp, Artificial Sequence; identical to SEQ ID NO: 144133
  Description of Artificial Sequence: Synthetic coding sequence

SEQ ID NO: 144135 - DNA, 5679 bp, Artificial Sequence
  Description of Artificial Sequence: Synthetic coding sequence
atggccaacagaagagtgggccggggctgctgggaggtgagccccacagagcggcggcccccagctggcctgcggggccctgctgctgaggaggaggccagcagcccccctgtgctgagcctgagccacttctgccgcagccccttcctgtgctttggagatgtgctgctgggcgccagcaggaccctgagcctggccctggacaaccccaatgaggaggtggccgaggtgaagatcagccacttccctgctgctgacctgggcttctctgtgtcccagcgctgctttgtgctgcagcccaaggagaagatcgtcatctctgtgaactggacccccctgaaggagggccgggtgcgggagatcatgaccttcctggtgaatgatgtgctgaagcaccaggccatcctgctgggcaatgctgaggagcagaagaagaagaagaggagcctgtgggacaccatcaagaagaagaagatcagcgccagcaccagccacaacagaagagtgagcaacatccagaatgtgaacaagaccttctctgtgtcccagaaggtggacagagtgcgcagccccctgcaggcctgtgagaacctggccatgaatgaaggaggccccccaacagagaacaacagcctcatcctggaggagaacaagatccccatcagccccatcagccctgccttcaatgaatgccacggggccacctgcctgcccctgtctgtgcggcgcagcaccacctacagcagcctgcacgccagcgagaaccgggagctgctgaatgtgcacagcgccaacgtgtccaaggtgtccttcaatgagaaggctgtgacagagaccagcttcaacagcgtgaatgtgaatggccagagaggagagaacagcaagctgagcctgacccccaactgcagcagcaccctgaacatcacccagagccagatccacttcctgagcccagacagctttgtgaacaacagccacggggccaacaatgagctggagctggtgacctgcctgagcagtgacatgttcatgaaggacaacagccagcctgtgcacctggagagcaccatcgcccacgagatctaccagaagatcctgagcccagacagcttcatcaaggacaactacggcctgaaccaggacctggagagcgagagcgtgaaccccatcctgagccccaaccagttcctgaaggacaacatggcctacatgtgcaccagccagcagacctgcaaggtgcccctgagcaatgaaaacagccaggtgccccagagccctgaggactggaggaagtctgaggtgagcccccgcatccctgagtgccagggcagcaagagccccaaggccatctttgaggagctggtggagatgaagagcaactactacagcttcatcaagcagaacaaccccaagttctctgctgtgcaggacatcagcagccacagccacaacaagcagcccaagagaagacccatcctgagcgccaccgtgaccaagaggaaggccacctgcacccgggagaaccagacagagatcaacaagcccaaggccaagcgctgcctgaacagcgctgtgggggagcacgagaaggtgatcaacaaccagaaggagaaggaggacttccacagctacctgcccatcatcgaccccatcctgagcaagagcaagagctacaagaatgaggtgacccccagcagcaccacagcctctgtggccaggaagaggaagagtgatggctccatggaggatgccaacgtgcgggtggccatcacagagcacacagaggtgcgggagatcaagaggatccacttcagccccagcgagcccaagaccagcgctgtgaagaagaccaagaatgtgaccacccccatcagcaagaggatcagcaaccgggagaagctgaacctgaagaagaagacagacctgagcatcttccgcacccccatcagcaagaccaacaagaggaccaagcccatcatcgctgtggcccagagcagcctgaccttcatcaagcccctgaagacagacatccccaggcaccccatgccctttgctgccaagaacatgttttatgatgagcgctggaaggagaagcaggagcagggcttcacctggtggctgaacttcatcctgaccccagatgacttcaccgtgaagaccaacatcagcgaggtgaatgctgccaccctgctgctgggcatcgagaaccagcacaagatctctgtgccccgggcccccaccaaggaggagatgagcctgcgggcctacacagcccgctgccgcctgaaccggctgcggcgggccgcctgccgcctcttcaccagcgagaagatggtgaaggccatcaagaagctggagattgaaattgaggcccggcggctgattgtgaggaaggacagacacctgtggaaggatgtgggggagcggcagaaggtgctgaactggctgctgagctacaaccccctgtggctgcgcatcggcctggagaccacctacggggagctgatcagcctggaggacaacagtgatgtgacaggcctggccatgttcatcctgaaccggctgctgtggaacccagacattgctgctgagtaccgccaccccaccgtgccccacctgtacagagatggccacgaggaggccctgagcaagttcaccctgaagaagctgctgctgctggtgtgcttcctggactatgccaagatcagccggctgattgaccatgacccctgcctcttctgcaaggatgctgagttcaaggccagcaaggagatcctgctggccttcagccgggacttcctgtctggagagggggacctgagccgccacctgggcctgctgggcctgcctgtgaaccacgtgcagaccccatttgatgaatttgattttgctgtgaccaacctggccgtggacctgcagtgtggggtgcggctggtgaggaccatggagctgctgacccagaactgggacctgagcaagaagctgcgcatcccagccatcagccggctgcagaagatgcacaacgtggacatcgtgctgcaggtgctgaagagccggggcatcgagctgagtgatgaacatggcaacaccatcctgagcaaggacatcgtggacagacaccgggagaagaccctgcggctgctgtggaagatcgcctttgccttccaggtggacatcagcctgaacctggaccagctgaaggaggagatcgccttcctgaagcacaccaagagcatcaagaagaccatcagcctgctgagctgccacagtgatgacctgatcaacaagaagaagggcaagagggacagcggcagctttgagcagtacagcgagaacatcaagctgctgatggactgggtgaatgctgtgtgtgccttctacaacaagaaggtggagaacttcaccgtgtccttcagtgatggccgggtgctgtgctacctgatccaccactaccacccctgctacgtgccctttgatgccatctgccagaggaccacccagacagtggagtgcacccagacaggctctgtggtgctgaacagcagcagcgagagtgatgacagcagcctggacatgagcctgaaggcctttgaccacgagaacaccagcgagctgtacaaggagctgctggagaatgagaagaagaacttccacctggtgcgctctgctgtgcgggacctgggcggcatcccagccatgatcaaccacagcgacatgagcaacaccatcccagatgagaaggtggtgatcacctacctgtccttcctgtgtgcccggctgctggacctgaggaaggagatccgggccgcccggctcatccagaccacctggaggaagtacaagctgaagacagacctgaagaggcaccaggagcgggagaaggccgcccgcatcatccagctggccgtcatcaacttcctggccaagcagaggctgaggaagagggtgaatgctgccctggtgatccagaagtactggaggagagtgctggcccagaggaagctgctgatgctgaagaaggagaagctggagaaggtgcagaacaaggccgccagcctcatccaggccatgtggaggcgctaccgggccaagaagtacctgtgcaaggtgaaggccgcctgcaagatccaggcctggtaccgctgctggagggcccacaaggagtacctggccatcctgaaggctgtgaagatcatccagggctgcttctacaccaagctggagaggacccgcttcctgaatgtgcgggccagcgccatcatcatccagaggaagtggagggccatcctgcctgccaagatcgcccacgagcacttcctgatgatcaagaggcacagagctgcctgcctgatccaggcccactaccggggctacaagggccggcaggtgttcctgcggcagaagtctgctgccctgatcatccagaagtacatccgggcccgggaggccggcaagcatgagcgcatcaagtacatcgagttcaagaagagcaccgtcatcctgcaggccctggtgcggggctggctggtgaggaagcgcttcctggagcagagggccaagatccggctgctgcacttcaccgctgctgcctactaccacctgaatgctgtgcgcatccagagggcctacaagctgtacctggccgtgaagaatgccaacaagcaggtgaacagcgtcatctgcatccagcgctggttccgggcccggctgcaggagaagcgcttcatccagaagtaccacagcatcaagaagattgaacatgagggccaggagtgcctgagccagaggaacagagctgccagcgtcatccagaaggctgtgcgccacttcctgctgaggaagaagcaggagaagttcaccagcggcatcatcaagatccaggccctgtggaggggctacagctggaggaagaagaatgactgcaccaagatcaaggccatccggctgagcctgcaggtggtgaaccgggagatccgggaggagaacaagctgtacaagaggacagccctggccctgcactacctgctgacctacaagcacctgagcgccatcctggaggccctgaagcacctggaggtggtgacccggctgagccccctgtgctgtgagaacatggcccagagcggggccatcagcaagatctttgtgctgatccgcagctgcaacagaagcatcccctgcatggaggtgatccgctatgctgtgcaggtgctgctgaatgtgtccaaatatgagaagaccaccagcgctgtgtatgatgtggagaactgcatcgacatcctgctggagctgctgcagatctaccgggagaagccaggcaacaaggtggccgacaagggcggcagcatcttcaccaagacctgctgcctgctggccatcctgctgaagaccaccaacagagccagtgatgtgcgcagccgcagcaaggtggtggaccgcatctacagcctgtacaagctgacagcccacaagcacaagatgaacacagagcgcatcctgtacaagcagaagaagaacagcagcatcagcatccccttcatccctgagacccctgtgaggacccgcatcgtgtcccggctgaagccagactgggtgctgcggcgggacaacatggaggagatcaccaaccccctgcaggccatccagatggtgatggacaccctgggcatcccctactag

SEQ ID NO: 144136 - DNA, 4170 bp, Artificial Sequence
  Description of Artificial Sequence: Synthetic coding sequence
atggccaacagaagagtgggccggggctgctgggaggtgagccccacagagcggcggcccccagctggcctgcggggccctgctgctgaggaggaggccagcagcccccctgtgctgagcctgagccacttctgccgcagccccttcctgtgctttggagatgtgctgctgggcgccagcaggaccctgagcctggccctggacaaccccaatgaggaggtggccgaggtgaagatcagccacttccctgctgctgacctgggcttctctgtgtcccagcgctgctttgtgctgcagcccaaggagaagatcgtcatctctgtgaactggacccccctgaaggagggccgggtgcgggagatcatgaccttcctggtgaatgatgtgctgaagcaccaggccatcctgctgggcaatgctgaggagcagaagaagaagaagaggagcctgtgggacaccatcaagaagaagaagatcagcgccagcaccagccacaacagaagagtgagcaacatccagaatgtgaacaagaccttctctgtgtcccagaaggtggaccggcgctaccggcagcagacctacttcaacaagctgaagaagatcaccaagacagtgcagcagcgctactgggccatgaaggagaggaacatccagttccagcgctacaacaagctgcggcacagcgtcatctacatccaggccatcttccggggcaagaaggcccggcggcacctgaagatgatgcacatcgccgccaccctcatccagaggcgcttccgcaccctgatgatgagaagacgcttcctgagcctgaagaagacagccatcctgatccagaggaagtaccgggcccacctgtgcaccaagcaccacctgcagttcctgcaggtgcagaatgctgtgatcaagatccagagcagctaccgccgctggatgatcaggaagaggatgagggagatgcacagagctgccaccttcatccagagcaccttcaggatgcaccggctgcacatgagataccaggccctgaagcaggcctctgtggtgatccagcagcagtaccaggccaacagagctgccaagctgcagaggcagcactacctgcggcagaggcacagcgctgtgatcctgcaggccgccttccggggcatgaagaccaggaggcacctgaagtccatgcacagcagcgccaccctcatccagagccgcttccgcagcctgctggtgagaagacgcttcatcagcctgaagaaggccaccatctttgtgcagaggaagtaccgggccaccatctgtgccaagcacaagctgtaccagttcctgcacctgaggaaggccgccatcaccatccagagcagctacagaaggctgatggtgaagaagaagctgcaggagatgcagagagctgctgtgctgatccaggccaccttcaggatgtaccgcacctacatcaccttccagacctggaagcacgccagcatcctgatccagcagcactaccgcacctacagagctgccaagctgcagcgggagaactacatccggcagtggcacagcgctgtggtgatccaggccgcctacaagggcatgaaggcccggcagctgctgcgggagaagcacaaggccagcatcgtcatccagagcacctacaggatgtaccggcagtactgcttctaccagaagctgcagtgggccaccaagatcatccaggagaagtaccgggccaacaagaagaagcagaaggtgttccagcacaatgagctgaagaaggagacctgtgtgcaggccggcttccaggacatgaacatcaagaagcagatccaggagcagcaccaggccgccatcatcatccagaagcactgcaaggccttcaagatcaggaagcactacctgcacctgcgggccaccgtggtgtccatccagaggcgctacaggaagctgacagctgtgaggacccaggccgtcatctgcatccagagctactaccggggcttcaaggtgaggaaggacatccagaacatgcacagagctgccaccctcatccagagcttctacaggatgcaccgggccaaggtggactatgagaccaagaagacagccatcgtggtgatccagaactactaccgcctgtatgtgcgggtgaagacagagaggaagaacttcctggccgtgcagaagtctgtgaggaccatccaggccgccttccggggcatgaaggtgcggcagaagctgaagaatgtgtctgaggagaagatggccgccatcgtgaaccagagcgccctgtgctgctaccgcagcaagacccagtatgaggccgtgcagagcgagggcgtgatgatccaggagtggtacaaggccagcggcctggcctgcagccaggaggccgagtaccacagccagagcagagctgctgtgaccatccagaaggccttctgcaggatggtgaccaggaagctggagacccagaagtgtgccgccctgcgcatccagttcttcctgcagatggctgtgtacagaagaagatttgtgcagcagaagagagctgccatcaccctgcagcactacttccgcacctggcagaccaggaagcagttcctgctgtacaggaaggctgctgtggtgctgcagaaccactaccgggccttcctgagcgccaagcaccagaggcaggtgtacctgcagatccgcagcagcgtcatcatcatccaggcccggagcaagggcttcatccagaagaggaagttccaggagatcaagaacagcaccatcaagatccaggccatgtggaggcgctaccgggccaagaagtacctgtgcaaggtgaaggccgcctgcaagatccaggcctggtaccgctgctggagggcccacaaggagtacctggccatcctgaaggctgtgaagatcatccagggctgcttctacaccaagctggagaggacccgcttcctgaatgtgcgggccagcgccatcatcatccagaggaagtggagggccatcctgcctgccaagatcgcccacgagcacttcctgatgatcaagaggcaccgggccgcctgcctgatccaggcccactaccggggctacaagggccggcaggtgttcctgcggcagaagtctgctgccctgatcatccagaagtacatccgggcccgggaggccggcaagcatgagcgcatcaagtacatcgagttcaagaagagcaccgtcatcctgcaggccctggtgcggggctggctggtgaggaagcgcttcctggagcagagggccaagatccggctgctgcacttcaccgctgctgcctactaccacctgaatgctgtgcgcatccagagggcctacaagctgtacctggccgtgaagaatgccaacaagcaggtgaacagcgtcatctgcatccagcgctggttccgggcccggctgcaggagaagcgcttcatccagaagtaccacagcatcaagaagattgagcacgagggccaggagtgcctgagccagaggaacagagctgccagcgtcatccagaaggctgtgcgccacttcctgctgaggaagaagcaggagaagttcaccagcggcatcatcaagatccaggccctgtggaggggctacagctggaggaagaagaatgactgcaccaagatcaaggccatccggctgagcctgcaggtggtgaaccgggagatccgggaggagaacaagctgtacaagaggacagccctggccctgcactacctgctgacctacaagcacctgagcgccatcctggaggccctgaagcacctggaggtggtgacccggctgagccccctgtgctgtgagaacatggcccagagcggggccatcagcaagatctttgtgctgatccgcagctgcaacagaagcatcccctgcatggaggtgatccgctatgctgtgcaggtgctgctgaatgtgtccaaatatgagaagaccaccagcgctgtgtatgatgtggagaactgcatcgacatcctgctggagctgctgcagatctaccgggagaagccaggcaacaaggtggccgacaagggcggcagcatcttcaccaagacctgctgcctgctggccatcctgctgaagaccaccaacagagcctctgtgtccatcagccagctgcccttcttcaagatcatcttcctgtggagctag

SEQ ID NO: 144137 - DNA, 3429 bp, Artificial Sequence
  Description of Artificial Sequence: Synthetic coding sequence
atgagcctgcgggcctacacagcccgctgccgcctgaaccggctgcggcgggccgcctgccgcctcttcaccagcgagaagatggtgaaggccatcaagaagctggagattgaaattgaggcccggcggctgattgtgaggaaggacagacacctgtggaaggatgtgggggagcggcagaaggtgctgaactggctgctgagctacaaccccctgtggctgcgcatcggcctggagaccacctacggggagctgatcagcctggaggacaacagtgatgtgacaggcctggccatgttcatcctgaaccggctgctgtggaacccagacattgctgctgagtaccgccaccccaccgtgccccacctgtacagagatggccacgaggaggccctgagcaagttcaccctgaagaagctgctgctgctggtgtgcttcctggactatgccaagatcagccggctgattgaccatgacccctgcctcttctgcaaggatgctgagttcaaggccagcaaggagatcctgctggccttcagccgggacttcctgtctggagagggggacctgagccgccacctgggcctgctgggcctgcctgtgaaccacgtgcagaccccatttgatgaatttgattttgctgtgaccaacctggccgtggacctgcagtgtggggtgcggctggtgaggaccatggagctgctgacccagaactgggacctgagcaagaagctgcgcatcccagccatcagccggctgcagaagatgcacaacgtggacatcgtgctgcaggtgctgaagagccggggcatcgagctgagtgatgaacatggcaacaccatcctgagcaaggacatcgtggacagacaccgggagaagaccctgcggctgctgtggaagatcgcctttgccttccaggtggacatcagcctgaacctggaccagctgaaggaggagatcgccttcctgaagcacaccaagagcatcaagaagaccatcagcctgctgagctgccacagtgatgacctgatcaacaagaagaagggcaagagggacagcggcagctttgagcagtacagcgagaacatcaagctgctgatggactgggtgaatgctgtgtgtgccttctacaacaagaaggtggagaacttcaccgtgtccttcagtgatggccgggtgctgtgctacctgatccaccactaccacccctgctacgtgccctttgatgccatctgccagaggaccacccagacagtggagtgcacccagacaggctctgtggtgctgaacagcagcagcgagagtgatgacagcagcctggacatgagcctgaaggcctttgaccacgagaacaccagcgagctgtacaaggagctgctggagaatgagaagaagaacttccacctggtgcgctctgctgtgcgggacctgggcggcatcccagccatgatcaaccacagcgacatgagcaacaccatcccagatgagaaggtggtgatcacctacctgtccttcctgtgtgcccggctgctggacctgaggaaggagatccgggccgcccggctcatccagaccacctggaggaagtacaagctgaagacagacctgaagaggcaccaggagcgggagaaggccgcccgcatcatccagctggccgtcatcaacttcctggccaagcagaggctgaggaagagggtgaatgctgccctggtgatccagaagtactggaggagagtgctggcccagaggaagctgctgatgctgaagaaggagaagctggagaaggtgcagaacaaggccgccagcctcatccaggccatgtggaggcgctaccgggccaagaagtacctgtgcaaggtgaaggccgcctgcaagatccaggcctggtaccgctgctggagggcccacaaggagtacctggccatcctgaaggctgtgaagatcatccagggctgcttctacaccaagctggagaggacccgcttcctgaatgtgcgggccagcgccatcatcatccagaggaagtggagggccatcctgcctgccaagatcgcccacgagcacttcctgatgatcaagaggcacagagctgcctgcctgatccaggcccactaccggggctacaagggccggcaggtgttcctgcggcagaagtctgctgccctgatcatccagaagtacatccgggcccgggaggccggcaagcatgagcgcatcaagtacatcgagttcaagaagagcaccgtcatcctgcaggccctggtgcggggctggctggtgaggaagcgcttcctggagcagagggccaagatccggctgctgcacttcaccgctgctgcctactaccacctgaatgctgtgcgcatccagagggcctacaagctgtacctggccgtgaagaatgccaacaagcaggtgaacagcgtcatctgcatccagcgctggttccgggcccggctgcaggagaagcgcttcatccagaagtaccacagcatcaagaagattgaacatgagggccaggagtgcctgagccagaggaacagagctgccagcgtcatccagaaggctgtgcgccacttcctgctgaggaagaagcaggagaagttcaccagcggcatcatcaagatccaggccctgtggaggggctacagctggaggaagaagaatgactgcaccaagatcaaggccatccggctgagcctgcaggtggtgaaccgggagatccgggaggagaacaagctgtacaagaggacagccctggccctgcactacctgctgacctacaagcacctgagcgccatcctggaggccctgaagcacctggaggtggtgacccggctgagccccctgtgctgtgagaacatggcccagagcggggccatcagcaagatctttgtgctgatccgcagctgcaacagaagcatcccctgcatggaggtgatccgctatgctgtgcaggtgctgctgaatgtgtccaaatatgagaagaccaccagcgctgtgtatgatgtggagaactgcatcgacatcctgctggagctgctgcagatctaccgggagaagccaggcaacaaggtggccgacaagggcggcagcatcttcaccaagacctgctgcctgctggccatcctgctgaagaccaccaacagagccagtgatgtgcgcagccgcagcaaggtggtggaccgcatctacagcctgtacaagctgacagcccacaagcacaagatgaacacagagcgcatcctgtacaagcagaagaagaacagcagcatcagcatccccttcatccctgagacccctgtgaggacccgcatcgtgtcccggctgaagccagactgggtgctgcggcgggacaacatggaggagatcaccaaccccctgcaggccatccagatggtgatggacaccctgggcatcccctactag

SEQ ID NO: 144138 - DNA, 10434 bp, Artificial Sequence
  Description of Artificial Sequence: Synthetic coding sequence
atggccaacagaagagtgggccggggctgctgggaggtgagccccacagagcggcggcccccagctggcctgcggggccctgctgctgaggaggaggccagcagcccccctgtgctgagcctgagccacttctgccgcagccccttcctgtgctttggagatgtgctgctgggcgccagcaggaccctgagcctggccctggacaaccccaatgaggaggtggccgaggtgaagatcagccacttccctgctgctgacctgggcttctctgtgtcccagcgctgctttgtgctgcagcccaaggagaagatcgtcatctctgtgaactggacccccctgaaggagggccgggtgcgggagatcatgaccttcctggtgaatgatgtgctgaagcaccaggccatcctgctgggcaatgctgaggagcagaagaagaagaagaggagcctgtgggacaccatcaagaagaagaagatcagcgccagcaccagccacaacagaagagtgagcaacatccagaatgtgaacaagaccttctctgtgtcccagaaggtggacagagtgcgcagccccctgcaggcctgtgagaacctggccatgaatgaaggaggccccccaacagagaacaacagcctcatcctggaggagaacaagatccccatcagccccatcagccctgccttcaatgaatgccacggggccacctgcctgcccctgtctgtgcggcgcagcaccacctacagcagcctgcacgccagcgagaaccgggagctgctgaatgtgcacagcgccaacgtgtccaaggtgtccttcaatgagaaggctgtgacagagaccagcttcaacagcgtgaatgtgaatggccagagaggagagaacagcaagctgagcctgacccccaactgcagcagcaccctgaacatcacccagagccagatccacttcctgagcccagacagctttgtgaacaacagccacggggccaacaatgagctggagctggtgacctgcctgagcagtgacatgttcatgaaggacaacagccagcctgtgcacctggagagcaccatcgcccacgagatctaccagaagatcctgagcccagacagcttcatcaaggacaactacggcctgaaccaggacctggagagcgagagcgtgaaccccatcctgagccccaaccagttcctgaaggacaacatggcctacatgtgcaccagccagcagacctgcaaggtgcccctgagcaatgaaaacagccaggtgccccagagccctgaggactggaggaagtctgaggtgagcccccgcatccctgagtgccagggcagcaagagccccaaggccatctttgaggagctggtggagatgaagagcaactactacagcttcatcaagcagaacaaccccaagttctctgctgtgcaggacatcagcagccacagccacaacaagcagcccaagagaagacccatcctgagcgccaccgtgaccaagaggaaggccacctgcacccgggagaaccagacagagatcaacaagcccaaggccaagcgctgcctgaacagcgctgtgggggagcacgagaaggtgatcaacaaccagaaggagaaggaggacttccacagctacctgcccatcatcgaccccatcctgagcaagagcaagagctacaagaatgaggtgacccccagcagcaccacagcctctgtggccaggaagaggaagagtgatggctccatggaggatgccaacgtgcgggtggccatcacagagcacacagaggtgcgggagatcaagaggatccacttcagccccagcgagcccaagaccagcgctgtgaagaagaccaagaatgtgaccacccccatcagcaagaggatcagcaaccgggagaagctgaacctgaagaagaagacagacctgagcatcttccgcacccccatcagcaagaccaacaagaggaccaagcccatcatcgctgtggcccagagcagcctgaccttcatcaagcccctgaagacagacatccccaggcaccccatgccctttgctgccaagaacatgttttatgatgagcgctggaaggagaagcaggagcagggcttcacctggtggctgaacttcatcctgaccccagatgacttcaccgtgaagaccaacatcagcgaggtgaatgctgccaccctgctgctgggcatcgagaaccagcacaagatctctgtgccccgggcccccaccaaggaggagatgagcctgcgggcctacacagcccgctgccgcctgaaccggctgcggcgggccgcctgccgcctcttcaccagcgagaagatggtgaaggccatcaagaagctggagattgaaattgaggcccggcggctgattgtgaggaaggacagacacctgtggaaggatgtgggggagcggcagaaggtgctgaactggctgctgagctacaaccccctgtggctgcgcatcggcctggagaccacctacggggagctgatcagcctggaggacaacagtgatgtgacaggcctggccatgttcatcctgaaccggctgctgtggaacccagacattgctgctgagtaccgccaccccaccgtgccccacctgtacagagatggccacgaggaggccctgagcaagttcaccctgaagaagctgctgctgctggtgtgcttcctggactatgccaagatcagccggctgattgaccatgacccctgcctcttctgcaaggatgctgagttcaaggccagcaaggagatcctgctggccttcagccgggacttcctgtctggagagggggacctgagccgccacctgggcctgctgggcctgcctgtgaaccacgtgcagaccccatttgatgaatttgattttgctgtgaccaacctggccgtggacctgcagtgtggggtgcggctggtgaggaccatggagctgctgacccagaactgggacctgagcaagaagctgcgcatcccagccatcagccggctgcagaagatgcacaacgtggacatcgtgctgcaggtgctgaagagccggggcatcgagctgagtgatgaacatggcaacaccatcctgagcaaggacatcgtggacagacaccgggagaagaccctgcggctgctgtggaagatcgcctttgccttccaggtggacatcagcctgaacctggaccagctgaaggaggagatcgccttcctgaagcacaccaagagcatcaagaagaccatcagcctgctgagctgccacagtgatgacctgatcaacaagaagaagggcaagagggacagcggcagctttgagcagtacagcgagaacatcaagctgctgatggactgggtgaatgctgtgtgtgccttctacaacaagaaggtggagaacttcaccgtgtccttcagtgatggccgggtgctgtgctacctgatccaccactaccacccctgctacgtgccctttgatgccatctgccagaggaccacccagacagtggagtgcacccagacaggctctgtggtgctgaacagcagcagcgagagtgatgacagcagcctggacatgagcctgaaggcctttgaccacgagaacaccagcgagctgtacaaggagctgctggagaatgagaagaagaacttccacctggtgcgctctgctgtgcgggacctgggcggcatcccagccatgatcaaccacagcgacatgagcaacaccatcccagatgagaaggtggtgatcacctacctgtccttcctgtgtgcccggctgctggacctgaggaaggagatccgggccgcccggctcatccagaccacctggaggaagtacaagctgaagacagacctgaagaggcaccaggagcgggagaaggccgcccgcatcatccagctggccgtcatcaacttcctggccaagcagaggctgaggaagagggtgaatgctgccctggtgatccagaagtactggaggagagtgctggcccagaggaagctgctgatgctgaagaaggagaagctggagaaggtgcagaacaaggccgccagcctcatccagggctactggaggcgctacagcacccggcagcgcttcctgaagctgaagtactacagcatcatcctgcagagccgcatccgcatgatcatcgctgtgaccagctacaagcgctacctgtgggccaccgtgaccatccagaggcactggagggcctacctgcggaggaagcaggaccagcagagatatgagatgctgaagagcagcaccctcatcatccagagcatgttcaggaagtggaagcagaggaagatgcagagccaggtgaaggccaccgtcatcctgcagagggccttccgggagtggcacctgaggaagcaggccaaggaggagaacagcgccatcatcatccagagctggtacaggatgcacaaggagctgaggaagtacatctacatccgcagctgtgtggtgatcatccagaagcgcttccgctgcttccaggcccagaagctgtacaagaggaggaaggagagcatcctgaccatccagaagtactacaaggcctacctgaagggcaagattgaaagaaccaactacctgcagaagagagctgctgccatccagctgcaggccgccttccggcggctgaaggcccacaacctgtgccggcagatccgggccgcctgcgtcatccagagctactggaggatgaggcaggacagagtgcgcttcctgaacctgaagaagaccatcatcaagttccaggcccacgtgaggaagcaccagcagaggcagaagtacaagaagatgaagaaggctgctgtgatcatccagacccacttccgggcctacatctttgccatgaaggtgctggccagctaccagaagaccaggtctgctgtgattgtgctgcagagcgcctaccggggcatgcaggccaggaagatgtacatccacatcctgaccagcgtcatcaagatccagagctactaccgggcctacgtgtccaagaaggagttcctgagcctgaagaatgccaccatcaagctgcagagcacagtgaagatgaagcagaccaggaagcagtacctgcacctgcgggccgccgccctcttcatccagcagtgctaccgcagcaagaagattgctgcccagaagcgggaggagtacatgcagatgagggagagctgcatcaagctgcaggcctttgtgcggggctacctggtgaggaagcagatgaggctgcagaggaaggccgtcatcagcctgcagagctacttcaggatgaggaaggcccggcagtactacctgaagatgtacaaggccatcatcgtcatccagaactactaccacgcctacaaggcccaggtgaaccagaggaagaacttcctgcaggtgaagaaggccgccacctgcctgcaggccgcctaccggggctacaaggtgcggcagctgatcaagcagcagagcattgctgccctgaagatccagagcgccttccggggctacaacaagagggtgaagtaccagagcgtgctgcagagcatcatcaagatccagcgctggtaccgggcctacaagaccctgcatgacaccaggacccacttcctgaagaccaaggctgctgtgatcagcctgcagagcgcctaccggggctggaaggtgaggaagcagatcagaagagagcaccaggccgccctgaagatccagagcgccttcaggatggccaaggcccagaagcagttccgcctcttcaagacagctgccctggtgatccagcagaacttccgggcctggacagctggcaggaagcagtgcatggagtacatcgagctgcggcatgctgtgctggtgctgcagagcatgtggaagggcaagaccctgcggcggcagctgcagaggcagcacaagtgtgccatcatcatccagagctactacaggatgcacgtgcagcagaagaagtggaagatcatgaagaaggccgccctgctgatccagaagtactaccgggcctacagcatcggccgggagcagaaccacctgtacctgaagaccaaggctgctgtggtgaccctgcagagcgcctaccggggcatgaaggtgaggaagaggatcaaggactgcaacaaggctgctgtgaccatccagagcaagtaccgggcctacaagaccaagaagaagtatgccacctaccgggccagcgccatcatcatccagcgctggtaccggggcatcaagatcaccaaccaccagcacaaggagtacctgaacctgaagaagacagccatcaagatccagagcgtgtaccggggcatccgggtgcggcggcacatccagcacatgcacagagctgccaccttcatcaaggccatgttcaagatgcaccagagccgcatctcctaccacaccatgaggaaggccgccatcgtcatccaggtgcgctgccgggcctactaccagggcaagatgcagcgggagaagtacctgaccatcctgaaggctgtgaaggtgctgcaggccagcttccggggcgtgcgggtgcggaggaccctgaggaagatgcagacagctgccaccctcatccagagcaactaccgccgctaccggcagcagacctacttcaacaagctgaagaagatcaccaagacagtgcagcagcgctactgggccatgaaggagaggaacatccagttccagcgctacaacaagctgcggcacagcgtcatctacatccaggccatcttccggggcaagaaggcccggcggcacctgaagatgatgcacatcgccgccaccctcatccagaggcgcttccgcaccctgatgatgagaagacgcttcctgagcctgaagaagacagccatcctgatccagaggaagtaccgggcccacctgtgcaccaagcaccacctgcagttcctgcaggtgcagaatgctgtgatcaagatccagagcagctaccgccgctggatgatcaggaagaggatgagggagatgcacagagctgccaccttcatccagagcaccttcaggatgcaccggctgcacatgagataccaggccctgaagcaggcctctgtggtgatccagcagcagtaccaggccaacagagctgccaagctgcagaggcagcactacctgcggcagaggcacagcgctgtgatcctgcaggccgccttccggggcatgaagaccaggaggcacctgaagtccatgcacagcagcgccaccctcatccagagccgcttccgcagcctgctggtgagaagacgcttcatcagcctgaagaaggccaccatctttgtgcagaggaagtaccgggccaccatctgtgccaagcacaagctgtaccagttcctgcacctgaggaaggccgccatcaccatccagagcagctacagaaggctgatggtgaagaagaagctgcaggagatgcagagagctgctgtgctgatccaggccaccttcaggatgtaccgcacctacatcaccttccagacctggaagcacgccagcatcctgatccagcagcactaccgcacctacagagctgccaagctgcagcgggagaactacatccggcagtggcacagcgctgtggtgatccaggccgcctacaagggcatgaaggcccggcagctgctgcgggagaagcacaaggccagcatcgtcatccagagcacctacaggatgtaccggcagtactgcttctaccagaagctgcagtgggccaccaagatcatccaggagaagtaccgggccaacaagaagaagcagaaggtgttccagcacaatgagctgaagaaggagacctgtgtgcaggccggcttccaggacatgaacatcaagaagcagatccaggagcagcaccaggccgccatcatcatccagaagcactgcaaggccttcaagatcaggaagcactacctgcacctgcgggccaccgtggtgtccatccagaggcgctacaggaagctgacagctgtgaggacccaggccgtcatctgcatccagagctactaccggggcttcaaggtgaggaaggacatccagaacatgcacagagctgccaccctcatccagagcttctacaggatgcaccgggccaaggtggactatgagaccaagaagacagccatcgtggtgatccagaactactaccgcctgtatgtgcgggtgaagacagagaggaagaacttcctggccgtgcagaagtctgtgaggaccatccaggccgccttccggggcatgaaggtgcggcagaagctgaagaatgtgtctgaggagaagatggccgccatcgtgaaccagagcgccctgtgctgctaccgcagcaagacccagtatgaggccgtgcagagcgagggcgtgatgatccaggagtggtacaaggccagcggcctggcctgcagccaggaggccgagtaccacagccagagcagagctgctgtgaccatccagaaggccttctgcaggatggtgaccaggaagctggagacccagaagtgtgccgccctgcgcatccagttcttcctgcagatggctgtgtacagaagaagatttgtgcagcagaagagagctgccatcaccctgcagcactacttccgcacctggcagaccaggaagcagttcctgctgtacaggaaggctgctgtggtgctgcagaaccactaccgggccttcctgagcgccaagcaccagaggcaggtgtacctgcagatccgcagcagcgtcatcatcatccaggcccggagcaagggcttcatccagaagaggaagttccaggagatcaagaacagcaccatcaagatccaggccatgtggaggcgctaccgggccaagaagtacctgtgcaaggtgaaggccgcctgcaagatccaggcctggtaccgctgctggagggcccacaaggagtacctggccatcctgaaggctgtgaagatcatccagggctgcttctacaccaagctggagaggacccgcttcctgaatgtgcgggccagcgccatcatcatccagaggaagtggagggccatcctgcctgccaagatcgcccacgagcacttcctgatgatcaagaggcaccgggccgcctgcctgatccaggcccactaccggggctacaagggccggcaggtgttcctgcggcagaagtctgctgccctgatcatccagaagtacatccgggcccgggaggccggcaagcatgagcgcatcaagtacatcgagttcaagaagagcaccgtcatcctgcaggccctggtgcggggctggctggtgaggaagcgcttcctggagcagagggccaagatccggctgctgcacttcaccgctgctgcctactaccacctgaatgctgtgcgcatccagagggcctacaagctgtacctggccgtgaagaatgccaacaagcaggtgaacagcgtcatctgcatccagcgctggttccgggcccggctgcaggagaagcgcttcatccagaagtaccacagcatcaagaagattgagcacgagggccaggagtgcctgagccagaggaacagagctgccagcgtcatccagaaggctgtgcgccacttcctgctgaggaagaagcaggagaagttcaccagcggcatcatcaagatccaggccctgtggaggggctacagctggaggaagaagaatgactgcaccaagatcaaggccatccggctgagcctgcaggtggtgaaccgggagatccgggaggagaacaagctgtacaagaggacagccctggccctgcactacctgctgacctacaagcacctgagcgccatcctggaggccctgaagcacctggaggtggtgacccggctgagccccctgtgctgtgagaacatggcccagagcggggccatcagcaagatctttgtgctgatccgcagctgcaacagaagcatcccctgcatggaggtgatccgctatgctgtgcaggtgctgctgaatgtgtccaaatatgagaagaccaccagcgctgtgtatgatgtggagaactgcatcgacatcctgctggagctgctgcagatctaccgggagaagccaggcaacaaggtggccgacaagggcggcagcatcttcaccaagacctgctgcctgctggccatcctgctgaagaccaccaacagagccagtgatgtgcgcagccgcagcaaggtggtggaccgcatctacagcctgtacaagctgacagcccacaagcacaagatgaacacagagcgcatcctgtacaagcagaagaagaacagcagcatcagcatccccttcatccctgagacccctgtgaggaccagaattgtgtcccggctgaagccagactgggtgctgcggcgggacaacatggaggagatcaccaaccccctgcaggccatccagatggtgatggacaccctgggcatcccctactag

SEQ ID NO: 144139 - DNA, 1686 bp, Artificial Sequence
  Description of Artificial Sequence: Synthetic coding sequence
atgtgtggcatctgggccctgtttggaagtgatgactgcctgtctgtgcagtgcctgagcgccatgaagatcgcccaccggggcccagatgccttccgctttgaaaatgtgaatggctacaccaactgctgcttcggcttccaccggctggccgtggtggaccccctgtttggcatgcagcccatccgggtgaagaagtacccctacctgtggctgtgctacaatggagagatctacaaccacaagaagatgcagcagcactttgaatttgagtaccagaccaaggtggatggagagatcatcctgcacctgtatgacaagggcggcatcgagcagaccatctgcatgctggatggagtgtttgcctttgtgctgctggacacagccaacaagaaggtgttcctgggccgggacacctacggcgtgcggcccctcttcaaggccatgacagaagatggcttcctggccgtgtgcagcgaggccaagggcctggtgaccctgaagcacagcgccacccccttcctgaaggtggagcccttcctgcccggccactatgaggtgctggacctgaagcccaacgggaaggtggcctctgtggagatggtgaagtaccaccactgcagagatgtgcccctgcacgccctgtatgacaacgtggagaagctgtttcctggctttgaaattgagaccgtgaagaacaacctgcgcatcctcttcaacaatgctgtgaagaagaggctgatgacagacagaagaattggctgcctgctgagcggcggcctggacagcagcctggtggccgccaccctgctgaagcagctgaaggaggcccaggtgcagtaccccctgcagacctttgccatcggcatggaggacagcccagacctgctggccgccaggaaggtggccgaccacatcggcagcgagcactatgaggtgctcttcaacagcgaggagggcatccaggccctggatgaagtcatcttcagcctggagacctatgacatcaccaccgtgcgggcctctgtgggcatgtacctgatcagcaagtacatcaggaagaacacagacagcgtggtgatcttctctggagagggcagtgatgagctgacccagggctacatctacttccacaaggcccccagccctgagaaggccgaggaggagagcgagcggctgctgcgggagctgtacctgtttgatgtgctgcgggctgacaggaccacagctgcccacggcctggagctgcgggtgcccttcctggaccaccgcttcagcagctactacctgagcctgcccccagagatgaggatccccaagaatggaattgagaagcacctgctgcgggagacctttgaggacagcaacctgatccccaaggagatcctgtggaggcccaaggaggccttcagtgatggcatcacctctgtgaagaacagctggttcaagatcctgcaggagtatgtggagcaccaggtggatgatgccatgatggccaatgctgcccagaagttccccttcaacacccccaagaccaaggagggctactactaccggcaggtgtttgagcggcactacccaggccgggctgactggctgagccactactggatgcccaagtggatcaatgccacagaccccagcgcccggaccctgacccactacaagtctgctgtgaaggcctag

SEQ ID NO: 144140 - DNA, 1686 bp, Artificial Sequence; identical to SEQ ID NO: 144139
  Description of Artificial Sequence: Synthetic coding sequence

SEQ ID NO: 144141 - DNA, 1686 bp, Artificial Sequence; identical to SEQ ID NO: 144139
  Description of Artificial Sequence: Synthetic coding sequence

SEQ ID NO: 144142 - DNA, 87 bp, Artificial Sequence
  Description of Artificial Sequence: Synthetic coding sequence
atgtgtggcatctgggccctgtttggaagtgatgactgcctgtctgtgcagtgcctgagcgccatgaagatcgcccaccggggctag

SEQ ID NO: 144143 - DNA, 489 bp, Artificial Sequence
  Description of Artificial Sequence: Synthetic coding sequence
atgtgtggcatctgggccctgtttggaagtgatgactgcctgtctgtgcagtgcctgagcgccatgaagatcgcccaccggggcccagatgccttccgctttgaaaatgtgaatggctacaccaactgctgcttcggcttccaccggctggccgtggtggaccccctgtttggcatgcagcccatccgggtgaagaagtacccctacctgtggctgtgctacaatggagagatctacaaccacaagaagatgcagcagcactttgaatttgagtaccagaccaaggtggatggagagatcatcctgcacctgtatgacaagggcggcatcgagcagaccatctgcatgctggatggagtgtttgcctttgtgctgctggacacagccaacaagaaggtgttcctgggccgggacacctacggcgtgcggcccctcttcaaggccatgacagaagatggcttcctggccgtgtgcagcgaggccaagtag

SEQ ID NO: 144144 - DNA, 648 bp, Artificial Sequence
  Description of Artificial Sequence: Synthetic coding sequence
atgtgtggcatctgggccctgtttggaagtgatgactgcctgtctgtgcagtgcctgagcgccatgaagatcgcccaccggggcccagatgccttccgctttgaaaatgtgaatggctacaccaactgctgcttcggcttccaccggctggccgtggtggaccccctgtttggcatgcagcccatccgggtgaagaagtacccctacctgtggctgtgctacaatggagagatctacaaccacaagaagatgcagcagcactttgaatttgagtaccagaccaaggtggatggagagatcatcctgcacctgtatgacaagggcggcatcgagcagaccatctgcatgctggatggagtgtttgcctttgtgctgctggacacagccaacaagaaggtgttcctgggccgggacacctacggcgtgcggcccctcttcaaggccatgacagaagatggcttcctggccgtgtgcagcgaggccaagggcctggtgaccctgaagcacagcgccacccccttcctgaaggtggagcccttcctgcccggccactatgaggtgctggacctgaagcccaacgggaaggtggcctctgtggagatggtgaagtaccaccactgcagagatgtgcccctgcacgccctgtag

SEQ ID NO: 144145 - DNA, 360 bp, Artificial Sequence
  Description of Artificial Sequence: Synthetic coding sequence
atgtgtggcatctgggccctgtttggaagtgatgactgcctgtctgtgcagtgcctgagcgccatgaagatcgcccaccggggcccagatgccttccgctttgaaaatgtgaatggctacaccaactgctgcttcggcttccaccggctggccgtggtggaccccctgtttggcatgcagcccatccgggtgaagaagtacccctacctgtggctgtgctacaatggagagatctacaaccacaagaagatgcagcagcactttgaatttgagtaccagaccaaggtggatggagagatcatcctgcacctgtatgacaagggcggcatcgagcagaccatctgcatgctggatggatag

SEQ ID NO: 144146 - DNA, 102 bp, Artificial Sequence
  Description of Artificial Sequence: Synthetic coding sequence
atgtgtggcatctgggccctgtttggaagtgatgactgcctgtctgtgcagtgcctgagcgccatgaagatcgcccaccggggcccagatgccttcagatag

SEQ ID NO: 144147 - DNA, 192 bp, Artificial Sequence
  Description of Artificial Sequence: Synthetic coding sequence
atgaagatcgcccaccggggcccagatgccttccgctttgaaaatgtgaatggctacaccaactgctgcttcggcttccaccggctggccgtggtggaccccctgtttggcatgcagcccatccgggtgaagaagtacccctacctgtggctgtgctacaacggggagatctacaaccacaagaaggtgtag

SEQ ID NO: 144148 - DNA, 1437 bp, Artificial Sequence
  Description of Artificial Sequence: Synthetic coding sequence
atgcagcagcactttgaatttgagtaccagaccaaggtggatggagagatcatcctgcacctgtatgacaagggcggcatcgagcagaccatctgcatgctggatggagtgtttgcctttgtgctgctggacacagccaacaagaaggtgttcctgggccgggacacctatggagtgcggcccctcttcaaggccatgacagaagatggcttcctggccgtgtgcagcgaggccaagggcctggtgaccctgaagcacagcgccacccccttcctgaaggtggagcccttcctgcccggccactatgaggtgctggacctgaagcccaacgggaaggtggcctctgtggagatggtgaagtaccaccactgcagagatgtgcccctgcacgccctgtatgacaacgtggagaagctgtttcctggctttgaaattgaaacagtgaagaacaacctgcgcatcctcttcaacaatgctgtgaagaagaggctgatgacagaccggcgcatcggctgcctgctgagcggcggcctggacagcagcctggtggccgccaccctgctgaagcagctgaaggaggcccaggtgcagtaccccctgcagacctttgccatcggcatggaggacagcccagacctgctggccgccaggaaggtggccgaccacatcggcagcgagcactatgaggtgctcttcaacagcgaggagggcatccaggccctggatgaggtgatcttcagcctggagacctatgacatcaccaccgtgcgggcctctgtgggcatgtacctgatcagcaagtacatcaggaagaacacagattctgtggtgatcttcagcggggagggcagtgatgagctgacccagggctacatctacttccacaaggcccccagccctgagaaggccgaggaggagagcgagcggctgctgcgggagctgtacctgtttgatgtgctgcgggctgacaggaccacagctgcccacggcctggagctgcgggtgcccttcctggaccaccgcttcagcagctactacctgagcctgcccccagagatgaggatccccaagaatggcatcgagaagcacctgctgcgggagacctttgaggacagcaacctgatccccaaggagatcctgtggaggcccaaggaggccttcagtgatggcatcacctctgtgaagaacagctggttcaagatcctgcaggagtatgtggagcaccaggtggatgatgccatgatggccaatgctgcccagaagttccccttcaacacccccaagaccaaggagggctactactaccggcaggtgtttgagcggcactacccaggccgggctgactggctgagccactactggatgcccaagtggatcaatgccacagaccccagcgcccggaccctgacccactacaagtctgctgtgaaggcctag

SEQ ID NO: 144149 - DNA, 1623 bp, Artificial Sequence
  Description of Artificial Sequence: Synthetic coding sequence
atgaagatcgcccaccggggcccagatgccttccgctttgaaaatgtgaatggctacaccaactgctgcttcggcttccaccggctggccgtggtggaccccctgtttggcatgcagcccatccgggtgaagaagtacccctacctgtggctgtgctacaacggggagatctacaaccacaagaagatgcagcagcactttgaatttgagtaccagaccaaggtggatggagagatcatcctgcacctgtatgacaagggcggcatcgagcagaccatctgcatgctggatggagtgtttgcctttgtgctgctggacacagccaacaagaaggtgttcctgggccgggacacctatggagtgcggcccctcttcaaggccatgacagaagatggcttcctggccgtgtgcagcgaggccaagggcctggtgaccctgaagcacagcgccacccccttcctgaaggtggagcccttcctgcccggccactatgaggtgctggacctgaagcccaacgggaaggtggcctctgtggagatggtgaagtaccaccactgcagagatgtgcccctgcacgccctgtatgacaacgtggagaagctgtttcctggctttgaaattgaaacagtgaagaacaacctgcgcatcctcttcaacaatgctgtgaagaagaggctgatgacagaccggcgcatcggctgcctgctgagcggcggcctggacagcagcctggtggccgccaccctgctgaagcagctgaaggaggcccaggtgcagtaccccctgcagacctttgccatcggcatggaggacagcccagacctgctggccgccaggaaggtggccgaccacatcggcagcgagcactatgaggtgctcttcaacagcgaggagggcatccaggccctggatgaggtgatcttcagcctggagacctatgacatcaccaccgtgcgggcctctgtgggcatgtacctgatcagcaagtacatcaggaagaacacagattctgtggtgatcttcagcggggagggcagtgatgagctgacccagggctacatctacttccacaaggcccccagccctgagaaggccgaggaggagagcgagcggctgctgcgggagctgtacctgtttgatgtgctgcgggctgacaggaccacagctgcccacggcctggagctgcgggtgcccttcctggaccaccgcttcagcagctactacctgagcctgcccccagagatgaggatccccaagaatggcatcgagaagcacctgctgcgggagacctttgaggacagcaacctgatccccaaggagatcctgtggaggcccaaggaggccttcagtgatggcatcacctctgtgaagaacagctggttcaagatcctgcaggagtatgtggagcaccaggtggatgatgccatgatggccaatgctgcccagaagttccccttcaacacccccaagaccaaggagggctactactaccggcaggtgtttgagcggcactacccaggccgggctgactggctgagccactactggatgcccaagtggatcaatgccacagaccccagcgcccggaccctgacccactacaagtctgctgtgaaggcctag

SEQ ID NO: 144150 - DNA, 1437 bp, Artificial Sequence; identical to SEQ ID NO: 144148
  Description of Artificial Sequence: Synthetic coding sequence

SEQ ID NO: 144151 - DNA, 1395 bp, Artificial Sequence
  Description of Artificial Sequence: Synthetic coding sequence
atggccgccagctgcctggtgctgctggccctgtgcctgctgctgcccctgctgctgctgggcggctggaagcgctggaggcggggccgggccgcccggcacgtggtggccgtggtgctgggagatgtgggccgcagccccaggatgcagtaccacgccctgagcctggccatgcacggcttctctgtgaccctgctgggcttctgcaacagcaagccccatgatgagctgctgcagaacaaccgcatccagatcgtgggcctgacagagctgcagagcctggccgtgggccccagggtcttccagtatggagtgaaggtggtgctgcaggccatgtacctgctgtggaagctgatgtggagggagcccggggcctacatcttcctgcagaaccccccaggcctgcccagcattgctgtgtgctggtttgtgggctgcctgtgtggcagcaagctggtgattgactggcacaactacggctacagcatcatgggcctggtgcacggccccaaccaccccctggtgctgctggccaagtggtatgagaagttcttcggccgcctgagccacctgaacctgtgtgtgaccaatgccatgagggaggacctggccgacaactggcacatccgggctgtgacagtgtatgacaagccagccagcttcttcaaggagacccccctggacctgcagcacaggctcttcatgaagctgggctccatgcacagccccttccgggcccggtctgagccagaagatcctgtgacagagaggtctgccttcacagaaagagatgctggcagcggcctggtgacccggctgcgggagaggcctgccctgctggtgagcagcacctcctggacagaagatgaggacttcagcatcctgctggccgccctggagaagtttgagcagctgaccctggatggccacaacctgcccagcctggtgtgtgtgatcaccgggaagggccccctgcgggagtactacagccgcctcatccaccagaagcacttccagcacatccaggtgtgcaccccctggctggaggccgaggactaccccctgctgctgggcagcgctgacctgggcgtgtgcctgcacaccagcagcagcggcctggacctgcccatgaaggtggtggacatgtttggctgctgcctgcctgtgtgtgctgtgaacttcaagtgcctgcacgagctggtgaagcatgaagaaaatggcctggtgtttgaagattctgaggagctggccgcccagctgcagatgctgttcagcaacttcccagaccctgctgggaagctgaaccagttcaggaagaacctgcgggagagccagcagctgcgctgggatgagagctgggtgcagacagtgctgcccctggtgatggacacctag

SEQ ID NO: 144152 - DNA, 1062 bp, Artificial Sequence
  Description of Artificial Sequence: Synthetic coding sequence
atgtacctgctgtggaagctgatgtggagggagcccggggcctacatcttcctgcagaaccccccaggcctgcccagcattgctgtgtgctggtttgtgggctgcctgtgtggcagcaagctggtgattgactggcacaactacggctacagcatcatgggcctggtgcacggccccaaccaccccctggtgctgctggccaagtggtatgagaagttcttcggccgcctgagccacctgaacctgtgtgtgaccaatgccatgagggaggacctggccgacaactggcacatccgggctgtgacagtgtatgacaagccagccagcttcttcaaggagacccccctggacctgcagcacaggctcttcatgaagctgggctccatgcacagccccttccgggcccggtctgagcctgaggaccctgtgacagagaggtctgccttcacagaaagagatgctggcagcggcctggtgacccggctgcgggagaggcctgccctgctggtgagcagcacctcctggacagaagatgaggacttcagcatcctgctggccgccctggagaagtttgagcagctgaccctggatggccacaacctgcccagcctggtgtgtgtgatcaccgggaagggccccctgcgggagtactacagccgcctcatccaccagaagcacttccagcacatccaggtgtgcaccccctggctggaggccgaggactaccccctgctgctgggcagcgctgacctgggcgtgtgcctgcacaccagcagcagcggcctggacctgcccatgaaggtggtggacatgtttggctgctgcctgcctgtgtgtgctgtgaacttcaagtgcctgcacgagctggtgaagcatgaggagaatggcctggtgtttgaggacagcgaggagctggccgcccagctgcagatgctgttcagcaacttcccagaccctgctgggaagctgaaccagttcaggaagaacctgcgggagagccagcagctgcgctgggatgagagctgggtgcagacagtgctgcccctggtgatggacacctag

SEQ ID NO: 144153 - DNA, 1422 bp, Artificial Sequence
  Description of Artificial Sequence: Synthetic coding sequence
atggcccagctggagggctactacttctctgctgccctgagctgcaccttcctggtgtcctgcctgctcttcagcgccttcagccgggccctgcgggagccctacatggatgagatcttccacctgccccaggcccagcgctactgtgagggccacttcagcctgagccagtgggaccccatgatcaccaccctgcccggcctgtacctggtgtccattggagtcatcaagccagccatctggatcttcggctggagcgagcacgtggtgtgcagcatcggcatgctgcgctttgtgaacctgctcttctctgtgggcaacttctacctgctgtacctgctcttctgcaaggtgcagcccaggaacaaggccgccagcagcatccagagggtgctgagcaccctgaccctggccgtgttccccaccctgtacttcttcaacttcctgtactacacagaggccggctccatgttcttcaccctgtttgcctacctgatgtgcctgtatggcaaccacaagaccagcgccttcctgggcttctgtggcttcatgttccggcagaccaacatcatctgggccgtgttctgtgctggaaatgtgattgcccagaagctgacagaggcctggaagacagagctgcagaagaaggaggaccggctgccccccatcaagggcccctttgctgagttcaggaagatcctgcagttcctgctggcctacagcatgtccttcaagaacctgtccatgctgctgctgctgacctggccctacatcctgctgggcttcctgttctgtgcctttgtggtggtgaatggaggcatcgtcatcggggacaggagcagccatgaggcctgcctgcacttcccccagctgttctacttcttctccttcaccctcttcttctccttcccccacctgctgagccccagcaagatcaagaccttcctgagcctggtgtggaagaggcgcatcctcttctttgtggtgaccctggtgtctgtgttcctggtgtggaagttcacctacgcccacaagtacctgctggccgacaacagacactacaccttctacgtgtggaagagggtcttccagagatatgagaccgtgaagtacctgctggtgcctgcctacatctttgctggctggagcattgctgacagcctgaagagcaagagcatcttctggaacctgatgttcttcatctgcctcttcaccgtgattgtgccccagaagctgctggagttccgctacttcatcctgccctacgtgatctaccgcctgaacatccccctgccccccaccagccgcctcatctgtgagctgagctgctatgctgtggtgaacttcatcaccttcttcatcttcctgaacaagaccttccagtggcccaacagccaggacatccagcgcttcatgtggtag

SEQ ID NO: 144154 - DNA, 1479 bp, Artificial Sequence
  Description of Artificial Sequence: Synthetic coding sequence
atggctgctggggagaggtcctggtgcctgtgcaagctgctgcgcttcttctacagcctcttcttccctggcctcatcgtgtgtggcaccctgtgtgtgtgcctggtgattgtgctgtggggcatccggctgctgctgcagaggaagaagaagctggtgtccaccagcaagaatggcaagaaccagatggtgattgccttcttccacccctactgcaatgctgggggcggcggggagcgggtgctgtggtgtgccctgcgggccctgcagaagaagtacccagaggccgtgtatgtggtgtacacaggagatgtgaatgtgaatggccagcagatcctggagggcgccttccgccgcttcaacatccgcctcatccaccctgtgcagtttgtgttcctgaggaagcgctacctggtggaggacagcctgtacccccacttcaccctgctgggccagagcctgggcagcatcttcctgggctgggaggccctgatgcagtgtgtgcctgatgtgtacatcgacagcatgggctacgccttcaccctgcccctcttcaagtacatcggcggctgccaggtgggcagctatgtgcactaccccaccatcagcacagacatgctgtctgtggtgaagaaccagaacatcggcttcaacaatgctgccttcatcaccaggaaccccttcctgagcaaggtgaagctgatctactactacctgtttgccttcatctacggcctggtgggcagctgcagtgatgtggtgatggtgaacagctcctggaccctgaaccacatcctgagcctgtggaaggtgggcaactgcaccaacatcgtgtacccaccctgtgatgtgcagaccttcctggacatccccctgcacgagaagaagatgaccccaggccacctgctggtgtctgtgggccagttccggcctgagaagaaccaccccctgcagatccgggcctttgccaagctgctgaacaagaagatggtggagagcccccccagcctgaagctggtgctgattggaggctgcaggaacaaggatgatgagctgcgggtgaaccagctgcggcggctgtctgaggacctgggcgtgcaggagtatgtggagttcaagatcaacatcccctttgatgagctgaagaactacctgtctgaggccaccatcggcctgcacaccatgtggaatgagcacttcggcatcggcgtggtggagtgcatggccgccggcaccatcatcctggcccacaacagcggcggccccaagctggacatcgtggtgccccatgaaggagacatcaccggcttcctggccgagagtgaagaagattatgcagagaccatcgcccacatcctgtccatgtctgctgagaagaggctgcagatcaggaagagcgcccgggcctctgtgagccgcttcagtgaccaggagtttgaggtgaccttcctgagctctgtggagaagctgttcaagtag

SEQ ID NO: 144155 - DNA, 111 bp, Artificial Sequence
  Description of Artificial Sequence: Synthetic coding sequence
atggctgctggggagaggtcctggtgcctgtgcaagctgctgcggagctgtggggtgtatggctcctggcacaactacccctgcacccagtttggaggccccaaggcctag

SEQ ID NO: 144156 - DNA, 1467 bp, Artificial Sequence
  Description of Artificial Sequence: Synthetic coding sequence
atggccggcaagggcagcagtggaagaagacccctgctgctgggcctgctggtggccgtggccaccgtgcacctggtgatctgcccctacaccaaggtggaggagagcttcaacctgcaggccacccatgacctgctgtaccactggcaggacctggagcagtatgaccacctggagttccctggggtggtgcccaggaccttcctgggccctgtggtgattgctgtgttcagcagccctgctgtgtatgtgctgagcctgctggagatgagcaagttctacagccagctgattgtgcggggcgtgctgggcctgggcgtcatcttcggcctgtggaccctgcagaaggaggtgagaagacactttggagccatggtggccaccatgttctgctgggtgacagccatgcagttccacctgatgttctactgcaccaggaccctgcccaacgtgctggccctgcctgtggtgctgctggccctggccgcctggctgcggcatgagtgggcccgcttcatctggctgagcgcctttgccatcatcgtgttccgggtggagctgtgcctcttcctgggcctgctgctgctgctggccctgggcaacaggaaggtgtctgtggtgcgggccctgcggcatgctgtgcctgctggcatcctgtgcctgggcctgactgtggccgtggacagctacttctggaggcagctgacctggccagagggcaaggtgctgtggtacaacacagtgctgaacaagagcagcaactggggcaccagccccctgctgtggtacttctacagcgccctgccccggggcctgggctgcagcctgctcttcatccccctgggcctggtggacaggaggacccacgcccccaccgtgctggccctgggcttcatggccctgtacagcctgctgccccacaaggagctgcgcttcatcatctatgccttccccatgctgaacatcacagctgcccggggctgcagctacctgctgaacaactacaagaagtcctggctgtacaaggccggcagcctgctggtgattggccacctggtggtgaatgctgcctacagcgccacagccctgtatgtgagccacttcaactacccaggaggagtggccatgcagaggctgcaccagctggtgcccccccagacagatgtgctgctgcacattgatgtggccgccgcccagacaggagtgagccgcttcctgcaggtgaacagcgcctggaggtatgacaagcgggaggatgtgcagcccggcaccggcatgctggcctacacccacatcctgatggaggccgcccctggcctgctggccctgtacagagacacccaccgggtgctggcctctgtggtgggcaccaccggggtgtccctgaacctgacccagctgccccccttcaacgtgcacctgcagaccaagctggtgctgctggagcggctgccccggcccagctag

SEQ ID NO: 144157 - DNA, 987 bp, Artificial Sequence
  Description of Artificial Sequence: Synthetic coding sequence
atgccacccacccagccccggccctgcatgtgccccatcagcaccacccaggtggccagccagtgccggggctgcacctcctggtgccccccccggcagaccagcttctgcaccctgacctggcagcccccccggcaggtgtgcctgggcttcagcaagagcacagcccctgggggcaccacccggggccgcatgtgcagccggggccaggcctgctggcacacccacaccagctcctggaggcggccctgggcccctggccccctgcagggccacaccccaggccctggccagaggagaggagaccaccgctgtgagagcgagccagaccccacagcccccctgcagaggcccccagctgacaaggccggggccagcggggaggcccccccagctgtgctgcggggcacccggcagcccagcgctgccaccggcctgcctggagctgtgatcaccaccagcttctggcacaacagcagcaccatcatgaccatccagaggagcaagagcaaggactgggccccagccagtgacagacaccagaccaggagccgggccagcagcacagccagcgctggggccctgagcaccaaggagcggggggcccaggtgctgctggccccccgggagcccctgccccgggtgatggtggccagcagcggcctgcctgctggggactgcaggccagaccaggtgcccttcatgaccaaccaggagcagagggcccaccctggcacctgcctgcccggcggccacgtgtgcccagcccaccctgggggcgctgtgttctggcagcaccccaccctggccgcccggggccccctgggcgcccccaagacagccccacccctgcggggggaccacggcggccctggccgcaccccaccaccctggtgccaccactgcaacttctgcatccaccgccaccccatcagcatcacagacaagatcctgggggacaagcacatccagaagggcatgaggtag

SEQ ID NO: 144158 - DNA, 2865 bp, Artificial Sequence
  Description of Artificial Sequence: Synthetic coding sequence
atgaacaaccaccagctggagctggccaagcagctgcacaaggagggccacctgttctactgcacctgccgggtgctgacctgccccggccaggccaagagcatcgccagcgcccctgggaagtgccaggacagcgctgccctgaccagcacagccttcagcggcctggactttggcctgctgagcggctacctgcacaagcaggccctggtgacagccacccaccccacctgcaccctgctcttccccagctgccacgccttcttccccctgcccctgacccccaccctgtacaagatgcacaagggctggaagaactactgcagccagaagagcctgaatgaggcctccatggatgagtacctgggcagcctgggcctcttcaggaagctgacagccaaggatgccagctgcctcttccgggccatcagcgagcagctgttctgcagccaggtgcaccacctggagatcaggaaggcctgtgtgtcctacatgagggagaaccagcagacctttgagagctatgtggagggcagctttgagaagtacctggagcggctgggggaccccaaggagagcgctggccagctggagatccgggccctgagcctcatctacaacagagacttcatcctgtaccgcttccctgggaagccacccacctacgtgacagacaatggctatgaggacaagatcctgctgtgctacagcagcagcggccactatgacagcgtgtacagcaagcagttccagagcagcgctgctgtgtgccaggccgtgctgtatgagatcctgtacaaggatgtgtttgtggtggatgaggaggagctgaagacagccatcaagctgttccgcagcggcagcaagaagaacagaaataatgctgtgactggaagtgaagatgcccacacagactacaagagcagcaaccagaacaggatggaggagtggggcgcctgctacaatgctgagaacatccctgagggctacaacaagggcacagaggagaccaagagccctgagaaccccagcaagatgcccttcccctacaaggtgctgaaggccctggaccctgagatctacagaaatgtggagtttgatgtgtggctggacagcaggaaggagctgcagaagagtgactacatggagtatgccggccggcagtactacctgggggacaagtgccaggtgtgcctggagagcgagggccgctactacaatgcccacatccaggaggtgggcaatgaaaacaacagcgtgacagtgttcatcgaggagctggccgagaagcacgtggtgcccctggccaacctgaagcctgtgacccaggtgatgtctgtgcctgcctggaatgccatgcccagcaggaagggccggggctaccagaagatgcctgggggctacgtgcctgagatcgtcatcagcgagatggacatcaagcagcagaagaagatgttcaagaagatccggggcaaggaggtgtacatgaccatggcctacggcaagggggaccccctgctgcccccccggctgcagcacagcatgcactacggccatgacccccccatgcactacagccagacagctggaaatgtgatgagcaatgagcacttccacccccagcaccccagcccccggcagggccggggctacggcatgcccaggaacagcagccgcttcatcaacagacacaacatgcctggccccaaggtggacttctacccaggccctgggaagcgctgctgccagagctatgacaacttctcctaccgcagccgctccttccgccgcagccaccggcagatgagctgtgtgaacaaggagagccagtatggcttcaccccaggaaatggccagatgccccggggcctggaggagaccatcaccttctatgaggtggaggagggagatgaaacagcctaccccaccctgcccaaccacggcggccccagcaccatggtgcctgccaccagcggctactgtgtgggccggcggggccacagcagcggcaagcagaccctgaacctggaggagggcaatggccagagtgaaaatggccgctaccacgaggagtacctgtacagagctgagccagactatgagaccagcggcgtgtacagcaccacagccagcacagccaacctgagcctgcaggacaggaagagctgcagcatgagcccccaggacacagtgaccagctacaactacccccagaagatgatgggcaacattgctgctgtggccgccagctgtgccaacaacgtgcctgcccctgtgctgagcaatggagctgctgccaaccaggccatcagcaccacctctgtgagcagccagaatgccatccagcccctgtttgtgagcccccccacccacggccgcccagacaccaaggtgctgcagtactacttcaacctgggcctgcagtgctactaccacagctactggcacagcatggtgtatgtgccccagatgcagcagcagctgcacgtggagaactaccctgtgtacacagagccccccctggtggaccagacagtgccccagtgctacagcgaggtgcggcgggaggatggcatccaggccgaggccagcgccaatgacaccttccccaatgctgacagcagctctgtgccccatggagctgtgtactaccctgtgatgtctgacccctacggccagccccccctgcccggctttgacagctgcctgcctgtggtgcctgactacagctgtgtgcccccctggcaccctgtgggcacagcctacggcggcagcagccagatccatggagccatcaaccctggccccatcggctgcatcgcccccagccccccagccagccactacgtgccccagggcatgtag

SEQ ID NO: 144159 - DNA, 498 bp, Artificial Sequence
  Description of Artificial Sequence: Synthetic coding sequence
atgaagtgtgtgtttgtgacagtgggcaccaccagctttgatgacctgattgcctgtgtgtctgccccagacagcctgcagaagattgagagcctgggctacaacagactcatcctgcagatcggccggggcaccgtggtgcctgagcccttcagcacagagagcttcaccctggatgtgtaccgctacaaggacagcctgaaggaggacatccagaaggctgacctggtgatcagccatgctggagctggcagctgcctggagaccctggagaagggcaagcccctggtggtggtgatcaatgagaagctgatgaacaaccaccagctggagctggccaagcagctgcacaaggagggccacctgttctactgcacctgcagcaccctgcccggcctgctgcagagcatggacctgagcaccctgaagtgctacccacctggccagcctgagaagttcagcgccttcctggacaaggtggtgggcctgcagaagtag

SEQ ID NO: 144160 - DNA, 3414 bp, Artificial Sequence
  Description of Artificial Sequence: Synthetic coding sequence
atgaagtgtgtgtttgtgacagtgggcaccaccagctttgatgacctgattgcctgtgtgtctgccccagacagcctgcagaagattgagagcctgggctacaacagactcatcctgcagatcggccggggcaccgtggtgcctgagcccttcagcacagagagcttcaccctggatgtgtaccgctacaaggacagcctgaaggaggacatccagaaggctgacctggtgatcagccatgctggagctggcagctgcctggagaccctggagaagggcaagcccctggtggtggtgatcaatgagaagctgatgaacaaccaccagctggagctggccaagcagctgcacaaggagggccacctgttctactgcacctgccgggtgctgacctgccccggccaggccaagagcatcgccagcgcccctgggaagtgccaggacagcgctgccctgaccagcacagccttcagcggcctggactttggcctgctgagcggctacctgcacaagcaggccctggtgacagccacccaccccacctgcaccctgctcttccccagctgccacgccttcttccccctgcccctgacccccaccctgtacaagatgcacaagggctggaagaactactgcagccagaagagcctgaatgaggcctccatggatgagtacctgggcagcctgggcctcttcaggaagctgacagccaaggatgccagctgcctcttccgggccatcagcgagcagctgttctgcagccaggtgcaccacctggagatcaggaaggcctgtgtgtcctacatgagggagaaccagcagacctttgagagctatgtggagggcagctttgagaagtacctggagcggctgggggaccccaaggagagcgctggccagctggagatccgggccctgagcctcatctacaacagagacttcatcctgtaccgcttccctgggaagccacccacctacgtgacagacaatggctatgaggacaagatcctgctgtgctacagcagcagcggccactatgacagcgtgtacagcaagcagttccagagcagcgctgctgtgtgccaggccgtgctgtatgagatcctgtacaaggatgtgtttgtggtggatgaggaggagctgaagacagccatcaagctgttccgcagcggcagcaagaagaacagaaataatgctgtgactggaagtgaagatgcccacacagactacaagagcagcaaccagaacaggatggaggagtggggcgcctgctacaatgctgagaacatccctgagggctacaacaagggcacagaggagaccaagagccctgagaaccccagcaagatgcccttcccctacaaggtgctgaaggccctggaccctgagatctacagaaatgtggagtttgatgtgtggctggacagcaggaaggagctgcagaagagtgactacatggagtatgccggccggcagtactacctgggggacaagtgccaggtgtgcctggagagcgagggccgctactacaatgcccacatccaggaggtgggcaatgaaaacaacagcgtgacagtgttcatcgaggagctggccgagaagcacgtggtgcccctggccaacctgaagcctgtgacccaggtgatgtctgtgcctgcctggaatgccatgcccagcaggaagggccggggctaccagaagatgcctgggggctacgtgcctgagatcgtcatcagcgagatggacatcaagcagcagaagaagatgttcaagaagatccggggcaaggaggtgtacatgaccatggcctacggcaagggggaccccctgctgcccccccggctgcagcacagcatgcactacggccatgacccccccatgcactacagccagacagctggaaatgtgatgagcaatgagcacttccacccccagcaccccagcccccggcagggccggggctacggcatgcccaggaacagcagccgcttcatcaacagacacaacatgcctggccccaaggtggacttctacccaggccctgggaagcgctgctgccagagctatgacaacttctcctaccgcagccgctccttccgccgcagccaccggcagatgagctgtgtgaacaaggagagccagtatggcttcaccccaggaaatggccagatgccccggggcctggaggagaccatcaccttctatgaggtggaggagggagatgaaacagcctaccccaccctgcccaaccacggcggccccagcaccatggtgcctgccaccagcggctactgtgtgggccggcggggccacagcagcggcaagcagaccctgaacctggaggagggcaatggccagagtgaaaatggccgctaccacgaggagtacctgtacagagctgagccagactatgagaccagcggcgtgtacagcaccacagccagcacagccaacctgagcctgcaggacaggaagagctgcagcatgagcccccaggacacagtgaccagctacaactacccccagaagatgatgggcaacattgctgctgtggccgccagctgtgccaacaacgtgcctgcccctgtgctgagcaatggagctgctgccaaccaggccatcagcaccacctctgtgagcagccagaatgccatccagcccctgtttgtgagcccccccacccacggccggcctgtgattgccagccccagctacccctgccacagcgccatcccccacgccggggccagcctgcccccacctcctcctcctcctcctcctcctcctcctcctcctcctcctcctcctcctcctcctcctcctcctcctcctccagccctggatgtgggggagaccagcaacctgcagcccccaccacccctgcccccaccaccctacagctgtgaccccagcggcagtgacctgccccaggacaccaaggtgctgcagtactacttcaacctgggcctgcagtgctactaccacagctactggcacagcatggtgtatgtgccccagatgcagcagcagctgcacgtggagaactaccctgtgtacacagagccccccctggtggaccagacagtgccccagtgctacagcgaggtgagaagagaagatggcatccaggccgaggccagcgccaatgacaccttccccaatgctgacagcagctctgtgccccacggggctgtgtactaccctgtgatgtctgacccctacggccagccccccctgcccggctttgacagctgcctgcctgtggtgcctgactacagctgtgtgcccccctggcaccctgtgggcacagcctatggaggcagcagccagatccacggggccatcaaccctggccccatcggctgcatcgcccccagccccccagccagccactacgtgccccagggcatgtag

SEQ ID NO: 144161 - DNA, 651 bp, Artificial Sequence
  Description of Artificial Sequence: Synthetic coding sequence
atggtgtgtgtgctggtgctggccgctgctgctggagctgtggccgtgttcctgatcctgcgcatctgggtggtgctgcgctccatggatgtgaccccccgggagagcctgagcatcctggtggtggccggcagcggcggccacaccacagagatcctgcggctgctgggcagcctgagcaatgcctacagccccaggcactacgtgattgctgacacagatgagatgtctgccaacaagatcaacagctttgagctggacagagctgaccgggaccccagcaacatgtacaccaagtactacatccaccgcatccccaggagccgggaggtgcagcagagctggcccagcaccgtcttcaccaccctgcacagcatgtggctgtccttccccctcatccaccgggtgaagccagacctggtgctgtgcaatggacctggcacctgtgtgcccatctgtgtgtctgccctgctgctgggcatcctgggcatcaagaaggtgatcatcgtgtatgtggagagcatctgccgggtggagaccctgtccatgtctgggaagatcctcttccacctgagtgactacttcatcgtgcagtggccagccctgaaggagaagtaccccaagtctgtgtacctgggcagaattgtgtag

SEQ ID NO: 144162 - DNA, 972 bp, Artificial Sequence
  Description of Artificial Sequence: Synthetic coding sequence
atgcccctgctgaagctggtgcacggcagccccctggtgtttggagagaagttcaagctgttcaccctggtgtctgcctgcatccctgtgttccggctggcccggcggaggaagaagatcctcttctactgccacttcccagacctgctgctgaccaagagggacagcttcctgaagaggctgtaccgggcccccatcgactggattgaggagtacaccaccggcatggctgactgcatcctggtgaacagccagttcaccgctgctgtgttcaaggagaccttcaagagcctgagccacattgatcctgatgtgctgtaccccagcctgaatgtgaccagctttgattctgtggtgcctgagaagctggatgacctggtgcccaagggcaagaagttcctgctgctgagcatcaacagatatgaaaggaagaagaacctgaccctggccctggaggccctggtgcagctgcggggccgcctgaccagccaggactgggagcgggtgcacctgattgtggccggcggctatgatgagcgggtgctggagaatgtggagcactaccaggagctgaagaagatggtgcagcagagcgacctgggccagtatgtgaccttcctgcgctccttcagtgacaagcagaagatcagcctgctgcacagctgcacctgtgtgctgtacacccccagcaatgagcacttcggcatcgtgcccctggaggccatgtacatgcagtgccctgtgattgctgtgaacagcggcggccccctggagagcattgaccacagcgtgacaggcttcctgtgtgagccagaccctgtgcacttcagcgaggccatcgagaagttcatccgggagcccagcctgaaggccaccatgggcctggccggccgggcccgggtgaaggagaagttcagccctgaggccttcacagagcagctgtaccgctacgtgaccaagctgctggtgtag

SEQ ID NO: 144163 - DNA, 1251 bp, Artificial Sequence
  Description of Artificial Sequence: Synthetic coding sequence
atggccgaggagcagggccgggagcgggacagcgtgcccaagcccagcgtgctcttcctgcacccagacctgggcgtgggcggcgctgagcggctggtgctggatgctgccctggccctgcaggcccggggctgcagcgtgaagatctggacagcccactatgaccccggccactgctttgctgagagccgggagctgcctgtgcgctgtgccggggactggctgccccggggcctgggctggggcggccgcggggctgctgtgtgtgcctacgtgaggatggtgttcctggccctgtatgtgctcttcctggctgatgaggagtttgatgtggtggtgtgtgaccaggtgtctgcctgcatccctgtgttccggctggcccggcggaggaagaagatcctcttctactgccacttcccagacctgctgctgaccaagagggacagcttcctgaagaggctgtaccgggcccccatcgactggattgaggagtacaccaccggcatggctgactgcatcctggtgaacagccagttcaccgctgctgtgttcaaggagaccttcaagagcctgagccacatcgaccctgatgtgctgtaccccagcctgaatgtgaccagctttgacagcgtggtgcctgagaagctggatgacctggtgcccaagggcaagaagttcctgctgctgagcatcaacagatatgaaaggaagaagaacctgaccctggccctggaggccctggtgcagctgcggggccgcctgaccagccaggactgggagcgggtgcacctgattgtggccggcggctatgatgagcgggtgctggagaatgtggagcactaccaggagctgaagaagatggtgcagcagagcgacctgggccagtatgtgaccttcctgcggagcttcagtgacaagcagaagatcagcctgctgcacagctgcacctgtgtgctgtacacccccagcaatgagcactttggaattgtgcccctggaggccatgtacatgcagtgccctgtgattgctgtgaacagcggcggccccctggagagcattgaccacagcgtgacaggcttcctgtgtgagccagaccctgtgcacttcagcgaggccatcgagaagttcatccgggagcccagcctgaaggccaccatgggcctggccggccgggcccgggtgaaggagaagttcagccctgaggccttcacagagcagctgtaccgctacgtgaccaagctgctggtgtag

SEQ ID NO: 144164 - DNA, 1317 bp, Artificial Sequence
  Description of Artificial Sequence: Synthetic coding sequence
atggctgctggcctgaggaagaggggccgcagcggcagcgctgcccaggccgagggcctgtgcaagcagtggctgcagagggcctggcaggagcggcggctgctgctgcgggagccccgctacaccctgctggtggccgcctgcctgtgcctggccgaggtgggcatcaccttctgggtgatccaccgggtggcctacacagaaattgactggaaggcctacatggccgaggtggagggcgtcatcaatggcacctatgactacacccagctgcagggcgacaccggccccctggtgtacccagctggctttgtgtacatcttcatgggcctgtactatgccaccagccggggcacagacatccgcatggcccagaacatctttgctgtgctgtacctggccaccctgctgctggtgttcctgatctaccaccagacctgcaaggtgcccccatttgtgttcttcttcatgtgctgtgccagctacagagtgcacagcatctttgtgctgcggctcttcaatgaccctgtggccatggtgctgctcttcctgagcatcaacctgctgctggcccagcgctggggctggggctgctgcttcttcagcctggccgtgtctgtgaagatgaatgtgctgctgtttgcccctggcctgctcttcctgctgctgacccagtttggcttccggggggccctgcccaagctgggcatctgtgccggcctgcaggtggtgctgggcctgcccttcctgctggagaaccccagcggctacctgagccgcagctttgacctgggccggcagttcctgttccactggacagtgaactggaggttcctgcctgaggccctcttcctgcaccgggccttccacctggccctgctgacagcccacctgaccctgctgctgctgtttgccctgtgccgctggcacaggactggagagagcatcctgagcctgctgcgggaccccagcaagaggaaggtgcccccccagcccctgacccccaaccagatcgtgtccaccctcttcaccagcaacttcatcggcatctgcttcagccgcagcctgcactaccagttctacgtgtggtacttccacaccctgccctacctgctgtgggccatgcctgcccgctggctgacccacctgctgcggctgctggtgctgggcctcatcgagctgtcctggaacacctaccccagcaccagctgcagcagcgctgccctgcacatctgccacgccgtcatcctgctgcagctgtggctgggcccccagcccttccccaagagcacccagcacagcaagaaggcccactag

SEQ ID NO: 144165 - DNA, 1149 bp, Artificial Sequence
  Description of Artificial Sequence: Synthetic coding sequence
atggctgctgcccggctggcccgggccgccccagctgctgctggggccgccctgcacgccgccggcggccgcctgcccctgcccggcggcggcggccaccacctgctgggccacagccagggcggcatgtacccagctggctttgtgtacatcttcatgggcctgtactatgccaccagccggggcacagacatccgcatggcccagaacatctttgctgtgctgtacctggccaccctgctgctggtgttcctgatctaccaccagacctgcaaggtgcccccatttgtgttcttcttcatgtgctgtgccagctacagagtgcacagcatctttgtgctgcggctcttcaatgaccctgtggccatggtgctgctcttcctgagcatcaacctgctgctggcccagcgctggggctggggctgctgcttcttcagcctggccgtgtctgtgaagatgaatgtgctgctgtttgcccctggcctgctcttcctgctgctgacccagtttggcttccggggggccctgcccaagctgggcatctgtgccggcctgcaggtggtgctgggcctgcccttcctgctggagaaccccagcggctacctgagccgcagctttgacctgggccggcagttcctgttccactggacagtgaactggaggttcctgcctgaggccctcttcctgcaccgggccttccacctggccctgctgacagcccacctgaccctgctgctgctgtttgccctgtgccgctggcacaggactggagagagcatcctgagcctgctgcgggaccccagcaagaggaaggtgcccccccagcccctgacccccaaccagatcgtgtccaccctcttcaccagcaacttcatcggcatctgcttcagccgcagcctgcactaccagttctacgtgtggtacttccacaccctgccctacctgctgtgggccatgcctgcccgctggctgacccacctgctgcggctgctggtgctgggcctcatcgagctgtcctggaacacctaccccagcaccagctgcagcagcgctgccctgcacatctgccacgccgtcatcctgctgcagctgtggctgggcccccagcccttccccaagagcacccagcacagcaagaaggcccactag

SEQ ID NO: 144166 - DNA, 1530 bp, Artificial Sequence
  Description of Artificial Sequence: Synthetic coding sequence
atggagaagtggtacctgatgacagtggtggtgctgattggcctgactgtgcgctggacagtgtccctgaacagctacagcggggccggcaagccacccatgtttggagactatgaggcccagaggcactggcaggagatcaccttcaacctgcctgtgaagcagtggtacttcaacagcagtgacaacaacctgcagtactggggcctggactacccacccctgacagcctaccacagcctgctgtgtgcctacgtggccaagttcatcaacccagactggatcgccctgcacaccagccggggctatgagagccaggcccacaagctgttcatgaggaccaccgtgctgattgctgacctgctgatctacatcccagctgtggtgctgtactgctgctgcctgaaggagatcagcaccaagaagaagatcgccaatgccctgtgcatcctgctgtacccaggcctcatcctgattgattatggccacttccagaacatctacaacagcgtgtccctgggctttgccctgtggggcgtgctgggcatcagctgtgactgtgacctgctgggcagcctggccttctgcctggccatcaactacaagcagatggagctgtaccacgccctgcccttcttctgcttcctgctgggcaagtgcttcaagaagggcctgaagggcaagggctttgtgctgctggtgaagctggcctgcatcgtggtggccagctttgtgctgtgctggctgcccttcttcacagagcgggagcagaccctgcaggtgctgcggcggctcttccctgtggaccggggcctgtttgaggacaaggtggccaacatctggtgcagcttcaacgtgttcctgaagatcaaggacatcctgcccaggcacatccagctgatcatgtccttctgcagcaccttcctgagcctgctgcctgcctgcatcaagctgatcctgcagcccagcagcaagggcttcaagttcaccctggtgtcctgtgccctgtccttcttcctgttctccttccaggtgcatgagaagagcatcctgctggtgtccctgcctgtgtgcctggtgctgtctgagatccccttcatgagcacctggttcctgctggtgtccaccttctccatgctgcccctgctgctgaaggatgagctgctgatgcccagcgtggtgaccaccatggccttcttcatcgcctgtgtgaccagcttcagcatctttgagaagaccagcgaggaggagctgcagctgaagagcttcagcatctctgtgaggaagtacctgccctgcttcaccttcctgagccgcatcatccagtacctgttcctgatcagcgtcatcaccatggtgctgctgaccctgatgacagtgaccctggaccccccccagaagctgcctgacctcttctctgtgctggtgtgctttgtgtcctgcctgaacttcctgttcttcctggtgtacttcaacatcatcatcatgtgggacagcaagtctggaagaaaccagaagaagatctcctag

SEQ ID NO: 144167 - DNA, 1524 bp, Artificial Sequence
  Description of Artificial Sequence: Synthetic coding sequence
atggagaagtggtacctgatgacagtggtggtgctgattggcctgactgtgcgctggacagtgtccctgaacagctacagcggggccggcaagccacccatgtttggagactatgaggcccagaggcactggcaggagatcaccttcaacctgcctgtgaagcagtggtacttcaacagcagtgacaacaacctgcagtactggggcctggactacccacccctgacagcctaccacagcctgctgtgtgcctacgtggccaagttcatcaacccagactggatcgccctgcacaccagccggggctatgagagccaggcccacaagctgttcatgaggaccaccgtgctgattgctgacctgctgatctacatcccagctgtggtgctgtactgctgctgcctgaaggagatcagcaccaagaagaagatcgccaatgccctgtgcatcctgctgtacccaggcctcatcctgattgattatggccacttccagtacaacagcgtgtccctgggctttgccctgtggggcgtgctgggcatcagctgtgactgtgacctgctgggcagcctggccttctgcctggccatcaactacaagcagatggagctgtaccacgccctgcccttcttctgcttcctgctgggcaagtgcttcaagaagggcctgaagggcaagggctttgtgctgctggtgaagctggcctgcatcgtggtggccagctttgtgctgtgctggctgcccttcttcacagagcgggagcagaccctgcaggtgctgcggcggctcttccctgtggaccggggcctgtttgaggacaaggtggccaacatctggtgcagcttcaacgtgttcctgaagatcaaggacatcctgcccaggcacatccagctgatcatgtccttctgcagcaccttcctgagcctgctgcctgcctgcatcaagctgatcctgcagcccagcagcaagggcttcaagttcaccctggtgtcctgtgccctgtccttcttcctgttctccttccaggtgcatgagaagagcatcctgctggtgtccctgcctgtgtgcctggtgctgtctgagatccccttcatgagcacctggttcctgctggtgtccaccttctccatgctgcccctgctgctgaaggatgagctgctgatgcccagcgtggtgaccaccatggccttcttcatcgcctgtgtgaccagcttcagcatctttgagaagaccagcgaggaggagctgcagctgaagagcttcagcatctctgtgaggaagtacctgccctgcttcaccttcctgagccgcatcatccagtacctgttcctgatcagcgtcatcaccatggtgctgctgaccctgatgacagtgaccctggaccccccccagaagctgcctgacctcttctctgtgctggtgtgctttgtgtcctgcctgaacttcctgttcttcctggtgtacttcaacatcatcatcatgtgggacagcaagtctggaagaaaccagaagaagatctcctag

SEQ ID NO: 144168 - DNA, 765 bp, Artificial Sequence
  Description of Artificial Sequence: Synthetic coding sequence
atggagctgtaccacgccctgcccttcttctgcttcctgctgggcaagtgcttcaagaagggcctgaagggcaaaggatttgtgctgctggtgaagctggcctgcatcgtggtggccagctttgtgctgtgctggctgcccttcttcacagagcgggagcagaccctgcaggtgctgcggcggctcttccctgtggaccggggcctgtttgaggacaaggtggccaacatctggtgcagcttcaacgtgttcctgaagatcaaggacatcctgcccaggcacatccagctgatcatgaggcctgtgtgcctggtgctgtctgagatccccttcatgagcacctggttcctgctggtgtccaccttctccatgctgcccctgctgctgaaggatgagctgctgatgcccagcgtggtgaccaccatggccttcttcatcgcctgtgtgaccagcttcagcatctttgagaagaccagcgaggaggagctgcagctgaagagcttcagcatctctgtgaggaagtacctgccctgcttcaccttcctgagccgcatcatccagtacctgttcctgatcagcgtcatcaccatggtgctgctgaccctgatgacagtgaccctggaccccccccagaagctgcctgacctcttctctgtgctggtgtgctttgtgtcctgcctgaacttcctgttcttcctggtgtacttcaacatcatcatcatgtgggacagcaagagcggcaggaaccagaagaagatctcctag

SEQ ID NO: 144169 - DNA, 1581 bp, Artificial Sequence
  Description of Artificial Sequence: Synthetic coding sequence
atggccgccctgaccatcgccaccggcaccggcaactggttcagcgccctggccctgggcgtgaccctgctgaagtgcctgctgatccccacctaccacagcacagactttgaggtgcacaggaactggctggccatcacccacagcctgcccatcagccagtggtactatgaggccaccagcgagtggaccctggactacccacccttctttgcctggtttgagtacatcctgagccacgtggccaagtactttgaccaggagatgctgaatgtgcacaacctgaactacagcagcagcaggaccctgctcttccagcgcttcagcgtcatcttcatggatgtgctgtttgtgtatgctgtgcgggagtgctgcaagtgcattgatggcaagaaggtgggcaaggagctgacagagaagcccaagttcatcctgtctgtgctgctgctgtggaactttggcctgctgattgtggaccacatccacttccagtacaacggcttcctgtttggcctgatgctgctgagcatcgcccggctcttccagaagaggcacatggagggcgccttcctgtttgctgtgctgctgcacttcaagcacatctacctgtatgtggccccagcctatggagtgtacctgctgcggagctactgcttcaccgccaacaagccagatggcagcatccgctggaagagcttctcctttgtgcgggtcatcagcctgggcctggtggtgttcctggtgtctgccctgagcctgggccccttcctggccctgaaccagctgccccaggtgttcagccgcctcttccccttcaagaggggcctgtgccacgcctactgggcccccaacttctgggccctgtacaatgccctggacaaggtgctgtctgtgattggcctgaagctgaagttcctggaccccaacaacatccccaaggcctccatgaccagcggcctggtgcagcagttccagcacacagtgctgcccagcgtgacccccctggccaccctcatctgcaccctgattgccatcctgcccagcatcttctgcctgtggttcaagccccagggcccccggggcttcctgcgctgcctgaccctgtgtgccctgagcagcttcatgtttggctggcacgtgcatgagaaggccatcctgctggccatcctgcccatgagcctgctgtctgtgggcaaggctggagatgccagcatcttcctgatcctgaccaccaccggccactacagcctcttccccctgctcttcaccgcccctgagctgcccatcaagatcctgctgatgctgctcttcaccatctacagcatcagcagcctgaagaccctcttcaggaaggagaagcccctcttcaactggatggagaccttctacctgctgggcctgggccccctggaggtgtgctgtgaatttgtgttccccttcacctcctggaaggtgaagtaccccttcatccccctgctgctgacctctgtgtactgtgctgtgggcatcacctacgcctggttcaagctgtatgtgtctgtgctgattgacagcgccatcggcaagaccaagaagcagtag

SEQ ID NO: 144170 - DNA, 1404 bp, Artificial Sequence
  Description of Artificial Sequence: Synthetic coding sequence
atggccgccctgaccatcgccaccggcaccggcaactggttcagcgccctggccctgggcgtgaccctgctgaagtgcctgctgatccccacctaccacagcacagactttgaggtgcacaggaactggctggccatcacccacagcctgcccatcagccagtggtactatgaggccaccagcgagtggaccctggactacccacccttctttgcctggtttgagtacatcctgagccacgtggccaagtactttgaccaggagatgctgaatgtgcacaacctgaactacagcagcagcaggaccctgctcttccagcgcttcagcgtcatcttcatggatgtgctgtttgtgtatgctgtgcgggagtgctgcaagtgcattgatggcaagaaggtgggcaaggagctgacagagaagcccaagttcatcctgtctgtgctgctgctgtggaactttggcctgctgattgtggaccacatccacttccagtacaacggcttcctgtttggcctgatgctgctgagcatcgcccggctcttccagaagaggcacatggagggcgccttcctgtttgctgtgctgctgcacttcaagcacatctacctgtatgtggccccagcctatggagtgtacctgctgcggagctactgcttcaccgccaacaagccagatggcagcatccgctggaagagcttctcctttgtgcgggtcatcagcctgggcctggtggtgttcctggtgtctgccctgagcctgggccccttcctggccctgaaccagctgccccaggtgttcagccgcctcttccccttcaagaggggcctgtgccacgcctactgggcccccaacttctgggccctgtacaatgccctggacaaggtgctgtctgtgattggcctgaagctgaagttcctggaccccaacaacatccccaaggcctccatgaccagcggcctggtgcagcagttccagcacacagtgctgcccagcgtgacccccctggccaccctcatctgcaccctgattgccatcctgcccagcatcttctgcctgtggttcaagccccagggcccccggggcttcctgcgctgcctgaccctgtgtgccctgagcagcttcatgtttggctggcacgtgcatgagaaggccatcctgctggccatcctgcccatgagcctgctgtctgtgggcaaggctggagatgccagcatcttcctgatcctgaccaccaccggccactacagcctcttccccctgctcttcaccgcccctgagctgcccatcaagatcctgctgatgctgctcttcaccatctacagcatcagcagcctgaagaccctcttccgccgctccttcaccctggtggcccaggccggcgtgcagtggcatgacctgtcctag

SEQ ID NO: 144171 - DNA, 1323 bp, Artificial Sequence
  Description of Artificial Sequence: Synthetic coding sequence
atgatgctggccttcctggtgctgagcacaggcatgttctgcagcagcagcgccttcctgcccagcagcttctgcatgtacaccaccctgattgccatgacaggctggtacatggacaagaccagcattgctgtgctgggcgtggccgccggggccatcctgggctggcccttctctgctgccctgggcctgcccatcgcctttgacctgctggtgatgaagcaccgctggaagagcttcttccactggagcctgatggccctgatcctcttcctggtgcctgtggtggtgattgacagctactactacggcaagctggtgattgcccccctgaacatcgtgctgtacaacgtgttcaccccccacggccctgacctgtatggaacagagccctggtacttctacctgatcaatggcttcctgaacttcaacgtggcctttgccctggccctgctggtgctgcccctgaccagcctgatggagtacctgctgcagcgcttccacgtgcagaacctgggccacccctactggctgaccctggcccccatgtacatctggttcatcatcttcttcatccagccccacaaggaggagcgcttcctgtttcctgtgtaccccctcatctgcctgtgtggggctgtggccctgagcgccctgcagaagtgctaccactttgtgttccagcgctaccgcctggagcactacacagtgaccagcaactggctggccctgggcaccgtcttcctgtttggcctgctgtccttcagccgctctgtggccctcttccggggctaccacggccccctggacctgtacccagagttctaccgcatcgccacagaccccaccatccacacagtgcctgagggccggcctgtgaatgtgtgtgtgggcaaggagtggtaccgcttccccagcagcttcctgctgcctgacaactggcagctgcagttcatccccagcgagttccggggccagctgcccaagccctttgctgagggccccctggccacccgcatcgtgcccacagacatgaatgaccagaacctggaggagcccagccgctacatcgacatcagcaagtgccactacctggtggacctggacaccatgagggagaccccccgggagcccaagtacagcagcaacaaggaggagtggatcagcctggcctaccggcccttcctggatgccagccgcagcagcaagctgctgcgggccttctacgtgcccttcctgagtgaccagtacacagtgtatgtgaactacaccatcctgaagcccaggaaggccaagcagatcaggaagaagagcggcggctag

SEQ ID NO: 144172 - DNA, 2535 bp, Artificial Sequence
  Description of Artificial Sequence: Synthetic coding sequence
atggccccccggcggctgctgctggtgggggagggcaacttctcctttgctgctgccctgtctgagaccctggaccagagcacccagctgacagccacctgcctgcagaggcctgctgagctggcccgggaccccctggcctgggagaacctgcagtgcctgcgggagcggggcattgatgtgcgctttggagtggactgcacccagctggctgatgtgtttgagctgcacgagcgggagtttgaccagatctacttcatcttcccccactgcggcaggaaggccggcgtggccaagaaccgggagctgctggccaagttcttccagagctgtgctgatgtgctggccgaggagggggaggtgcacgtggccctgtgccggggccagggcggcaccccagctgacaagccccagcgggagtggcacaacagctggcaggtggtggccatggccgccctgggcggcctcatcctgagtgatgtgtaccccttcagctgcaaggctgtggccggctacaagtgcaccggctaccgcagccaggacaagagcttccacgtggagggcgccctgaaccacatcttcaccaggagcctgccctttgagggcagccagccccgcatcttccgcatcaagctgggcaaccagtggttctccttccctgagcctgaggccctggtgggcaagctgaaccggctggccatggccagcagaggagcccggcagaggctgaagggcagcggggccagcagcggggacacagccccagctgctgacaagctgcgggagctgctgggcagccgggaggccggcggcgctgagcacaggacagagctgagcggcaacaaggccggccaggtgtgggcccctgagggcagcacagccttcaagtgcctgctgagcgcccggctgtgtgccgccctgctgagcaacatcagtgactgtgatgagaccttcaactactgggagcccacccactacctgatctatggagagggcttccagacctgggagtacagccctgcctatgccatccgctcctatgcctacctgctgctgcacgcctggccagctgccttccacgcccgcatcctgcagaccaacaagatcctggtgttctacttcctgcgctgcctgctggcctttgtgtcctgcatctgtgagctgtacttctacaaggctgtgtgcaagaagtttggcctgcacgtgtccaggatgatgctggccttcctggtgctgagcacaggcatgttctgcagcagcagcgccttcctgcccagcagcttctgcatgtacaccaccctgattgccatgacaggctggtacatggacaagaccagcattgctgtgctgggcgtggccgccggggccatcctgggctggcccttctctgctgccctgggcctgcccatcgcctttgacctgctggtgatgaagcaccgctggaagagcttcttccactggagcctgatggccctgatcctcttcctggtgcctgtggtggtgattgacagctactactacggcaagctggtgattgcccccctgaacatcgtgctgtacaacgtgttcaccccccacggccctgacctgtatggaacagagccctggtacttctacctgatcaatggcttcctgaacttcaacgtggcctttgccctggccctgctggtgctgcccctgaccagcctgatggagtacctgctgcagcgcttccacgtgcagaacctgggccacccctactggctgaccctggcccccatgtacatctggttcatcatcttcttcatccagccccacaaggaggagcgcttcctgtttcctgtgtaccccctcatctgcctgtgtggggctgtggccctgagcgccctgcagaagtgctaccactttgtgttccagcgctaccgcctggagcactacacagtgaccagcaactggctggccctgggcaccgtcttcctgtttggcctgctgtccttcagccgctctgtggccctcttccggggctaccacggccccctggacctgtacccagagttctaccgcatcgccacagaccccaccatccacacagtgcctgagggccggcctgtgaatgtgtgtgtgggcaaggagtggtaccgcttccccagcagcttcctgctgcctgacaactggcagctgcagttcatccccagcgagttccggggccagctgcccaagccctttgctgagggccccctggccacccgcatcgtgcccacagacatgaatgaccagaacctggaggagcccagccgctacatcgacatcagcaagtgccactacctggtggacctggacaccatgagggagaccccccgggagcccaagtacagcagcaacaaggaggagtggatcagcctggcctaccggcccttcctggatgccagccgcagcagcaagctgctgcgggccttctacgtgcccttcctgagtgaccagtacacagtgtatgtgaactacaccatcctgaagcccaggaaggccaagcagatcaggaagaagagcggcggctag

SEQ ID NO: 144173 - DNA, 1344 bp, Artificial Sequence
  Description of Artificial Sequence: Synthetic coding sequence
atgatgctggccttcctggtgctgagcacaggcatgttctgcagcagcagcgccttcctgcccagcagcttctgcatgtacaccaccctgattgccatgacaggctggtacatggacaagaccagcattgctgtgctgggcgtggccgccggggccatcctgggctggcccttctctgctgccctgggcctgcccatcgcctttgacctgctggtgatgaagcaccgctggaagagcttcttccactggagcctgatggccctgatcctcttcctggtgcctgtggtggtgattgacagctactactacggcaagctggtgattgcccccctgaacatcgtgctgtacaacgtgttcaccccccacggccctgacctgtatggaacagagccctggtacttctacctgatcaatggcttcctgaacttcaacgtggcctttgccctggccctgctggtgctgcccctgaccagcctgatggagtacctgctgcagcgcttccacgtgcagaacctgggccacccctactggctgaccctggcccccatgtacatctggttcatcatcttcttcatccagccccacaaggaggagcgcttcctgtttcctgtgtaccccctcatctgcctgtgtggggctgtggccctgagcgccctgcagcacagcttcctgtacttccagaagtgctaccactttgtgttccagcgctaccgcctggagcactacacagtgaccagcaactggctggccctgggcaccgtcttcctgtttggcctgctgtccttcagccgctctgtggccctcttccggggctaccacggccccctggacctgtacccagagttctacagaattgccacagaccccaccatccacacagtgcctgagggccggcctgtgaatgtgtgtgtgggcaaggagtggtaccgcttccccagcagcttcctgctgcctgacaactggcagctgcagttcatccccagcgagttccggggccagctgcccaagccctttgctgagggccccctggccaccagaattgtgcccacagacatgaatgaccagaacctggaggagcccagccgctacatcgacatcagcaagtgccactacctggtggacctggacaccatgagggagaccccccgggagcccaagtacagcagcaacaaggaggagtggatcagcctggcctaccggcccttcctggatgccagccgcagcagcaagctgctgcgggccttctacgtgcccttcctgagtgaccagtacacagtgtatgtgaactacaccatcctgaagcccaggaaggccaagcagatcaggaagaagagcggcggctag

SEQ ID NO: 144174 - DNA, 1647 bp, Artificial Sequence
  Description of Artificial Sequence: Synthetic coding sequence
atggtgctggccgagctgtatgtgtctgaccgggagggcagtgatgccactggagatggcaccaaggagaagcccttcaagacaggcctgaaggccctgatgacagtgggcaaggagcccttccccaccatctacgtggacagccagaaggaaaatgaacgctggaatgtcatcagcaagagccagctgaagaacatcaagaagatgtggcaccgggagcagatgaagtctgagagccgggagaagaaggaggccgaggacagcctgcggcgggagaagaacctggaggaggccaagaagatcaccatcaagaatgaccccagcctgcctgagcccaagtgtgtgaagattggagccctggagggctaccggggccagagggtgaaggtgtttggctgggtgcaccggctgcggcggcagggcaagaacctgatgttcctggtgctgagagatggcaccggctacctgcagtgtgtgctggctgatgagctgtgccagtgctacaatggagtgctgctgagcacagagagctctgtggccgtgtatggcatgctgaacctgacccccaagggcaagcaggcccctgggggccacgagctgagctgtgacttctgggagctgattggcctggccccagctggaggagctgacaacctgatcaatgaggagagtgatgtggatgtgcagctgaacaacagacacatgatgatccggggggagaacatgagcaagatcctgaaggcccgctccatggtgacccgctgcttccgggaccacttctttgaccggggctactatgaggtgaccccacccaccctggtgcagacccaggtggagggcggggccaccctcttcaagctggactactttggagaggaggccttcctgacccagagcagccagctgtacctggagacctgcctgcctgccctgggagatgtgttctgcatcgcccagagctacagagctgagcagagcaggaccaggaggcacctggccgagtacacccacgtggaggctgaatgtcccttcctgacctttgatgacctgctgaaccggctggaggacctggtgtgtgatgtggtggaccgcatcctgaagagccctgctggcagcatcgtgcatgagctgaaccccaacttccagccccccaagaggcccttcaagaggatgaactacagtgatgccatcgtgtggctgaaggagcatgatgtgaagaaggaggatggcaccttctatgaatttggagaggacatccctgaggcccctgagcggctgatgacagacaccatcaatgagcccatcctgctgtgccgcttccctgtggagatcaagagcttctacatgcagcgctgcccagaggacagccggctgacagaatctgtggatgtgctgatgcccaacgtgggggagatcgtgggcggctccatgaggatctttgacagcgaggagatcctggccggctacaagcgggagggcatcgaccccaccccctactactggtacacagaccagaggaaatatggcacctgcccccatggaggctacggcctgggcctggagcgcttcctgacctggatcctgaaccgctaccacatcagagatgtgtgcctgtaccccaggtttgtgcagcgctgcaccccctag

SEQ ID NO: 144175 - DNA, 765 bp, Artificial Sequence
  Description of Artificial Sequence: Synthetic coding sequence
atgacagtgggcaaggagcccttccccaccatctacgtggacagccagaaggaaaatgaacgctggaatgtcatcagcaagagccagctgaagaacatcaagaagatgtggcaccgggagcagatgaagtctgagagccgggagaagaaggaggccgaggacagcctgcggcgggagaagaacctggaggaggccaagaagatcaccatcaagaatgaccccagcctgcctgagcccaagtgtgtgaagatcggggccctggagggctaccggggccagagggtgaaggtgtttggctgggtgcaccggctgcggcggcagggcaagaacctgatgttcctggtgctgagagatggcaccggctacctgcagtgtgtgctggctgatgagctgtgccagtgctacaacggggtgctgctgagcacagagagctctgtggccgtgtatggcatgctgaacctgacccccaagggcaagcaggcccctgggggccacgagctgagctgtgacttctgggagctgattggcctggccccagctgggggcgctgacaacctgatcaatgaggagagtgatgtggatgtgcagctgaacaacagacacatgatgatcagaggagagaacatgagcaagatcctgaaggcccgctccatggtgacccgctgcttccgggaccacttctttgaccggggctactatgaggtgtccatgcacagcagcgcctttgccaagaacatgttctttgctgtgctgaagctggagtag

SEQ ID NO: 144176 - DNA, 900 bp, Artificial Sequence
  Description of Artificial Sequence: Synthetic coding sequence
atgtgtgaggactggtgcttccgggaccacttctttgaccggggctactatgaggtgaccccacccaccctggtgcagacccaggtggagggcggggccaccctcttcaagctggactactttggagaggaggccttcctgacccagagcagccagctgtacctggagacctgcctgcctgccctgggagatgtgttctgcatcgcccagagctacagagctgagcagagcaggacccggcggcacctggccgagtacacccacgtggaggccgagtgccccttcctgacctttgatgacctgctgaaccggctggaggacctggtgtgtgatgtggtggaccgcatcctgaagagccctgctggcagcatcgtgcatgagctgaaccccaacttccagccccccaagaggcccttcaagaggatgaactacagtgatgccatcgtgtggctgaaggagcatgatgtgaagaaggaggatggcaccttctatgaatttggagaggacatccctgaggcccctgagcggctgatgacagacaccatcaatgagcccatcctgctgtgccgcttccctgtggagatcaagagcttctacatgcagcgctgcccagaggacagccggctgacagagagcgtggatgtgctgatgcccaacgtgggggagatcgtgggcggctccatgaggatctttgattctgaggagatcctggccggctacaagcgggagggcatcgaccccaccccctactactggtacacagaccagaggaaatatggcacctgcccccacggcggctacggcctgggcctggagcgcttcctgacctggatcctgaaccgctaccacatcagagatgtgtgcctgtaccccaggtttgtgcagcgctgcaccccctag

SEQ ID NO: 144177 - DNA, 525 bp, Artificial Sequence
  Description of Artificial Sequence: Synthetic coding sequence
atggtgctggccgagctgtatgtgtctgaccgggagggcagtgatgccactggagatggcaccaaggagaagcccttcaagacaggcctgaaggccctgatgacagtgggcaaggagcccttccccaccatctacgtggacagccagaaggaaaatgaacgctggaatgtcatcagcaagagccagctgaagaacatcaagaagatgtggcaccgggagcagatgaagtctgagagccgggagaagaaggaggccgaggacagcctgcggcgggagaagaacctggaggaggccaagaagatcaccatcaagaatgaccccagcctgcctgagcccaagtgtgtgaagattggagccctggagggctaccggggccagagggtgaaggtgtttggctgggtgcaccggctgcggcggcaggtgtctgtgctgcagtggagcagcctggtgcatggagagcagtgctgcagcgtgtggaatgccaagagctaccccaagggccaggccggcagccgctggccctag

SEQ ID NO: 144178 - DNA, 1434 bp, Artificial Sequence
  Description of Artificial Sequence: Synthetic coding sequence
atgctgggcgtgcgctgcctgctgcggtctgtgcgcttctgcagcagcgcccccttccccaagcacaagcccagcgccaagctgtctgtgagagatgccctgggcgcccagaatgccagcggggagcgcatcaagatccagggctggatccgctctgtgcgcagccagaaggaggtgctcttcctgcacgtgaatgatggcagcagcctggagagcctgcaggtggtggccgacagcggcctggacagccgggagctgaactttggcagctctgtggaggtgcagggccagctgatcaagagccccagcaagaggcagaatgtggagctgaaggccgagaagatcaaggtgattggcaactgtgatgccaaggacttccccatcaagtacaaggagcggcaccccctggagtacctgcggcagtacccccacttccgctgcaggaccaacgtgctgggcagcatcctgcgcatccgctctgaggccacagctgccatccacagcttcttcaaggacagcggctttgtgcacatccacacccccatcatcaccagcaatgacagcgagggcgctggggagctgttccagctggagcccagcggcaagctgaaggtgcctgaggagaacttcttcaacgtgcctgccttcctgactgtgtctggccagctgcacctggaggtgatgtctggggccttcacccaggtgttcaccttcggccccaccttccgggcagagaacagccagagccgccgccacctggccgagttctacatgattgaagctgagatcagctttgtggacagcctgcaggacctgatgcaggtgattgaggagctgttcaaggccaccaccatgatggtgctgagcaagtgcccagaagatgtggagctgtgccacaagttcatcgcccctggccagaaggaccggctggagcacatgctgaagaacaacttcctgatcatctcctacacagaggccgtggagatcctgaagcaggccagccagaacttcaccttcaccccagagtggggcgctgacctgaggacagaacatgagaagtacctggtgaagcactgcggcaacatccctgtgtttgtgatcaactaccccctgaccctgaagcccttctacatgagggacaatgaagatggcccccagcacacagtggccgctgtggacctgctggtgcctggggtgggggagctgtttggaggcggcctgcgggaggagcgctaccacttcctggaggagcggctggcccggagcggcctgacagaggtgtaccagtggtacctggacctgcggagatttggatctgtgccccacggcggcttcggcatgggctttgagcgctacctgcagtgcatcctgggcgtggacaacatcaaggatgtgatccccttcccccgcttcccccacagctgcctgctgtag

SEQ ID NO: 144179 - DNA, 942 bp, Artificial Sequence
  Description of Artificial Sequence: Synthetic coding sequence
atggcccagaggaagaatgccaagagcagcggcaacagcagcagcagcggcagcggcagcggcagcaccagcgctggcagcagcagccctggggcccggcgggagaccaagcacggcggccacaagaatggaaggaagggcggcctgagcggcaccagcttcttcacctggttcatggtgattgccctgctgggcgtgtggacctctgtggccgtggtgtggtttgacctggtggactatgaggaggtgctgggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcacgtggagggggaggacctgcagcaggaggatggccccaccggggagccccagcaggaggatgatgagttcctgatggccacagatgtggatgacagatttgagaccctggagcctgaggtgtcccatgaggagacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggccgtgtatgagcccctggagaatgaaggcatcgagatcacagaggtgacagcccctcctgaggacaaccctgtggaggacagccaggtgattgtggaggaggtgtccatcttccctgtggaggagcagcaggaggtgcccccagacacctag

SEQ ID NO: 144180 - DNA, 612 bp, Artificial Sequence
  Description of Artificial Sequence: Synthetic coding sequence
atggcccagaggaagaatgccaagagcagcggcaacagcagcagcagcggcagcggcagcggcagcaccagcgctggcagcagcagccctggggcccggcgggagaccaagcacggcggccacaagaatggaaggaagggcggcctgagcggcaccagcttcttcacctggttcatggtgattgccctgctgggcgtgtggacctctgtggccgtggtgtggtttgacctggtggactatgaggaggtgctggccaaggccaaggacttccgctacaacctgtctgaggtgctgcagggcaagctgggcatctatgatgctgatggagatggagactttgatgtggatgatgccaaggtgctgctgggcctgaccaaggatggcagcaatgaaaatattgacagcctggaggaggtgctgaacatcctggccgaggagagcagtgactggttctacggcttcctgtccttcctgtatgacatcatgaccccatttgagatgctggaggaggaggaggaggagagcgagacagcagatggagtggatggcaccagccagaatgaaggagtgcagggcaagacctgtgtgatcctggacctgcacaaccagtag

SEQ ID NO: 144181 - DNA, 2277 bp, Artificial Sequence
  Description of Artificial Sequence: Synthetic coding sequence
atggcccagaggaagaatgccaagagcagcggcaacagcagcagcagcggcagcggcagcggcagcaccagcgctggcagcagcagccctggggcccggcgggagaccaagcacggcggccacaagaatggaaggaagggcggcctgagcggcaccagcttcttcacctggttcatggtgattgccctgctgggcgtgtggacctctgtggccgtggtgtggtttgacctggtggactatgaggaggtgctgggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcacgtggagggggaggacctgcagcaggaggatggccccaccggggagccccagcaggaggatgatgagttcctgatggccacagatgtggatgacagatttgagaccctggagcctgaggtgtcccatgaggagacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggccgtgtatgagcccctggagaatgaaggcatcgagatcacagaggtgacagcccctcctgaggacaaccctgtggaggacagccaggtgattgtggaggaggtgtccatcttccctgtggaggagcagcaggaggtgcccccagagaccaacaggaagacagatgatcctgagcagaaggccaaggtgaagaagaagaagcccaagctgctgaacaagtttgacaagaccatcaaggccgagctggatgctgctgagaagctgaggaagaggggcaagattgaggaggccgtgaatgccttcaaggagctggtgaggaagtacccccagagcccccgggcccgctatggcaaggcccagtgtgaagatgacctggccgagaagaggaggagcaatgaggtgctgcggggggccatcgagacctaccaggaggtggccagcctgcctgatgtgcctgctgacctgctgaagctgagcctgaagagaagaagtgaccggcagcagttcctgggccacatgaggggcagcctgctgaccctgcagaggctggtgcagctgttccccaatgacaccagcctgaagaatgacctgggcgtgggctacctgctgattggagacaatgacaatgccaagaaggtgtatgaggaggtgctgtctgtgaccccaaatgatggctttgccaaggtgcactacggcttcatcctgaaggcccagaacaagattgctgagagcatcccctacctgaaggagggcattgaaagtggggaccccggcacagatgatggccgcttctacttccacctgggagatgccatgcagagggtgggcaacaaggaggcctacaagtggtatgagctgggccacaagaggggccactttgcctctgtgtggcagaggagcctgtacaacgtgaatggcctgaaggcccagccctggtggacccccaaggagaccggctacacagagctggtgaagagcctggagaggaactggaagctgatcagagatgagggcctggccgtgatggacaaggccaagggcctcttcctgcctgaagatgagaacctgcgggagaagggggactggagccagttcaccctgtggcagcagggcagaagaaatgaaaatgcctgcaagggggcccccaagacctgcaccctgctggagaagtttcctgagaccaccggctgcagaagaggccagatcaagtacagcatcatgcaccctggcacccacgtgtggccccacacaggccccaccaactgccgcctgaggatgcacctgggcctggtgatccccaaggagggctgcaagatccgctgtgccaatgagaccaagacctgggaggagggcaaggtgctgatctttgatgacagctttgaacatgaggtgtggcaggatgccagcagcttccgcctcatcttcatcgtggatgtgtggcaccctgagctgaccccccagcagaggaggagcctgcctgccatctag

SEQ ID NO: 144182 - DNA, 678 bp, Artificial Sequence
  Description of Artificial Sequence: Synthetic coding sequence
atggccgaggacaaggagaccaagcatggaggccacaagaatggaagaaaaggaggcctgagcggcaccagcttcttcacctggttcatggtgattgccctgctgggcgtgtggacctctgtggccgtggtgtggtttgacctggtggactatgaggaggtgctggccaaggccaaggacttccgctacaacctgtctgaggtgctgcagggcaagctgggcatctatgatgctgatggagatggagactttgatgtggatgatgccaaggtgctgctggagggccccagcggcgtggccaagaggaagaccaaggccaaggtgaaggagctgaccaaggaggagctgaagaaggagaaggagaagccagagagcaggaaggagagcaagaatgaggagaggaagaagggcaagaaggaggatgtgaggaaggacaagaagattgctgatgctgacctgagcaggaaggagagccccaagggcaagaaggaccgggagaaggagaaggtggacctggagaagagcgccaagaccaaggagaacaggaagaagagcaccaacatgaaggatgtgagcagcaagatggccagccgggacaaggatgacaggaaggagagccgcagcagcaccaggtatgcccacctgaccaagggcaacacccagaagagaaatggatag

SEQ ID NO: 144183 - DNA, 1290 bp, Artificial Sequence
  Description of Artificial Sequence: Synthetic coding sequence
atggcccagaggaagaatgccaagagcagcggcaacagcagcagcagcggcagcggcagcggcagcaccagcgctggcagcagcagccctggggcccggcgggagaccaagcacggcggccacaagaatggaaggaagggcggcctgagcggcaccagcttcttcacctggttcatggtgattgccctgctgggcgtgtggacctctgtggccgtggtgtggtttgacctggtggactatgaggaggtgctgggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcacgtggagggggaggacctgcagcaggaggatggccccaccggggagccccagcaggaggatgatgagttcctgatggccacagatgtggatgacagatttgagaccctggagcctgaggtgtcccatgaggagacagagcacagctaccacgtggaggagacagacagcagcgagcctgtggtggaggatgagcggctgcaccacgacacagatgatgtgacctaccaggtgtatgaggagcaggccgtgtatgagcccctggagaatgaaggaattgagatcacagaggtgacagcccccccagaggacaaccctgtggaggacagccaggtgattgtggaggaggtgtccatcttccctgtggaggagcagcaggaggtgcccccagagaccaacaggaagacagatgatcctgagcagaaggccaaggtgaagaagaagaagcccaagctgctgaacaagtttgacaagaccatcaaggccgagctggatgctgctgagaagctgaggaagaggggcaagattgaggaggccgtgaatgccttcaaggagctggtgaggaagtacccccagagcccccgggcccgctatggcaaggcccagtgtgaagatgacctggccgagaagagaagaagcaatgaggtgctgcggggggccatcgagacctaccaggaggtggccagcctgcctgatgtgcctgctgacctgctgaagctgagcctgaagagaagaagtgaccggcagcagttcctgggccacatgaggggcagcctgctgaccctgcagaggctggtgcagtag

SEQ ID NO: 144184 - DNA, 900 bp, Artificial Sequence
  Description of Artificial Sequence: Synthetic coding sequence
atggccgaggacaaggagaccaagcatggaggccacaagaatggaagaaaaggaggcctgagcggcaccagcttcttcacctggttcatggtgattgccctgctgggcgtgtggacctctgtggccgtggtgtggtttgacctggtggactatgaggaggtgctggccaaggccaaggacttccgctacaacctgtctgaggtgctgcagggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcacgtggagggggaggacctgcagcaggaggatggccccaccggggagccccagcaggaggatgatgagttcctgatggccacagatgtggatgacagatttgagaccctggagcctgaggtgtcccatgaggagacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggccgtgtatgagcccctggagaatgaaggcatcgagatcacagaggtgacagcccctcctgaggacaaccctgtggaggacagccaggtgattgtggaggaggtgtccatcttccctgtggaggagcagcaggaggtgcccccagacacctag

SEQ ID NO: 144185 - DNA, 900 bp, Artificial Sequence; identical to SEQ ID NO: 144184
  Description of Artificial Sequence: Synthetic coding sequence

SEQ ID NO: 144186 - DNA, 897 bp, Artificial Sequence
  Description of Artificial Sequence: Synthetic coding sequence
atggccgaggacaaggagaccaagcatggaggccacaagaatggaagaaaaggaggcctgagcggcaccagcttcttcacctggttcatggtgattgccctgctgggcgtgtggacctctgtggccgtggtgtggtttgacctggtggactatgaggaggtgctggccaaggccaaggacttccgctacaacctgtctgaggtgctgcagggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcacgtggagggggaggacctgcagcaggaggatggccccaccggggagccccagcaggaggatgatgagttcctgatggccacagatgtggatgacagatttgagaccctggagcctgaggtgtcccatgaggagacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggtgtatgagcccctggagaatgaaggaattgagatcacagaggtgacagcccccccagaggacaaccctgtggaggacagccaggtgattgtggaggaggtgtccatcttccctgtggaggagcagcaggaggtgcccccagacacctag

SEQ ID NO: 144187 - DNA, 813 bp, Artificial Sequence
  Description of Artificial Sequence: Synthetic coding sequence
atggcccagaggaagaatgccaagagcagcggcaacagcagcagcagcggcagcggcagcggcagcaccagcgctggcagcagcagccctggggcccggcgggagaccaagcacggcggccacaagaatggaaggaagggcggcctgagcggcaccagcttcttcacctggttcatggtgattgccctgctgggcgtgtggacctctgtggccgtggtgtggtttgacctggtggactatgaggaggtgctgggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcatgaaacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggccgtgtatgagcccctggagaatgaaggaattgagatcacagaggtgacagcccccccagaggacaaccctgtggaggacagccaggtgattgtggaggaggtgtccatcttccctgtggaggagcagcaggaggtgcccccagacacctag

SEQ ID NO: 144188 - DNA, 633 bp, Artificial Sequence
  Description of Artificial Sequence: Synthetic coding sequence
atggccgaggacaaggagaccaagcatggaggccacaagaatggaagaaaaggaggcctgagcggcaccagcttcttcacctggttcatggtgattgccctgctgggcgtgtggacctctgtggccgtggtgtggtttgacctggtggactatgaggaggtgctgggcaagctgggcatctatgatgctgatggagatggagactttgatgtggatgatgccaaggtgctgctggagggccccagcggcgtggccaagaggaagaccaaggccaaggtgaaggagctgaccaaggaggagctgaagaaggagaaggagaagccagagagcaggaaggagagcaagaatgaggagaggaagaagggcaagaaggaggatgtgaggaaggacaagaagattgctgatgctgacctgagcaggaaggagagccccaagggcaagaaggaccgggagaaggagaaggtggacctggagaagagcgccaagaccaaggaaaataggaagaagagcaccaacatgaaggatgtgagcagcaagatggccagccgggacaaggatgacaggaaggagagccgcagcagcaccaggtatgcccacctgaccaagggcaacacccagaagagaaatggatag

SEQ ID NO: 144189 - DNA, 771 bp, Artificial Sequence
  Description of Artificial Sequence: Synthetic coding sequence
atggccgaggacaaggagaccaagcatggaggccacaagaatggaagaaaaggaggcctgagcggcaccagcttcttcacctggttcatggtgattgccctgctgggcgtgtggacctctgtggccgtggtgtggtttgacctggtggactatgaggaggtgctggccaaggccaaggacttccgctacaacctgtctgaggtgctgcagggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcatgctgagcatgaaacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggccgtgtatgagcccctggagaatgaaggaattgagatcacagaggtgacagcccccccagaggacaaccctgtggaggacagccaggtgattgtggaggaggtgtccatcttccctgtggaggagcagcaggaggtgcccccagacacctag

SEQ ID NO: 144190 - DNA, 2190 bp, Artificial Sequence
  Description of Artificial Sequence: Synthetic coding sequence
atggccgaggacaaggagaccaagcatggaggccacaagaatggaagaaaaggaggcctgagcggcaccagcttcttcacctggttcatggtgattgccctgctgggcgtgtggacctctgtggccgtggtgtggtttgacctggtggactatgaggaggtgctgggcaagctgggcatctatgatgctgatggagatggagactttgatgtggatgatgccaaggtgctgctgggcctgaaggagaggagcaccagcgagcctgctgtgcccccagaggaggccgagccccacacagagcctgaggagcaggtgcctgtggaggccgagccccagaacattgaagatgaggccaaggagcagatccagagcctgctgcacgagatggtgcacgccgagcacgtggagggggaggacctgcagcaggaggatggccccactggagagccccagcaggaggatgatgagttcctgatggccacagatgtggatgacagatttgagaccctggagcctgaggtgtcccatgaggagacagagcacagctaccacgtggaggagaccgtgtcccaggactgcaaccaggacatggaggagatgatgtctgagcaggagaacccagacagcagcgagcctgtggtggaggatgagcggctgcaccacgacacagatgatgtgacctaccaggtgtatgaggagcaggccgtgtatgagcccctggagaatgaaggaattgagatcacagaggtgacagcccccccagaggacaaccctgtggaggacagccaggtgattgtggaggaggtgtccatcttccctgtggaggagcagcaggaggtgcccccagagaccaacaggaagacagatgatcctgagcagaaggccaaggtgaagaagaagaagcccaagctgctgaacaagtttgacaagaccatcaaggccgagctggatgctgctgagaagctgaggaagaggggcaagattgaggaggccgtgaatgccttcaaggagctggtgaggaagtacccccagagcccccgggcccgctatggcaaggcccagtgtgaagatgacctggccgagaagagaagaagcaatgaggtgctgcggggggccatcgagacctaccaggaggtggccagcctgcctgatgtgcctgctgacctgctgaagctgagcctgaagagaagaagtgaccggcagcagttcctgggccacatgaggggcagcctgctgaccctgcagaggctggtgcagctgttccccaatgacaccagcctgaagaatgacctgggcgtgggctacctgctgattggagacaatgacaatgccaagaaggtgtatgaggaggtgctgtctgtgaccccaaatgatggctttgccaaggtgcactacggcttcatcctgaaggcccagaacaagattgctgagagcatcccctacctgaaggagggcatcgagagcggggaccctggaacagatgatggccgcttctacttccacctgggagatgccatgcagagggtgggcaacaaggaggcctacaagtggtatgagctgggccacaagaggggccactttgcctctgtgtggcagaggagcctgtacaacgtgaatggcctgaaggcccagccctggtggacccccaaggagaccggctacacagagctggtgaagagcctggagaggaactggaagctgatcagagatgagggcctggccgtgatggacaaggccaagggcctcttcctgcctgaagatgagaacctgcgggagaagggggactggagccagttcaccctgtggcagcagggcagaagaaatgaaaatgcctgcaagggggcccccaagacctgcaccctgctggagaagtttcctgagaccaccggctgccggcggggccagatcaagtacagcatcatgcaccctggcacccacgtgtggccccacacaggccccaccaactgccgcctgaggatgcacctgggcctggtgatccccaaggagggctgcaagatccgctgtgccaatgagaccaagacctgggaggagggcaaggtgctgatctttgatgacagctttgagcacgaggtgtggcaggatgccagcagcttccgcctcatcttcatcgtggatgtgtggcaccctgagctgaccccccagcagaggaggagcctgcctgccatctag

SEQ ID NO: 144191 - DNA, 1032 bp, Artificial Sequence
  Description of Artificial Sequence: Synthetic coding sequence
atgggcagccctggggccagcctgggcatcaagaaggccctgcagagcgagcaggccacagccctgcctgccagcgccccagctgtgtcccagcccacagccccagcccccagctgcctgcccaaggccggccaggtgatccccaccctgctgcgggaggcccccttcagcagcgtcatcgcccccaccctgctgtgtggcttcctgttcctggcctgggtggccgctgaggtgcctgaggagagcagcaggatggccggcagcggggcccggtctgaggagggccggcggcagcacgcctttgtgcctgagccctttgatggagccaacgtggtgcccaacctgtggctgcacagctttgaggtgatcaatgacctgaaccactgggaccacatcaccaagctgcgcttcctgaaggagagcctgcggggggaggccctgggcgtgtacaaccggctgagcccccaggaccagggcgactatggaacagtgaaggaggccctgctgaaggccttcggcgtgcctggagctgcccccagccacctgcccaaggagatcgtgtttgccaacagcatgggcaagggctactacctgaagggcaagattggcaaggtgcctgtgcgcttcctggtggacagcggggcccaggtgtctgtggtgcaccccaacctgtgggaggaggtgacagatggagacctggacaccctgcagccctttgaaaatgtggtgaaggtggccaatggagctgagatgaagatcctgggcgtgtgggacacagctgtgtccctgggcaagctgaagctgaaggcccagttcctggtggccaatgccagcgctgaggaggccatcatcggcacagatgtgctgcaggaccacaatgccatcctggactttgagcacaggacctgcaccctgaagggcaagaagttccggctgctgcctgtgggcggcagcctggaggatgaatttgacctggagctgattgaggaggaccccagcagcgaggagggccggcaggagctgagccactag

SEQ ID NO: 144192 - DNA, 960 bp, Artificial Sequence
  Description of Artificial Sequence: Synthetic coding sequence
atgtgcagcctgcctgtgccccgggagcccctgcggcgggtggccgtgactggaggcacccatggaaatgagatgtctggagtgtacctggcccggcactggctgcacgccccagctgagctgcagagggccagcttctctgctgtgcctgtgctggccaacccagctgccaccagcggctgccgccgctacgtggaccatgacctgaacagaaccttcaccagcagcttcctgaacagccggcccaccccagatgacccctatgaggtgacccgggcccgggagctgaaccagctgctgggccccaaggccagcggccaggcctttgattttgtgctggacctgcacaacaccacagccaacatgggcacctgcctgattgccaagagcagccatgaggtgtttgccatgcacctgtgccgccacctgcagctgcagtacccagagctgagctgccaggtgttcctgtaccagaggtctggagaggagagctacaacctggacagcgtggccaagaatggcctgggcctggagctgggcccccagccccagggcgtgctgcgggctgacatcttcagcaggatgaggaccctggtggccaccgtgctggacttcatcgagctgttcaaccagggcacagccttccctgcctttgagatggaggcctacagacctgtgggcgtggtggacttccccaggacagaggccggccacctggccggcaccgtgcacccccagctgcaggaccgggacttccagcccctgcagcccggggcccccatcttccagatgttcagcggggaggacctgctgtatgaaggagagagcacagtgtaccctgtgttcatcaatgaggccgcctactatgaaaaaggagtggcctttgtgcagacagagaagttcaccttcaccgtgcctgccatgcctgccctgaccccagcccccagccctgccagctag

SEQ ID NO: 144193 - DNA, 1041 bp, Artificial Sequence
  Description of Artificial Sequence: Synthetic coding sequence
atggccaggaagagcaacctgcctgtgctgctggtgcccttcctgctgtgccaggccctggtgcgctgcagcagccccctgcccctggtggtgaacacctggcccttcaagaatgccacagaggccgcctggagggccctggccagcggcggcagcgccctggatgctgtggagagcggctgtgccatgtgtgagcgggagcagtgtgatggctctgtgggctttggaggcagcccagatgagctgggggagaccaccctggatgccatgatcatggatggcaccaccatggatgtgggcgctgtgggggacctgcggcgcatcaagaatgccatcggcgtggccaggaaggtgctggagcacaccacccacaccctgctggtgggggagagcgccaccacctttgcccagagcatgggcttcatcaatgaagacctgagcaccacagccagccaggccctgcacagcgactggctggccaggaactgccagcccaactactggagaaatgtcatcccagaccccagcaagtactgcggcccctacaagcccccaggcatcctgaagcaggacatccccatccacaaggagacagaagatgaccggggccatgacaccatcggcatggtggtgatccacaagacaggccacatcgccgccggcaccagcaccaacggcatcaagttcaagatccacggccgggtgggggacagccccatccctggagctggggcctatgcagatgacacagctggagctgctgctgccactggaaatggagacatcctgatgaggttcctgcccagctaccaggccgtggagtacatgagaagaggagaggaccccaccatcgcctgccagaaggtgatcagccgcatccagaagcacttccctgagttctttggagctgtgatctgtgccaacgtgacaggcagctatggagctgcctgcaacaagctgagcaccttcacccagttctccttcatggtgtacaacagcgagaagaaccagcccacagaggagaaggtggactgcatctag

SEQ ID NO: 144194 - DNA, 573 bp, Artificial Sequence
  Description of Artificial Sequence: Synthetic coding sequence
atggagagccagaggctggagctgatccggctgatggagacccaggaggaggatgtggtgctgctgacagctggggagcacaacaaggcctgcagcctgctgggcaagctgcggctggagtgtgccgacctgctggagacccggggcgtggtgctgcgggaccccaccctcttctccttcctgtgggtggtggacttccccctcttcctgcccaaggaggagaacccccgggagctggagagcgcccaccaccccttcaccgccccccaccccagcgacatccacctgctgtacacagagcccaagaaggaggatgtgaagatgctgagccacctgctgcaggccctggactatggagcccctcctcatggaggcatcgccctgggcctggacaggctcatctgcctggtgacaggcagccccagcatcagagatgtgattgccttccccaagagcttccggggccatgacctgatgagcaacaccccagattctgtgcccccagaggagctgaagccctaccacatccgggtgtccaagcccacagacagcaaggccgagcgggcccactag

SEQ ID NO: 144195 - DNA, 1938 bp, Artificial Sequence
  Description of Artificial Sequence: Synthetic coding sequence
atgtacttccccagctggctgagccagctgtaccggggcctgagccggcccatccggaggaccacccagcccatctggggcagcctgtaccgcagcctgctgcagagcagccagaggcgcatccctgagttcagcagctttgtggtgaggaccaacacctgtggggagctgcggagcagccacctgggccaggaggtgaccctgtgtggctggatccagtaccgccggcagaacaccttcctggtgctgcgggactttgatggcctggtgcaggtgatcatcccccaggatgaatctgctgcctctgtgaagaagatcctgtgtgaggcccctgtggagagcgtggtgcaggtgtctggaacagtcatcagcaggcctgctggccaggagaaccccaagatgcccaccggggagattgagatcaaggtgaagacagctgagctgctgaatgcctgcaagaagctgccctttgagatcaagaactttgtgaagaagacagaggccctgcggctgcagtaccgctacctggacctgcggagcttccagatgcagtacaacctgcggctgcggagccagatggtgatgaagatgagggagtacctgtgcaacctgcacggctttgtggacatcgagacccccaccctcttcaagaggacccctgggggcgccaaggagttcctggtgcccagccgggagcccgggaagttctacagcctgccccagagcccccagcagttcaagcagctgctgatggtgggcggcctggaccgctacttccaggtggcccgctgctacagagatgagggcagcaggccagaccggcagcctgagttcacccagattgatattgagatgagctttgtggaccagacaggcatccagagcctgattgagggcctgctgcagtacagctggcccaatgacaaggaccctgtggtggtgcccttccccaccatgacctttgctgaggtgctggccacctacggcacagacaagccagacaccaggtttggcatgaagatcatcgacatcagtgatgtgttcaggaacacagaaattggcttcctgcaggatgccctgagcaagccccacggcaccgtgaaggccatctgcatccctgagggcgccaagtacctgaagaggaaggacatcgagagcatccggaactttgctgctgaccacttcaaccaggagatcctgcctgtgttcctgaatgccaacagaaactggaacagccctgtggccaacttcatcatggagagccagaggctggagctgatccggctgatggagacccaggaggaggatgtggtgctgctgacagctggggagcacaacaaggcctgcagcctgctgggcaagctgcggctggagtgtgccgacctgctggagacccggggcgtggtgctgcgggaccccaccctcttctccttcctgtgggtggtggacttccccctcttcctgcccaaggaggagaacccccgggagctggagagcgcccaccaccccttcaccgccccccaccccagcgacatccacctgctgtacacagagcccaagaaggcccggagccagcactatgacctggtgctgaatggaaatgagatcggcggcggcagcatccgcatccacaatgctgagctgcagcgctacatcctggccaccctgctgaaggaggatgtgaagatgctgagccacctgctgcaggccctggactatggagccccaccccacggcggcatcgccctgggcctggacaggctcatctgcctggtgacaggcagccccagcatcagagatgtgattgccttccccaagagcttccggggccatgacctgatgagcaacaccccagacagcgtgcccccagaggagctgaagccctaccacatccgggtgtccaagcccacagacagcaaggccgagcgggcccactag

SEQ ID NO: 144196 - DNA, 1143 bp, Artificial Sequence
  Description of Artificial Sequence: Synthetic coding sequence
atgaaggagtatgtgctgctgctcttcctggccctgtgcagcgccaagcccttcttcagccccagccacatcgccctgaagaacatgatgctgaaggacatggaggacacagatgatgatgatgatgatgatgatgatgatgatgatgatgatgaggacaacagcctcttccccacccgggagcccaggagccacttcttcccctttgacctcttccccatgtgccccttcggctgccagtgctacagccgggtggtgcactgcagcgacctgggcctgacctctgtgcccaccaacatcccctttgacaccaggatgctggacctgcagaacaacaagatcaaggagatcaaggaaaatgacttcaagggcctgaccagcctgtatggcctcatcctgaacaacaacaagctgaccaagatccaccccaaggccttcctgaccaccaagaagctgcggcggctgtacctgagccacaaccagctgtctgagatccccctgaacctgcccaagagcctggccgagctgcgcatccacgagaacaaggtgaagaagatccagaaggacaccttcaagggcatgaatgccctgcacgtgctggagatgtctgccaaccccctggacaacaacggcatcgagcccggggcctttgaaggagtgacagtgttccacatcagaattgctgaggccaagctgacctctgtgcccaagggcctgccccccaccctgctggagctgcacctggactacaacaagatcagcacagtggagctggaggacttcaagcgctacaaggagctgcagaggctgggcctgggcaacaacaagatcacagacattgaaaatggcagcctggccaacatcccccgggtgcgggagatccacctggagaacaacaagctgaagaagatccccagcggcctgcctgagctgaagtacctgcagatcatcttcctgcacagcaacagcatcgcccgggtgggcgtgaatgacttctgccccaccgtgcccaagatgaagaagagcctgtacagcgccatcagcctcttcaacaaccctgtgaagtactgggagatgcagcctgccaccttccgctgtgtgctgagcaggatgtctgtgcagctgggcaactttggcatgtag

SEQ ID NO: 144197 - DNA, 732 bp, Artificial Sequence
  Description of Artificial Sequence: Synthetic coding sequence
atgaaggagtatgtgctgctgctcttcctggccctgtgcagcgccaagcccttcttcagccccagccacatcgccctgaagaacatgatgctgaaggacatggaggacacagatgatgatgatgatgatgatgatgatgatgatgatgatgatgaggacaacagcctcttccccacccgggagcccaggagccacttcttcccctttgacctcttccccatgtgccccttcggctgccagtgctacagccgggtggtgcactgcagcgacctgggcctgacctctgtgcccaccaacatcccctttgacaccaggatgctggacctgcagaacaacaagatcaaggagatcaaggaaaatgacttcaagggcctgaccagcctgtatggcctcatcctgaacaacaacaagctgaccaagatccaccccaaggccttcctgaccaccaagaagctgcggcggctgtacctgagccacaaccagctgtctgagatccccctgaacctgcccaagagcctggccgagctgcgcatccacgagaacaaggtgaagaagatccagaaggacaccttcaagggcatgaatgccctgcacgtgctggagatgtctgccaaccccctggacaacaacggcatcgagcccggggcctttgaaggagtgacagtgttccacatcagaattgctgaggccaagctgacctctgtgcccaaggtgaacctgccccagttctag

SEQ ID NO: 144198 - DNA, 243 bp, Artificial Sequence
  Description of Artificial Sequence: Synthetic coding sequence
atgatgctgaaggacatggaggacacagatgatgatgatgatgatgatgatgatgatgatgatgatgatgaggacaacagcctcttccccacccgggagcccaggagccacttcttcccctttgacctcttccccatgtgccccttcggctgccagtgctacagccgggtggtgcactgcagcgacctgggcctgacctctgtgcccaccaacatccccctcatcctggagtgcctgatctag

SEQ ID NO: 144199 - DNA, 732 bp, Artificial Sequence
  Description of Artificial Sequence: Synthetic coding sequence
atgaaggagtatgtgctgctgctcttcctggccctgtgcagcgccaagcccttcttcagccccagccacatcgccctgaagaacatgatgctgaaggacatggaggacacagatgatgatgatgatgatgatgatgatgatgatgatgatgatgaggacaacagcctcttccccacccgggagcccaggagccacttcttcccctttgacctcttccccatgtgccccttcggctgccagtgctacagccgggtggtgcactgcagcgacctgggcctgacctctgtgcccaccaacatcccctttgacaccaggatgctggacctgcagaacaacaagatcaaggagatcaaggaaaatgacttcaagggcctgaccagcctgtatggcctcatcctgaacaacaacaagctgaccaagatccaccccaaggccttcctgaccaccaagaagctgcggcggctgtacctgagccacaaccagctgtctgagatccccctgaacctgcccaagagcctggccgagctgcgcatccacgagaacaaggtgaagaagatccagaaggacaccttcaagggcatgaatgccctgcacgtgctggagatgtctgccaaccccctggacaacaacggcatcgagcccggggcctttgaaggagtgacagtgttccacatcagaattgctgaggccaagctgacctctgtgcccaaggacaacctgcccagcttctag

SEQ ID NO: 144200 - DNA, 3885 bp, Artificial Sequence
  Description of Artificial Sequence: Synthetic coding sequence
atggccctggccggcctgtgtgccctgctggcctgctgctggggccctgctgctgtgctggccacagctgctggagatgtggaccccagcaaggagctggagtgcaagctgaagagcatcaccgtgtctgccctgcccttcctgcgggagaatgacctgagcatcatgcacagccccagcgccagcgagcccaagctgctcttctctgtgagaaatgacttccctggagagatggtggtggtggatgacctggagaacacagagctgccctactttgtgctggagatcagcggcaacacagaggacatccccctggtgcgctggaggcagcagtggctggagaatggcaccctgctcttccacatccaccaccaggatggagcccccagcctgcccggccaggaccccacagaggagccccagcacgagagcgctgaggaggagctgcgcatcctgcacatctctgtgatgggcggcatgattgccctgctgctgagcatcctgtgcctggtgatgatcctgtacacccggcggcgctggtgcaagagaagaagagtgccccagccccagaagagcgccagcgctgaggccgccaatgagatccactacatccccagcgtgctgattggaggccacggccgggagagcctgagaaatgcccgggtgcagggccacaacagcagcggcaccctgagcatccgggagacccccatcctggatggctatgaatatgacatcacagacctgcggcaccacctgcagcgggagtgcatgaatggaggagaggactttgccagccaggtgaccaggaccctggacagcctgcagggctgcaatgagaagagcggcatggacctgaccccaggcagtgacaatgccaagctgagcctgatgaacaagtacaaggacaacatcatcgccaccagccctgtggacagcaaccaccagcaggccaccctgctgagccacaccagcagcagccagaggaagaggatcaacaacaaggcccgggccggcagcgccttcctgaaccctgagggggacagcggcacagaagcagaaaatgacccccagctgaccttctacacagaccccagccgcagcagaagaagaagccgggtgggcagccccaggagccctgtgaacaagaccaccctgaccctcatcagcatcaccagctgtgtgattggcctggtgtgcagcagccacgtgaactgccccctggtggtgaagatcaccctgcacgtgcctgagcacctgattgctgatggcagccgcttcatcctgctggagggcagccagctggatgccagtgactggctgaacccagcccaggtggtgctcttcagccagcagaacagcagcggcccctgggccatggacctgtgtgcccggcggctgctggacccctgtgagcaccagtgtgaccctgagactggagaatgtctgtgctatgagggctacatgaaggaccctgtgcacaagcacctgtgcatcagaaatgagtggggcaccaaccagggcccctggccctacaccatcttccagaggggctttgacctggtgctgggggagcagcccagcgacaagatcttccgcttcacctacaccctgggggagggcatgtggctgcccctgagcaagagctttgtgattcctcctgctgagctggccatcaaccccagcgccaagtgcaagacagacatgacagtgatggaggatgctgtggaggtgcgggaggagctgatgaccagcagcagctttgacagcctggaggtgctgctggacagctttggacctgtgcgggactgcagcaaggacaatggaggctgcagcaagaacttccgctgcatcagtgacaggaagctggacagcacaggctgtgtgtgccccagcggcctgagccccatgaaggacagcagcggctgctatgacagacacatcggcgtggactgcagtgatggcttcaatggaggctgtgagcagctgtgcctgcagcagatggcccccttcccagatgaccccaccctgtacaacatcctgatgttctgtggctgcatcgaggactacaagctgggcgtggatggccgcagctgccagctgatcacagagacctgcccagagggcagtgactgtggggagagccgggagctgcccatgaaccagaccctgtttggagagatgttcttcggctacaacaaccacagcaaggaggtggccgccggccaggtgctgaagggcaccttccggcagaacaactttgcccggggcctggaccagcagctgcctgatggcctggtggtggccaccgtgcccctggagaaccagtgcctggaggagatcagcgagcccaccccagaccctgacttcctgaccggcatggtgaacttcagcgaggtgtctggctaccctgtgctgcagcactggaaggtgcgctctgtgatgtaccacatcaagctgaaccaggtggccatcagccaggccctgagcaatgccctgcacagcctggatggagccaccagcagagctgactttgtggccctgctggaccagtttggaaaccactacatccaggaggccatctacggctttgaggagagctgcagcatctggtaccccaacaagcaggtgcagaggcggctgtggctggagtatgaggacatcagcaagggcaacagccccagtgatgagagcgaggagcgggagcgggaccccaaggtgctgaccttccctgagtacatcaccagcctgagtgacagcggcaccaagcacatggctgctggggtgaggatggagtgccacagcaagggccgctgccccagcagctgccccctgtgccacgtgaccagcagcccagacaccccagctgagcctgtgctgctggaggtgaccaaggccgcccccatctatgagctggtgaccaacaaccagacccagaggctgctgcaggaggccaccatgagcagcctgtggtgcagcggcactggagatgtgattgaggactggtgccgctgtgacagcacagccttcggggctgatggcctgcccacctgtgcccccctgccccagcctgtgctgcggctgagcacagtgcatgagcccagcagcaccctggtggtgctggagtgggagcacagcgagccccccatcggcgtgcagatcgtggactacctgctgcggcaggagaaggtgacagacaggatggaccacagcaaggtggagacagaaacagtgctgagctttgtggatgacatcatcagcggggccaagagcccctgtgccatgcccagccaggtgcctgacaagcagctgaccaccatcagcctcatcatccgctgcctggagccagacaccatctacatgttcaccctgtggggcgtggacaacacaggccgccgcagccggcccagtgatgtgattgtgaagaccccctgccctgtggtggatgatgtgaaggcccaggagattgctgacaagatctacaacctcttcaacggctacaccagcggcaaggagcagcagacagcctacaacaccctgctggacctgggcagccccaccctgcaccgggtgctgtaccactacaaccagcactatgagagctttggagagttcacctggaggtgtgaagatgagctgggccccaggaaggccggcctcatcctgagccagctgggggacctgagctcctggtgcaatggcctgctgcaggagcccaagatcagcctgcggcgcagcagcctgaagtacctgggctgccgctacagcgagatcaagccctacggcctggactgggccgagctgagccgggacctgaggaagacctgtgaggagcagaccctgagcatcccctacaatgactatggagacagcaaggagatctag

SEQ ID NO: 144201 - DNA, 3909 bp, Artificial Sequence
  Description of Artificial Sequence: Synthetic coding sequence
atggccctggccggcctgtgtgccctgctggcctgctgctggggccctgctgctgtgctggccacagctgctggagatgtggaccccagcaaggagctggagtgcaagctgaagagcatcaccgtgtctgccctgcccttcctgcgggagaatgacctgagcatcatgcacagccccagcgccagcgagcccaagctgctcttctctgtgagaaatgacttccctggagagatggtggtggtggatgacctggagaacacagagctgccctactttgtgctggagatcagcggcaacacagaggacatccccctggtgcgctggaggcagcagtggctggagaatggcaccctgctcttccacatccaccaccaggatggagcccccagcctgcccggccaggaccccacagaggagccccagcacgagagcgctgaggaggagctgcgcatcctgcacatctctgtgatgggcggcatgattgccctgctgctgagcatcctgtgcctggtgatgatcctgtacacccggcggcgctggtgcaagagaagaagagtgccccagccccagaagagcgccagcgctgaggccgccaatgagatccactacatccccagcgtgctgattggaggccacggccgggagagcctgagaaatgcccgggtgcagggccacaacagcagcggcaccctgagcatccgggagacccccatcctggatggctatgaatatgacatcacagacctgcggcaccacctgcagcgggagtgcatgaatggaggagaggactttgccagccaggtgaccaggaccctggacagcctgcagggctgcaatgagaagagcggcatggacctgaccccaggcagtgacaatgccaagctgagcctgatgaacaagtacaaggacaacatcatcgccaccagccctgtggacagcaaccaccagcaggccaccctgctgagccacaccagcagcagccagaggaagaggatcaacaacaaggcccgggccggcagcgccttcctgaaccctgagggggacagcggcacagaagcagaaaatgacccccagctgaccttctacacagaccccagccgcagcagaagaagaagccgggtgggcagccccaggagccctgtgaacaagaccaccctgaccctcatcagcatcaccagctgtgtgattggcctggtgtgcagcagccacgtgaactgccccctggtggtgaagatcaccctgcacgtgcctgagcacctgattgctgatggcagccgcttcatcctgctggagggcagccagctggatgccagtgactggctgaacccagcccaggtggtgctcttcagccagcagaacagcagcggcccctgggccatggacctgtgtgcccggcggctgctggacccctgtgagcaccagtgtgaccctgagactggaagaagagagcacagagctgctggagaatgtctgtgctatgagggctacatgaaggaccctgtgcacaagcacctgtgcatcagaaatgagtggggcaccaaccagggcccctggccctacaccatcttccagaggggctttgacctggtgctgggggagcagcccagcgacaagatcttccgcttcacctacaccctgggggagggcatgtggctgcccctgagcaagagctttgtgattcctcctgctgagctggccatcaaccccagcgccaagtgcaagacagacatgacagtgatggaggatgctgtggaggtgcgggaggagctgatgaccagcagcagctttgacagcctggaggtgctgctggacagctttggacctgtgcgggactgcagcaaggacaatggaggctgcagcaagaacttccgctgcatcagtgacaggaagctggacagcacaggctgtgtgtgccccagcggcctgagccccatgaaggacagcagcggctgctatgacagacacatcggcgtggactgcagtgatggcttcaatggaggctgtgagcagctgtgcctgcagcagatggcccccttcccagatgaccccaccctgtacaacatcctgatgttctgtggctgcatcgaggactacaagctgggcgtggatggccgcagctgccagctgatcacagagacctgcccagagggcagtgactgtggggagagccgggagctgcccatgaaccagaccctgtttggagagatgttcttcggctacaacaaccacagcaaggaggtggccgccggccaggtgctgaagggcaccttccggcagaacaactttgcccggggcctggaccagcagctgcctgatggcctggtggtggccaccgtgcccctggagaaccagtgcctggaggagatcagcgagcccaccccagaccctgacttcctgaccggcatggtgaacttcagcgaggtgtctggctaccctgtgctgcagcactggaaggtgcgctctgtgatgtaccacatcaagctgaaccaggtggccatcagccaggccctgagcaatgccctgcacagcctggatggagccaccagcagagctgactttgtggccctgctggaccagtttggaaaccactacatccaggaggccatctacggctttgaggagagctgcagcatctggtaccccaacaagcaggtgcagaggcggctgtggctggagtatgaggacatcagcaagggcaacagccccagtgatgagagcgaggagcgggagcgggaccccaaggtgctgaccttccctgagtacatcaccagcctgagtgacagcggcaccaagcacatggctgctggggtgaggatggagtgccacagcaagggccgctgccccagcagctgccccctgtgccacgtgaccagcagcccagacaccccagctgagcctgtgctgctggaggtgaccaaggccgcccccatctatgagctggtgaccaacaaccagacccagaggctgctgcaggaggccaccatgagcagcctgtggtgcagcggcactggagatgtgattgaggactggtgccgctgtgacagcacagccttcggggctgatggcctgcccacctgtgcccccctgccccagcctgtgctgcggctgagcacagtgcatgagcccagcagcaccctggtggtgctggagtgggagcacagcgagccccccatcggcgtgcagatcgtggactacctgctgcggcaggagaaggtgacagacaggatggaccacagcaaggtggagacagaaacagtgctgagctttgtggatgacatcatcagcggggccaagagcccctgtgccatgcccagccaggtgcctgacaagcagctgaccaccatcagcctcatcatccgctgcctggagccagacaccatctacatgttcaccctgtggggcgtggacaacacaggccgccgcagccggcccagtgatgtgattgtgaagaccccctgccctgtggtggatgatgtgaaggcccaggagattgctgacaagatctacaacctcttcaacggctacaccagcggcaaggagcagcagacagcctacaacaccctgctggacctgggcagccccaccctgcaccgggtgctgtaccactacaaccagcactatgagagctttggagagttcacctggaggtgtgaagatgagctgggccccaggaaggccggcctcatcctgagccagctgggggacctgagctcctggtgcaatggcctgctgcaggagcccaagatcagcctgcggcgcagcagcctgaagtacctgggctgccgctacagcgagatcaagccctacggcctggactgggccgagctgagccgggacctgaggaagacctgtgaggagcagaccctgagcatcccctacaatgactatggagacagcaaggagatctag

SEQ ID NO: 144202 - DNA, 3651 bp, Artificial Sequence
  Description of Artificial Sequence: Synthetic coding sequence
atggccctggccggcctgtgtgccctgctggcctgctgctggggccctgctgctgtgctggccacagctgctggagatgtggaccccagcaaggagctggagtgcaagctgaagagcatcaccgtgtctgccctgcccttcctgcgggagaatgacctgagcatcatgcacagccccagcgccagcgagcccaagctgctcttctctgtgagaaatgacttccctggagagatggtggtggtggatgacctggagaacacagagctgccctactttgtgctggagatcagcggcaacacagaggacatccccctggtgcgctggaggcagcagtggctggagaatggcaccctgctcttccacatccaccaccaggatggagcccccagcctgcccggccaggaccccacagaggagccccagcacgagagcgctgaggaggagctgcgcatcctgcacatctctgtgatgggcggcatgattgccctgctgctgagcatcctgtgcctggtgatgatcctgtacacccggcggcgctggtgcaagagaagaagagtgccccagccccagaagagcgccagcgctgaggccgccaatgagatccactacatccccagcgtgctgattggaggccacggccgggagagcctgagaaatgcccgggtgcagggccacaacagcagcggcaccctgagcatccgggagacccccatcctggatggctatgaatatgacatcacagacctgcggcaccacctgcagcgggagtgcatgaatggaggagaggactttgccagccaggtgaccaggaccctggacagcctgcagggctgcaatgagaagagcggcatggacctgaccccaggcagtgacaatgccaagctgagcctgatgaacaagtacaaggacaacatcatcgccaccagccctgtggacagcaaccaccagcaggccaccctgctgagccacaccagcagcagccagaggaagaggatcaacaacaaggcccgggccggcagcgccttcctgaaccctgagggggacagcggcacagaagcagaaaatgacccccagctgaccttctacacagaccccagccgcagcagaagaagaagccgggtgggcagccccaggagccctgtgaacaagaccaccctgaccctcatcagcatcaccagctgtgtgattggcctggtgtgcagcagccacgtgaactgccccctggtggtgaagatcaccctgcacgtgcctgagcacctgattgctgatggcagccgcttcatcctgctggagggcagccagctggatgccagtgactggctgaacccagcccaggtggtgctcttcagccagcagaacagcagcggcccctgggccatggacctgtgtgcccggcggctgctggacccctgtgagcaccagtgtgaccctgagactggagaatgtctgtgctatgagggctacatgaaggaccctgtgcacaagcacctgtgcatcagaaatgagtggggcaccaaccagggcccctggccctacaccatcttccagaggggctttgacctggtgctgggggagcagcccagcgacaagatcttccgcttcacctacaccctgggggagggcatgtggctgcccctgagcaagagctttgtgattcctcctgctgagctggccatcaaccccagcgccaagtgcaagacagacatgacagtgatggaggatgctgtggaggtgcgggaggagctgatgaccagcagcagctttgacagcctggaggtgctgctggacagctttggacctgtgcgggactgcagcaaggacaatggaggctgcagcaagaacttccgctgcatcagtgacaggaagctggacagcacaggctgtgtgtgccccagcggcctgagccccatgaaggacagcagcggctgctatgacagacacatcggcgtggactgcagtgatggcttcaatggaggctgtgagcagctgtgcctgcagcagatggcccccttcccagatgaccccaccctgtacaacatcctgatgttctgtggctgcatcgaggactacaagctgggcgtggatggccgcagctgccagctgatcacagagacctgcccagagggcagtgactgtggggagagccgggagctgcccatgaaccagaccctgtttggagagatgttcttcggctacaacaaccacagcaaggaggtggccgccggccaggtgctgaagggcaccttccggcagaacaactttgcccggggcctggaccagcagctgcctgatggcctggtggtggccaccgtgcccctggagaaccagtgcctggaggagatcagcgagcccaccccagaccctgacttcctgaccggcatggtgaacttcagcgaggtgtctggctaccctgtgctgcagcactggaaggtgcgctctgtgatgtaccacatcaagctgaaccaggtggccatcagccaggccctgagcaatgccctgcacagcctggatggagccaccagcagagctgactttgtggccctgctggaccagtttggaaaccactacatccaggaggccatctacggctttgaggagagctgcagcatctggtaccccaacaagcaggtgcagaggcggctgtggctggagtatgaggacatcagcaagggcaacagccccagtgatgagagcgaggagcgggagcgggaccccaaggtgctgaccttccctgagtacatcaccagcctgagtgacagcggcaccaagcacatggctgctggggtgaggatggagtgccacagcaagggccgctgccccagcagctgccccctgtgccacgtgaccagcagcccagacaccccagctgagcctgtgctgctggaggtgaccaaggccgcccccatctatgagctggtgaccaacaaccagacccagaggctgctgcaggaggccaccatgagcagcctgtggtgcagcggcactggagatgtgattgaggactggtgccgctgtgacagcacagccttcggggctgatggcctgcccacctgtgcccccctgccccagcctgtgctgcggctgagcacagtgcatgagcccagcagcaccctggtggtgctggagtgggagcacagcgagccccccatcggcgtgcagatcgtggactacctgctgcggcaggagaaggtgacagacaggatggaccacagcaaggtggagacagaaacagtgctgagctttgtggatgacatcatcagcggggccaagagcccctgtgccatgcccagccaggtgcctgacaagcagctgaccaccatcagcctcatcatccgctgcctggagccagacaccatctacatgttcaccctgtggggcgtggacaacacaggccgccgcagccggcccagtgatgtgattgtgaagaccccctgccctgtggtggatgatgtgaaggcccaggagattgctgacaagatctacaacctcttcaacggctacaccagcggcaaggagcagcagacagcctacaacaccctgctggacctgggcagccccaccctgcaccgggtgctgtaccactacaaccagcactatgagagctttggagagttcacctggaggtgtgaagatgagctgggccccaggtag

SEQ ID NO: 144203 - DNA, 3657 bp, Artificial Sequence
  Description of Artificial Sequence: Synthetic coding sequence
atggccctggccggcctgtgtgccctgctggcctgctgctggggccctgctgctgtgctggccacagctgctggagatgtggaccccagcaaggagctggagtgcaagctgaagagcatcaccgtgtctgccctgcccttcctgcgggagaatgacctgagcatcatgcacagccccagcgccagcgagcccaagctgctcttctctgtgagaaatgacttccctggagagatggtggtggtggatgacctggagaacacagagctgccctactttgtgctggagatcagcggcaacacagaggacatccccctggtgcgctggaggcagcagtggctggagaatggcaccctgctcttccacatccaccaccaggatggagcccccagcctgcccggccaggaccccacagaggagccccagcacgagagcgctgaggaggagctgcgcatcctgcacatctctgtgatgggcggcatgattgccctgctgctgagcatcctgtgcctggtgatgatcctgtacacccggcggcgctggtgcaagagaagaagagtgccccagccccagaagagcgccagcgctgaggccgccaatgagatccactacatccccagcgtgctgattggaggccacggccgggagagcctgagaaatgcccgggtgcagggccacaacagcagcggcaccctgagcatccgggagacccccatcctggatggctatgaatatgacatcacagacctgcggcaccacctgcagcgggagtgcatgaatggaggagaggactttgccagccaggtgaccaggaccctggacagcctgcagggctgcaatgagaagagcggcatggacctgaccccaggcagtgacaatgccaagctgagcctgatgaacaagtacaaggacaacatcatcgccaccagccctgtggacagcaaccaccagcaggccaccctgctgagccacaccagcagcagccagaggaagaggatcaacaacaaggcccgggccggcagcgccttcctgaaccctgagggggacagcggcacagaagcagaaaatgacccccagctgaccttctacacagaccccagccgcagcagaagaagaagccgggtgggcagccccaggagccctgtgaacaagaccaccctgaccctcatcagcatcaccagctgtgtgattggcctggtgtgcagcagccacgtgaactgccccctggtggtgaagatcaccctgcacgtgcctgagcacctgattgctgatggcagccgcttcatcctgctggagggcagccagctggatgccagtgactggctgaacccagcccaggtggtgctcttcagccagcagaacagcagcggcccctgggccatggacctgtgtgcccggcggctgctggacccctgtgagcaccagtgtgaccctgagactggagaatgtctgtgctatgagggctacatgaaggaccctgtgcacaagcacctgtgcatcagaaatgagtggggcaccaaccagggcccctggccctacaccatcttccagaggggctttgacctggtgctgggggagcagcccagcgacaagatcttccgcttcacctacaccctgggggagggcatgtggctgcccctgagcaagagctttgtgattcctcctgctgagctggccatcaaccccagcgccaagtgcaagacagacatgacagtgatggaggatgctgtggaggtgcgggaggagctgatgaccagcagcagctttgacagcctggaggtgctgctggacagctttggacctgtgcgggactgcagcaaggacaatggaggctgcagcaagaacttccgctgcatcagtgacaggaagctggacagcacaggctgtgtgtgccccagcggcctgagccccatgaaggacagcagcggctgctatgacagacacatcggcgtggactgcagtgatggcttcaatggaggctgtgagcagctgtgcctgcagcagatggcccccttcccagatgaccccaccctgtacaacatcctgatgttctgtggctgcatcgaggactacaagctgggcgtggatggccgcagctgccagctgatcacagagacctgcccagagggcagtgactgtggggagagccgggagctgcccatgaaccagaccctgtttggagagatgttcttcggctacaacaaccacagcaaggaggtggccgccggccaggtgctgaagggcaccttccggcagaacaactttgcccggggcctggaccagcagctgcctgatggcctggtggtggccaccgtgcccctggagaaccagtgcctggaggagatcagcgagcccaccccagaccctgacttcctgaccggcatggtgaacttcagcgaggtgtctggctaccctgtgctgcagcactggaaggtgcgctctgtgatgtaccacatcaagctgaaccaggtggccatcagccaggccctgagcaatgccctgcacagcctggatggagccaccagcagagctgactttgtggccctgctggaccagtttggaaaccactacatccaggaggccatctacggctttgaggagagctgcagcatctggtaccccaacaagcaggtgcagaggcggctgtggctggagtatgaggacatcagcaagggcaacagccccagtgatgagagcgaggagcgggagcgggaccccaaggtgctgaccttccctgagtacatcaccagcctgagtgacagcggcaccaagcacatggctgctggggtgaggatggagtgccacagcaagggccgctgccccagcagctgccccctgtgccacgtgaccagcagcccagacaccccagctgagcctgtgctgctggaggtgaccaaggccgcccccatctatgagctggtgaccaacaaccagacccagaggctgctgcaggaggccaccatgagcagcctgtggtgcagcggcactggagatgtgattgaggactggtgccgctgtgacagcacagccttcggggctgatggcctgcccacctgtgcccccctgccccagcctgtgctgcggctgagcacagtgcatgagcccagcagcaccctggtggtgctggagtgggagcacagcgagccccccatcggcgtgcagatcgtggactacctgctgcggcaggagaaggtgacagacaggatggaccacagcaaggtggagacagaaacagtgctgagctttgtggatgacatcatcagcggggccaagagcccctgtgccatgcccagccaggtgcctgacaagcagctgaccaccatcagcctcatcatccgctgcctggagccagacaccatctacatgttcaccctgtggggcgtggacaacacaggccgccgcagccggcccagtgatgtgattgtgaagaccccctgccctgtggtggatgatgtgaaggcccaggagattgctgacaagatctacaacctcttcaacggctacaccagcggcaaggagcagcagacagcctacaacaccctgctggacctgggcagccccaccctgcaccgggtgctgtaccactacaaccagcactatgagagctttggagagttcacctggaggtgtgaagatgagctgggccccaggaaccagtag

SEQ ID NO: 144204 - DNA, 1323 bp, Artificial Sequence
  Description of Artificial Sequence: Synthetic coding sequence
atgaacaccctgctgtgcaagggcatgttctgcctgctgtcctgggaggccgacagccggggccgcctgggggagtacaccctgcagcccctgagcctgcagacagaggagaccacagagctgggcagcaagaaggagctgaagtccatgcccttcatcacctacctgagcggcctgctgacagcccagatgctgagtgatgaccagctgatcagcggcgtggagatccgctgtgaggagaagggccgctgccccagcacctgccacctgtgccggcggcctgggaaggagcagctgagccccacccctgtgctgctggagatcaacagagtggtgcccctgtacaccctcatccaggacaatggcaccaaggaggccttcaagagcgccctgatgagcagctactggtgcagcgggaaaggagatgtgattgatgactggtgccgctgtgacctgagcgcctttgatgccaacggcctgcccaactgcagccccctgctgcagcctgtgctgcggctgagccccaccgtggagcccagcagcacagtggtgtccctggagtgggtggatgtgcagcctgccatcggcaccaaggtgtctgactacatcctgcagcacaagaaggtggatgagtacacagacacagacctgtacacaggagagttcctgagctttgctgatgacctgctgagcggcctgggcaccagctgtgtggccgccggccgcagccacggggaggtgcctgaggtgtccatctacagcgtcatcttcaagtgcctggagccagatggcctgtacaagttcaccctgtatgctgtggacacccggggccgccacagcgagctgagcacagtgaccctgaggacagcctgccccctggtggatgacaacaaggccgaggagattgctgacaagatctacaacctgtacaacggctacaccagcggcaaggagcagcagatggcctacaacaccctgatggaggtgtctgcctccatgctgttccgggtgcagcaccactacaacagccactatgagaagtttggagactttgtgtggaggagtgaagatgagctgggccccaggaaggcccacctgatcctgcggcggctggagcgggtgagcagccactgcagcagcctgctgcggagcgcctacatccagagccgggtggagaccgtgccctacctgttctgccgctctgaggaggtgcggcctgctggcatggtgtggtacagcatcctgaaggacaccaagatcacctgtgaggagaagatggtgtccatggccaggaacacctacggggagagcaagggccgctag

SEQ ID NO: 144205 - DNA, 4020 bp, Artificial Sequence
  Description of Artificial Sequence: Synthetic coding sequence
atggctgctgctggggcccggctgagccctggccctggcagcggcctgcggggccggccccggctgtgcttccaccctggccccccacccctgctgcccctgctgctgctcttcctgctgctgctgcccccaccacccctgctggccggggccacagctgctgccagccgggagccagacagcccctgccgcctgaagacagtgacagtgtccaccctgcctgccctgcgggagagtgacatcggctggagcggggcccgggccggggccggggccggcaccggggccggggctgctgctgctgctgccagccctggcagccctggcagcgctggaacagctgctgagagccggctgctgctgtttgtgagaaatgagctgcccggcagaattgctgtgcaggatgacctggacaacacagagctgcccttcttcaccctggagatgagcggcacagctgctgacatcagcctggtgcactggaggcagcagtggctggagaatggcaccctgtacttccacgtgtccatgagcagcagcggccagctggcccaggccacagcccccaccctgcaggagcccagcgagatcgtggaggagcagatgcacatcctgcacatctctgtgatgggcggcctcatcgccctgctgctgctgctgctggtgttcaccgtggccctgtatgcccagaggcgctggcagaagagaagacgcatcccccagaagagcgccagcacagaggccacccatgagatccactacatccccagcgtgctgctgggcccccaggcccgggagagcttccgcagcagccggctgcagacccacaacagcgtcatcggcgtgcccatccgggagacccccatcctggatgattatgactgtgaagaagatgaggagcccccaagaagagccaaccacgtgtccagagaagatgaatttggcagccaggtgacccacaccctggacagcctgggccaccctggagaggagaaggtggactttgagaagaaggctgctgctgaggccacccaggagaccgtggagagcctgatgcagaagttcaaggagagcttccgggccaacacccccattgaaattggccagctgcagccccccctgcggagcaccagcgctgggaagaggaagaggaggagcaagagccggggcggcatcagctttggccgggccaagggcaccagcggcagcgaggctgatgatgagacccagctgaccttctacacagagcagtaccgcagcagaagaagaagcaagggcctgctgaagagccctgtgaacaagacagccctgaccctgattgctgtgagcagctgcatcctggccatggtgtgtggcagccagatgagctgccccctgactgtgaaggtgaccctgcacgtgcctgagcacttcatcgcagatggcagcagctttgtggtgtctgagggcagctacctggacatcagtgactggctgaacccagccaagctgagcctgtactaccagatcaatgccaccagcccctgggtgcgggacctgtgtggccagaggaccacagatgcctgtgagcagctgtgtgaccctgagaccggggagtgcagctgccacgagggctacgccccagaccctgtgcaccgccacctgtgtgtgcggagtgactggggccagagcgagggcccctggccctacaccaccctggagcggggctatgacctggtgactggagagcaggcccctgagaagatcctgcggagcaccttcagcctgggccagggcctgtggctgcctgtgtccaagagctttgtggtgccccctgtggagctgagcatcaaccccctggccagctgcaagacagatgtgctggtgacagaggaccctgcagatgtgcgggaggaggccatgctgagcacctactttgagaccatcaatgacctgctgagcagctttggacctgtgcgggactgcagcagaaataatggaggctgcaccaggaacttcaagtgtgtgtctgaccggcaggtggacagcagcggctgtgtgtgcccagaggagctgaagcccatgaaggatggcagcggctgctatgaccacagcaaaggaattgactgcagtgatggcttcaacggcggctgtgagcagctgtgcctgcagcagaccctgcccctgccctatgatgccaccagcagcaccatcttcatgttctgtggctgtgtggaggagtacaagctggccccagatggcaagagctgcctgatgctgagtgatgtgtgtgagggccccaagtgcctgaagccagacagcaagttcaatgacaccctgtttggagagatgctgcacggctacaacaacagaacccagcacgtgaaccagggccaggtgttccagatgaccttccgggagaacaacttcatcaaggacttcccccagctggctgatggcctgctggtgatccccctgcctgtggaggagcagtgccggggcgtgctgtctgagcccctgcctgacctgcagctgctgaccggggacatccgctatgatgaggccatgggctaccccatggtgcagcagtggagggtgcgcagcaacctgtacagagtgaagctgagcaccatcaccctggccgccggcttcaccaacgtgctgaagatcctgaccaaggagagcagccgggaggagctgctgtccttcatccagcactacggcagccactacatcgccgaggccctgtatggcagcgagctgacctgcatcatccacttccccagcaagaaggtgcagcagcagctgtggctgcagtaccagaaggagaccacagagctgggcagcaagaaggagctgaagtccatgcccttcatcacctacctgagcggcctgctgacagcccagatgctgagtgatgaccagctgatctctggagtggagatccgctgtgaggagaagggccgctgccccagcacctgccacctgtgcagaagacctgggaaggagcagctgagccccacccctgtgctgctggagatcaacagagtggtgcccctgtacaccctcatccaggacaatggcaccaaggaggccttcaagagcgccctgatgagcagctactggtgcagcgggaaaggagatgtgattgatgactggtgccgctgtgacctgagcgcctttgatgccaacggcctgcccaactgcagccccctgctgcagcctgtgctgcggctgagccccaccgtggagcccagcagcacagtggtgtccctggagtgggtggatgtgcagcctgccatcggcaccaaggtgtctgactacatcctgcagcacaagaaggtggatgagtacacagacacagacctgtacaccggggagttcctgagctttgctgatgacctgctgagcggcctgggcaccagctgtgtggccgccggccgcagccatggagaggtgcctgaggtgtccatctacagcgtcatcttcaagtgcctggagccagatggcctgtacaagttcaccctgtatgctgtggacacccggggccgccacagcgagctgagcacagtgaccctgaggacagcctgccccctggtggatgacaacaaggccgaggagattgctgacaagatctacaacctgtacaacggctacaccagcggcaaggagcagcagatggcctacaacaccctgatggaggtgtctgcctccatgctgttccgggtgcagcaccactacaacagccactatgagaagtttggagactttgtgtggaggagtgaagatgagctgggccccaggaaggcccacctgatcctgcggcggctggagcgggtgagcagccactgcagcagcctgctgcggagcgcctacatccagagccgggtggagaccgtgccctacctgttctgccgctctgaggaggtgcggcctgctggcatggtgtggtacagcatcctgaaggacaccaagatcacctgtgaggagaagatggtgtccatggccaggaacacctatggagagagcaaaggaagatag

SEQ ID NO: 144206 - DNA, 1188 bp, Artificial Sequence
  Description of Artificial Sequence: Synthetic coding sequence
atgcccttcatcacctacctgagcggcctgctgacagcccagatgctgagtgatgaccagctgatctctggagtggagatccgctgtgaggagaagggccgctgccccagcacctgccacctgtgcagaagacctgggaaggagcagctgagccccacccctgtgctgctggagatcaacagagtggtgcccctgtacaccctcatccaggacaatggcaccaaggaggccttcaagagcgccctgatgagcagctactggtgcagcgggaaaggagatgtgattgatgactggtgccgctgtgacctgagcgcctttgatgccaacggcctgcccaactgcagccccctgctgcagcctgtgctgcggctgagccccaccgtggagcccagcagcacagtggtgtccctggagtgggtggatgtgcagcctgccatcggcaccaaggtgtctgactacatcctgcagcacaagaaggtggatgagtacacagacacagacctgtacaccggggagttcctgagctttgctgatgacctgctgagcggcctgggcaccagctgtgtggccgccggccgcagccatggagaggtgcctgaggtgtccatctacagcgtcatcttcaagtgcctggagccagatggcctgtacaagttcaccctgtatgctgtggacacccggggccgccacagcgagctgagcacagtgaccctgaggacagcctgccccctggtggatgacaacaaggccgaggagattgctgacaagatctacaacctgtacaacggctacaccagcggcaaggagcagcagatggcctacaacaccctgatggaggtgtctgcctccatgctgttccgggtgcagcaccactacaacagccactatgagaagtttggagactttgtgtggaggagtgaagatgagctgggccccaggaaggcccacctgatcctgcggcggctggagcgggtgagcagccactgcagcagcctgctgcggagcgcctacatccagagccgggtggagaccgtgccctacctgttctgccgctctgaggaggtgcggcctgctggcatggtgtggtacagcatcctgaaggacaccaagatcacctgtgaggagaagatggtgtccatggccaggaacacctactacctgaccctgagcaaggtgagccccttctag

SEQ ID NO: 144207 - DNA, 585 bp, Artificial Sequence
  Description of Artificial Sequence: Synthetic coding sequence
atgcccttcatcacctacctgagcggcctgctgacagcccagatgctgagtgatgaccagctgatctctggagtggagatccgctgtgaggagaagggccgctgccccagcacctgccacctgtgcagaagacctgggaaggagcagctgagccccacccctgtgctgctggagatcaacagagtggtgcccctgtacaccctcatccaggacaatggcaccaaggaggccttcaagagcgccctgatgagcagctactggtgcagcgggaaaggagatgtgattgatgactggtgccgctgtgacctgagcgcctttgatgccaacggcctgcccaactgcagccccctgctgcagcctgtgctgcggctgagccccaccgtggagcccagcagcacagtggtgtccctggagtgggtggatgtgcagcctgccatcggcaccaaggtgtctgactacatcctgcagcacaagaaggtggatgagtacacagacacagacctgtacacagtgtactgctggatcaccttcatcgacctgcgcatcctgaaccagccctgcatccctggcatgaagcccacctag

SEQ ID NO: 144208 - DNA, 3867 bp, Artificial Sequence
  Description of Artificial Sequence: Synthetic coding sequence
atggctgctgctggggcccggctgagccctggccctggcagcggcctgcggggccggccccggctgtgcttccaccctggccccccacccctgctgcccctgctgctgctcttcctgctgctgctgcccccaccacccctgctggccggggccacagctgctgccagccgggagccagacagcccctgccgcctgaagacagtgacagtgtccaccctgcctgccctgcgggagagtgacatcggctggagcggggcccgggccggggccggggccggcaccggggccggggctgctgctgctgctgccagccctggcagccctggcagcgctggaacagctgctgagagccggctgctgctgtttgtgagaaatgagctgcccggcagaattgctgtgcaggatgacctggacaacacagagctgcccttcttcaccctggagatgagcggcacagctgctgacatcagcctggtgcactggaggcagcagtggctggagaatggcaccctgtacttccacgtgtccatgagcagcagcggccagctggcccaggccacagcccccaccctgcaggagcccagcgagatcgtggaggagcagatgcacatcctgcacatctctgtgatgggcggcctcatcgccctgctgctgctgctgctggtgttcaccgtggccctgtatgcccagaggcgctggcagaagagaagacgcatcccccagaagagcgccagcacagaggccacccatgagatccactacatccccagcgtgctgctgggcccccaggcccgggagagcttccgcagcagccggctgcagacccacaacagcgtcatcggcgtgcccatccgggagacccccatcctggatgattatgactgtgaagaagatgaggagcccccaagaagagccaaccacgtgtccagagaagatgaatttggcagccaggtgacccacaccctggacagcctgggccaccctggagaggagaaggtggactttgagaagaagggcggcatcagctttggccgggccaagggcaccagcggcagcgaggctgatgatgagacccagctgaccttctacacagagcagtaccgcagcagaagaagaagcaagggcctgctgaagagccctgtgaacaagacagccctgaccctgattgctgtgagcagctgcatcctggccatggtgtgtggcagccagatgagctgccccctgactgtgaaggtgaccctgcacgtgcctgagcacttcatcgcagatggcagcagctttgtggtgtctgagggcagctacctggacatcagtgactggctgaacccagccaagctgagcctgtactaccagatcaatgccaccagcccctgggtgcgggacctgtgtggccagaggaccacagatgcctgtgagcagctgtgtgaccctgagactggagaatgtagctgccacgagggctacgccccagaccctgtgcaccgccacctgtgtgtgcggagtgactggggccagagcgagggcccctggccctacaccaccctggagcggggctatgacctggtgactggagagcaggcccctgagaagatcctgcggagcaccttcagcctgggccagggcctgtggctgcctgtgtccaagagctttgtggtgccccctgtggagctgagcatcaaccccctggccagctgcaagacagatgtgctggtgacagaagatcctgcagatgtgcgggaggaggccatgctgagcacctactttgagaccatcaatgacctgctgagcagctttggacctgtgcgggactgcagcaggaacaacggcggctgcaccaggaacttcaagtgtgtgtctgaccggcaggtggacagcagcggctgtgtgtgcccagaggagctgaagcccatgaaggatggcagcggctgctatgaccacagcaagggcatcgactgcagtgatggcttcaatggaggctgtgagcagctgtgcctgcagcagaccctgcccctgccctatgatgccaccagcagcaccatcttcatgttctgtggctgtgtggaggagtacaagctggccccagatggcaagagctgcctgatgctgagtgatgtgtgtgagggccccaagtgcctgaagccagacagcaagttcaatgacaccctgtttggagagatgctgcacggctacaacaacagaacccagcacgtgaaccagggccaggtgttccagatgaccttccgggagaacaacttcatcaaggacttcccccagctggctgatggcctgctggtgatccccctgcctgtggaggagcagtgccggggcgtgctgtctgagcccctgcctgacctgcagctgctgactggagacatccgctatgatgaggccatgggctaccccatggtgcagcagtggagggtgcgcagcaacctgtacagagtgaagctgagcaccatcaccctggccgccggcttcaccaacgtgctgaagatcctgaccaaggagagcagccgggaggagctgctgtccttcatccagcactacggcagccactacatcgccgaggccctgtatggcagcgagctgacctgcatcatccacttccccagcaagaaggtgcagcagcagctgtggctgcagtaccagaaggagaccacagagctgggcagcaagaaggagctgaagtccatgcccttcatcacctacctgagcggcctgctgacagcccagatgctgagtgatgaccagctgatcagcggcgtggagatccgctgtgaggagaagggccgctgccccagcacctgccacctgtgccggcggcctgggaaggagcagctgagccccacccctgtgctgctggagatcaacagagtggtgcccctgtacaccctcatccaggacaatggcaccaaggaggccttcaagagcgccctgatgagcagctactggtgcagcgggaaaggagatgtgattgatgactggtgccgctgtgacctgagcgcctttgatgccaacggcctgcccaactgcagccccctgctgcagcctgtgctgcggctgagccccaccgtggagcccagcagcacagtggtgtccctggagtgggtggatgtgcagcctgccatcggcaccaaggtgtctgactacatcctgcagcacaagaaggtggatgagtacacagacacagacctgtacacaggagagttcctgagctttgctgatgacctgctgagcggcctgggcaccagctgtgtggccgccggccgcagccacggggaggtgcctgaggtgtccatctacagcgtcatcttcaagtgcctggagccagatggcctgtacaagttcaccctgtatgctgtggacacccggggccgccacagcgagctgagcacagtgaccctgaggacagcctgccccctggtggatgacaacaaggccgaggagattgctgacaagatctacaacctgtacaacggctacaccagcggcaaggagcagcagatggcctacaacaccctgatggaggtgtctgcctccatgctgttccgggtgcagcaccactacaacagccactatgagaagtttggagactttgtgtggaggagtgaagatgagctgggccccaggaaggcccacctgatcctgcggcggctggagcgggtgagcagccactgcagcagcctgctgcggagcgcctacatccagagccgggtggagaccgtgccctacctgttctgccgctctgaggaggtgcggcctgctggcatggtgtggtacagcatcctgaaggacaccaagatcacctgtgaggagaagatggtgtccatggccaggaacacctacggggagagcaagggccgctag

SEQ ID NO: 144209 - DNA, 1188 bp, Artificial Sequence; identical to SEQ ID NO: 144206
  Description of Artificial Sequence: Synthetic coding sequence

SEQ ID NO: 144210 - DNA, 4008 bp, Artificial Sequence
  Description of Artificial Sequence: Synthetic coding sequence
atggctgctgctggggcccggctgagccctggccctggcagcggcctgcggggccggccccggctgtgcttccaccctggccccccacccctgctgcccctgctgctgctcttcctgctgctgctgcccccaccacccctgctggccggggccacagctgctgccagccgggagccagacagcccctgccgcctgaagacagtgacagtgtccaccctgcctgccctgcgggagagtgacatcggctggagcggggcccgggccggggccggggccggcaccggggccggggctgctgctgctgctgccagccctggcagccctggcagcgctggaacagctgctgagagccggctgctgctgtttgtgagaaatgagctgcccggcagaattgctgtgcaggatgacctggacaacacagagctgcccttcttcaccctggagatgagcggcacagctgctgacatcagcctggtgcactggaggcagcagtggctggagaatggcaccctgtacttccacgtgtccatgagcagcagcggccagctggcccaggccacagcccccaccctgcaggagcccagcgagatcgtggaggagcagatgcacatcctgcacatctctgtgatgggcggcctcatcgccctgctgctgctgctgctggtgttcaccgtggccctgtatgcccagaggcgctggcagaagagaagacgcatcccccagaagagcgccagcacagaggccacccatgagatccactacatccccagcgtgctgctgggcccccaggcccgggagagcttccgcagcagccggctgcagacccacaacagcgtcatcggcgtgcccatccgggagacccccatcctggatgattatgactgtgaagaagatgaggagcccccaagaagagccaaccacgtgtccagagaagatgaatttggcagccaggtgacccacaccctggacagcctgggccaccctggagaggagaaggtggactttgagaagaaggctgctgctgaggccacccaggagaccgtggagagcctgatgcagaagttcaaggagagcttccgggccaacacccccattgaaattggccagctgcagccccccctgcggagcaccagcgctgggaagaggaagaggaggagcaagagccggggcggcatcagctttggccgggccaagggcaccagcggcagcgaggctgatgatgagacccagctgaccttctacacagagcagtaccgcagcagaagaagaagcaagggcctgctgaagagccctgtgaacaagacagccctgaccctgattgctgtgagcagctgcatcctggccatggtgtgtggcagccagatgagctgccccctgactgtgaaggtgaccctgcacgtgcctgagcacttcatcgcagatggcagcagctttgtggtgtctgagggcagctacctggacatcagtgactggctgaacccagccaagctgagcctgtactaccagatcaatgccaccagcccctgggtgcgggacctgtgtggccagaggaccacagatgcctgtgagcagctgtgtgaccctgagaccggggagtgcagctgccacgagggctacgccccagaccctgtgcaccgccacctgtgtgtgcggagtgactggggccagagcgagggcccctggccctacaccaccctggagcggggctatgacctggtgactggagagcaggcccctgagaagatcctgagcctgggccagggcctgtggctgcctgtgtccaagagctttgtggtgccccctgtggagctgagcatcaaccccctggccagctgcaagacagatgtgctggtgacagaggaccctgcagatgtgcgggaggaggccatgctgagcacctactttgagaccatcaatgacctgctgagcagctttggacctgtgcgggactgcagcagaaataatggaggctgcaccaggaacttcaagtgtgtgtctgaccggcaggtggacagcagcggctgtgtgtgcccagaggagctgaagcccatgaaggatggcagcggctgctatgaccacagcaaaggaattgactgcagtgatggcttcaacggcggctgtgagcagctgtgcctgcagcagaccctgcccctgccctatgatgccaccagcagcaccatcttcatgttctgtggctgtgtggaggagtacaagctggccccagatggcaagagctgcctgatgctgagtgatgtgtgtgagggccccaagtgcctgaagccagacagcaagttcaatgacaccctgtttggagagatgctgcacggctacaacaacagaacccagcacgtgaaccagggccaggtgttccagatgaccttccgggagaacaacttcatcaaggacttcccccagctggctgatggcctgctggtgatccccctgcctgtggaggagcagtgccggggcgtgctgtctgagcccctgcctgacctgcagctgctgaccggggacatccgctatgatgaggccatgggctaccccatggtgcagcagtggagggtgcgcagcaacctgtacagagtgaagctgagcaccatcaccctggccgccggcttcaccaacgtgctgaagatcctgaccaaggagagcagccgggaggagctgctgtccttcatccagcactacggcagccactacatcgccgaggccctgtatggcagcgagctgacctgcatcatccacttccccagcaagaaggtgcagcagcagctgtggctgcagtaccagaaggagaccacagagctgggcagcaagaaggagctgaagtccatgcccttcatcacctacctgagcggcctgctgacagcccagatgctgagtgatgaccagctgatctctggagtggagatccgctgtgaggagaagggccgctgccccagcacctgccacctgtgcagaagacctgggaaggagcagctgagccccacccctgtgctgctggagatcaacagagtggtgcccctgtacaccctcatccaggacaatggcaccaaggaggccttcaagagcgccctgatgagcagctactggtgcagcgggaaaggagatgtgattgatgactggtgccgctgtgacctgagcgcctttgatgccaacggcctgcccaactgcagccccctgctgcagcctgtgctgcggctgagccccaccgtggagcccagcagcacagtggtgtccctggagtgggtggatgtgcagcctgccatcggcaccaaggtgtctgactacatcctgcagcacaagaaggtggatgagtacacagacacagacctgtacaccggggagttcctgagctttgctgatgacctgctgagcggcctgggcaccagctgtgtggccgccggccgcagccatggagaggtgcctgaggtgtccatctacagcgtcatcttcaagtgcctggagccagatggcctgtacaagttcaccctgtatgctgtggacacccggggccgccacagcgagctgagcacagtgaccctgaggacagcctgccccctggtggatgacaacaaggccgaggagattgctgacaagatctacaacctgtacaacggctacaccagcggcaaggagcagcagatggcctacaacaccctgatggaggtgtctgcctccatgctgttccgggtgcagcaccactacaacagccactatgagaagtttggagactttgtgtggaggagtgaagatgagctgggccccaggaaggcccacctgatcctgcggcggctggagcgggtgagcagccactgcagcagcctgctgcggagcgcctacatccagagccgggtggagaccgtgccctacctgttctgccgctctgaggaggtgcggcctgctggcatggtgtggtacagcatcctgaaggacaccaagatcacctgtgaggagaagatggtgtccatggccaggaacacctatggagagagcaaaggaagatag

SEQ ID NO: 144211 - DNA, 297 bp, Artificial Sequence
  Description of Artificial Sequence: Synthetic coding sequence
tgaatggcctacaacaccctgatggaggtgtctgcctccatgctgttccgggtgcagcaccactacaacagccactatgagaagtttggagactttgtgtggaggagtgaagatgagctgggccccagcctgctggagagcttcatgagcctgcaggacatcaacctgctggagaggaggcctggccggccccagaggcctggcaaccccctgagcaatgtgtcctggaggatcagcgagatcgcccccaccagccacacagacatgtctgctggcatcaaggagacagccagctag

SEQ ID NO: 144212 - DNA, 6828 bp, Artificial Sequence
  Description of Artificial Sequence: Synthetic coding sequence
atggctgctgagcggcgctgtggctccatgagggacctgcgggcccaggtgaccagcggcctgctgcccttccctgaggtgaccctgcaggccctgggggaggatgagatcaccctggagagcgtgctgcggggcaagtttgctgctgggaagaatggcctggcctgcctggcctgtggcccccagctggaggtggtgaacagcatcaccggggagcggctgagcgcctaccgcttcagcggcgtgaatgagcagccccctgtggtgctggccgtgaaggagttctcctggcagaagaggacaggcctgctgattggcctggaggagacagagggctctgtgctgtgcctgtatgacctgggcatcagcaaggtggtgaaggctgtggtgctgcccggccgggtgacagccatcgagcccatcatcaaccacggcggggccagcgccagcacccagcacctgcaccccagcctgcgctggctgtttggagtggccgctgtggtgacagatgtgggccagatcctgctggtggacctgtgcctggatgacctgagctgcaaccagaatgaggtggaggccagtgacctggaggtgctgaccggcatcccagctgaggtgccccacatccgggagagcgtgatgaggcagggccgccacctgtgcttccagctggtgagccccaccggcacagctgtgtccaccctgagctacatcagcaggaccaaccagctggccgtgggcttcagtgatggctacctggccctgtggaacatgaagtccatgaagcgggagtactacatccagctggagagcggccaggtgcctgtgtatgctgtgaccttccaggagccagaaaatgaccccaggaactgctgctacctgtgggccgtgcagagcacccaggacagtgaaggagatgtgctgagcctgcacctgctgcagctggcctttggaaacaggaagtgcctggccagcggccagatcctgtatgagggcctggagtactgtgaggagcgctacaccctggacctgactggaggcatgttccccctgcggggccagaccagcaacaccaagctgctgggctgccagagcattgagaagttccgcagccacggggaccgggaggagggcgtgaatgaggccctgagcccagacacctctgtgtctgtgttcacctggcaggtgaacatctacggccagggcaagcccagcgtgtacctgggcctgtttgacatcaaccgctggtaccacgcccagatgccagacagcctgcggtctggagagtacctgcacaactgcagctactttgccctgtggagcctggagagcgtggtgtccaggaccagcccccacggcatcctggacatcctggtgcatgagaggagcctgaacagaggagtgcccccatcctacccacctcctgagcagttcttcaaccccagcacctacaactttgatgccacctgcctgctgaacagcggcgtggtgcacctgacctgcaccggcttccagaaggagaccctgaccttcctgaagaagagcggccccagcctgaatgagctgatcccagatggctacaaccgctgcctggtggccggcctgctgagccccaggtttgtggatgtgcagcccagcagcctgagccaggaggagcagctggaggccatcctgtctgctgccatccagaccagcagcctgggcctgctgaccggctacatccgccgctggatcacagaggagcagcccaacagcgccaccaacctgcgctttgtgctggagtggacctggaacaaggtggtgctgaccaaggaggagtttgaccggctgtgtgtgcccctgtttgatggcagctgccacttcatggacccccagaccatccagagcatccagcagtgctacctgctgctgagcaacctgaacatcgtgctgagctgctttgccagcgaggcccgggagatcacagagcggggcctgattgacctgagcaacaagtttgtggtgagccacctgatctgccagtatgcccaggtggtgctgtggttcagccacagcggcctgctgcctgagggcattgatgattctgtgcagctgagccggctgtgctacaactaccctgtgatccagaactactacaccagccggcggcagaagtttgagcggctgagccggggcaagtggaacccagactgcctgatgattgatggcctggtgtcccagctgggggagagaattgagaagctgtggaagagagatgagggcggcaccgggaagtaccccccagccagcctgcatgctgtgctggacatgtacctgctggatggagtgacagaagctgccaagcacagcatcaccatctacctgctgctggacatcatgtacagcttccccaacaagacagacacccccatcgagagcttccccaccgtgtttgccatctcctggggccaggtgaagctgatccagggcttctggctgattgaccacaatgactatgagagcggcctggacctgctcttccacccagccacagccaagcccctgtcctggcagcacagcaagatcatccaggccttcatgagccagggcgagcaccggcaggccctgcgctacatccagaccatgaagcccaccgtgtcctctggaaatgatgtgatcctgcacctgactgtgctgctcttcaaccgctgcatggtggaggcctggaacttcctgcggcagcactgcaaccggctgaacatcgaggagctgctgaagcacatgtatgaggtgtgccaggagatgggcctgatggaggacctgctgaagctgcccttcacagacacagagcaggagtgcctggtgaagttcctgcagagcagcgcctctgtgcagaaccacgagttcctgctggtgcaccacctgcagagggccaactacgtgcctgccctgaagctgaaccagaccctgaagatcaacgtgatgaatgaccgggacccccggctgcgggagaggagcctggccaggaacagcatcctggaccagtatggcaagatcctgccccgggtgcacaggaagctggccatcgagcgggccaagccctaccacctgagcaccagcagcgtcttccggctggtgtcccggcccaagcccctgtctgctgtgcccaagcaggtggtgacaggcaccgtgctgaccaggtctgtgttcatcaacaacgtgctgagcaagattggagaggtgtgggccagcaaggagcccatcaacagcaccacccccttcaacagcagcaagattgaggagcccagccccatcgtgtacagcctgcctgcccctgagctgcctgaggccttcttcggcacccccatcagcaaggccagccagaagatcagccggctgctggacctggtggtgcagcctgtgccccggcccagccagtgcagcgagttcatccagcagagctccatgaagagccccctgtacctggtgagccgcagcctgcccagcagcagccagctgaagggcagcccccaggccatcagccgggccagcgagctgcacctgctggagacccccctggtggtgaagaaggccaagagcctggccatgtctgtgaccaccagcggcttcagcgagttcaccccccagagcatcctgcggagcaccctgcggagcacccccctggccagccccagccccagccctggccgcagcccccagaggctgaaggagacccgcatcagctttgtggaggaggatgtgcaccccaagtggatccctggagctgctgatgacagcaagctggaggtgttcaccacccccaagaagtgtgctgtgcctgtggagacagagtggctgaagagcaaggacaggaccaccagcttcttcctgaacagccctgagaaggagcaccaggagatggatgagggcagccagagcctggagaagctggatgtgtccaagggcaacagctctgtgtccatcaccagtgatgagaccaccctggagtaccaggatgcccccagccctgaggacctggaggagaccgtcttcaccgccagcaagcccaagagcagcagcacagccctgaccaccaacgtgacagagcagacagagaaggatggagacaaggatgtgtttgccagcgaggtgacccccagcgacctgcagaagcagatgggcaacctggaggatgctgagaccaaggacctgctggtggccgctgaggccttcagcgagctgaaccacctgagccctgtgcagggcacagaggccagcctgtgtgcccccagcgtgtatgagggcaagatcttcacccagaagagcaaggtgcctgtgctggatgagggcctgacctctgtggagacctacaccccagccatccgggccaatgacaacaagtccatggctgatgtgctgggagatggcggcaacagcagcctgaccatcagcgagggccccatcgtgtctgaaagaaggctgaaccaggaggtggccctgaacctgaaggaggaccacgaggtggaggtgggcgtgctgaaggagagcgtggacctgcctgaggagaagctgcccatcagtgacagccccccagacacccaggagatccacgtgattgagcaggagaagctggaggcccaggacagcggggaggaggccaggaacctgtccttcaatgagctgtaccccagcggcaccctgaagctgcagtacaactttgacaccatcgaccagcagttctgtgacctggccgacaacaaggacacagcagaatgtgacattgctgaggtggatggagagctgtttgtggcccagagcaacttcaccctcatcctggagggggaggagggggaggtggagcccggggactttgccagcagtgatgtgctgcccaaggccgccaacacagccacagaggagaagctggtgtgcagcggggagaatgacaaccacggccagatcgccaacctgcccagcgctgtgaccagtgaccagaagagccagaaggtggacaccctgccctacgtgcctgagcccatcaaggtggccatcgccgagaacctgctggatgtgatcaaggacaccaggagcaaggagatcaccagtgacaccatggagcagagcatccacgagaccatccccctggtgtcccagaacatcatgtgccccaccaagctggtgaagagcgccttcaagacagcccaggagaccagcaccatgaccatgaatgtgtcccaggtggatgatgtggtgagcagcaagaccaggacccggggccagaggatccagaatgtgaatgtgaagagcgcccagcaggaggccagcgcagatgtggccacccccaagatgcctggccagagcgtgaggaagaagaccaggaaggccaaggagatcagcgaggccagcgagaacatctacagtgatgtgcggggcctgagccagaaccagcagatcccccagaacagcgtgaccccaagaagaggccgcaggaagaaggaggtgaaccaggacatcctggagaacaccagctctgtggagcaggagctgcagatcaccaccggccgggagagcaagaggctgaagagcagccagctgctggagcctgctgtggaggagaccaccaagaaggaggtgaaggtgtcctctgtgaccaagaggaccccccggcgcatcaagaggtctgtggagaaccaggagagcgtggagatcatcaatgacctgaaggtgtccacagtgaccagccccagcaggatgatcaggaagctgcggagcaccaacctggatgccagcgagaacacaggcaacaagcaggatgacaagagcagtgacaagcagctgcgcatcaagcacgtgagaagagtgcggggccgggaggtgagccccagtgatgtgcgggaggacagcaacctggagagcagccagctgactgtgcaggccgagtttgacatgtctgccatccccaggaagaggggccggcccaggaagatcaaccccagtgaagatgtgggcagcaaggctgtgaaggaggagaggagccccaagaagaaggaggcccccagcatcagaagaagaagcaccaggaacaccccagccaagtcagaaaatgtggatgtgggcaagccagccctgggcaagagcatcctggtgcccaatgaggagctgtccatggtgatgagcagcaagaagaagctgaccaagaagacagagagccagagccagaagaggagcctgcacagcgtgtctgaggagaggacagatgagatgacccacaaggagaccaatgagcaggaggagcggctgctggccacagccagcttcaccaagagcagccgcagcagcaggaccaggagcagcaaggccatcctgctgcctgacctgtctgagcccaacaatgagcccctcttcagccctgccagcgaggtgcccaggaaggccaaggccaagaagattgaggtgcctgcccagctgaaggagctggtgtctgacctgagcagccagtttgtgatcagccccccagccctgcggagccggcagaagaacaccagcaacaagaacaagctggaggatgagctgaaggatgatgcccagagcgtggagaccctgggcaagcccaaggccaagaggatccgcaccagcaagaccaagcaggccagcaagaacacagagaaggagagcgcctggagccccccacccatcgagatccgcctcatcagccccctggccagccctgcagatggagtgaagagcaagcccaggaagaccacagaggtgactggaacaggcctgggcaggaacaggaagaagctgagcagctaccccaagcagatcctgcggaggaagatgctgtag

SEQ ID NO: 144213 - DNA, 6906 bp, Artificial Sequence
  Description of Artificial Sequence: Synthetic coding sequence
atggacagcctggccggcctgagcccccgggaggccgccggcgtgctgagcctgagctgtgtgggcgtgtgcagcacctgtgcctgggcctggccccacggctccatgagggacctgcgggcccaggtgaccagcggcctgctgcccttccctgaggtgaccctgcaggccctgggggaggatgagatcaccctggagagcgtgctgcggggcaagtttgctgctgggaagaatggcctggcctgcctggcctgtggcccccagctggaggtggtgaacagcatcaccggggagcggctgagcgcctaccgcttcagcggcgtgaatgagcagccccctgtggtgctggccgtgaaggagttctcctggcagaagaggacaggcctgctgattggcctggaggagacagagggctctgtgctgtgcctgtatgacctgggcatcagcaaggtggtgaaggctgtggtgctgcccggccgggtgacagccatcgagcccatcatcaaccacggcggggccagcgccagcacccagcacctgcaccccagcctgcgctggctgtttggagtggccgctgtggtgacagatgtgggccagatcctgctggtggacctgtgcctggatgacctgagctgcaaccagaatgaggtggaggccagtgacctggaggtgctgaccggcatcccagctgaggtgccccacatccgggagagcgtgatgaggcagggccgccacctgtgcttccagctggtgagccccaccggcacagctgtgtccaccctgagctacatcagcaggaccaaccagctggccgtgggcttcagtgatggctacctggccctgtggaacatgaagtccatgaagcgggagtactacatccagctggagagcggccaggtgcctgtgtatgctgtgaccttccaggagccagaaaatgaccccaggaactgctgctacctgtgggccgtgcagagcacccaggacagtgaaggagatgtgctgagcctgcacctgctgcagctggcctttggaaacaggaagtgcctggccagcggccagatcctgtatgagggcctggagtactgtgaggagcgctacaccctggacctgactggaggcatgttccccctgcggggccagaccagcaacaccaagctgctgggctgccagagcattgagaagttccgcagccacggggaccgggaggagggcgtgaatgaggccctgagcccagacacctctgtgtctgtgttcacctggcaggtgaacatctacggccagggcaagcccagcgtgtacctgggcctgtttgacatcaaccgctggtaccacgcccagatgccagacagcctgcggtctggagagtacctgcacaactgcagctactttgccctgtggagcctggagagcgtggtgtccaggaccagcccccacggcatcctggacatcctggtgcatgagaggagcctgaacagaggagtgcccccatcctacccacctcctgagcagttcttcaaccccagcacctacaactttgatgccacctgcctgctgaacagcggcgtggtgcacctgacctgcaccggcttccagaaggagaccctgaccttcctgaagaagagcggccccagcctgaatgagctgatcccagatggctacaaccgctgcctggtggccggcctgctgagccccaggtttgtggatgtgcagcccagcagcctgagccaggaggagcagctggaggccatcctgtctgctgccatccagaccagcagcctgggcctgctgaccggctacatccgccgctggatcacagaggagcagcccaacagcgccaccaacctgcgctttgtgctggagtggacctggaacaaggtggtgctgaccaaggaggagtttgaccggctgtgtgtgcccctgtttgatggcagctgccacttcatggacccccagaccatccagagcatccagcagtgctacctgctgctgagcaacctgaacatcgtgctgagctgctttgccagcgaggcccgggagatcacagagcggggcctgattgacctgagcaacaagtttgtggtgagccacctgatctgccagtatgcccaggtggtgctgtggttcagccacagcggcctgctgcctgagggcattgatgattctgtgcagctgagccggctgtgctacaactaccctgtgatccagaactactacaccagccggcggcagaagtttgagcggctgagccggggcaagtggaacccagactgcctgatgattgatggcctggtgtcccagctgggggagagaattgagaagctgtggaagagagatgagggcggcaccgggaagtaccccccagccagcctgcatgctgtgctggacatgtacctgctggatggagtgacagaagctgccaagcacagcatcaccatctacctgctgctggacatcatgtacagcttccccaacaagacagacacccccatcgagagcttccccaccgtgtttgccatctcctggggccaggtgaagctgatccagggcttctggctgattgaccacaatgactatgagagcggcctggacctgctcttccacccagccacagccaagcccctgtcctggcagcacagcaagatcatccaggccttcatgagccagggcgagcaccggcaggccctgcgctacatccagaccatgaagcccaccgtgtcctctggaaatgatgtgatcctgcacctgactgtgctgctcttcaaccgctgcatggtggaggcctggaacttcctgcggcagcactgcaaccggctgaacatcgaggagctgctgaagcacatgtatgaggtgtgccaggagatgggcctgatggaggacctgctgaagctgcccttcacagacacagagcaggagtgcctggtgaagttcctgcagagcagcgcctctgtgcagaaccacgagttcctgctggtgcaccacctgcagagggccaactacgtgcctgccctgaagctgaaccagaccctgaagatcaacgtgatgaatgaccgggacccccggctgcgggagaggagcctggccaggaacagcatcctggaccagtatggcaagatcctgccccgggtgcacaggaagctggccatcgagcgggccaagccctaccacctgagcaccagcagcgtcttccggctggtgtcccggcccaagcccctgtctgctgtgcccaagcaggtggtgacaggcaccgtgctgaccaggtctgtgttcatcaacaacgtgctgagcaagattggagaggtgtgggccagcaaggagcccatcaacagcaccacccccttcaacagcagcaagattgaggagcccagccccatcgtgtacagcctgcctgcccctgagctgcctgaggccttcttcggcacccccatcagcaaggccagccagaagatcagccggctgctggacctggtggtgcagcctgtgccccggcccagccagtgcagcgagttcatccagcagagctccatgaagagccccctgtacctggtgagccgcagcctgcccagcagcagccagctgaagggcagcccccaggccatcagccgggccagcgagctgcacctgctggagacccccctggtggtgaagaaggccaagagcctggccatgtctgtgaccaccagcggcttcagcgagttcaccccccagagcatcctgcggagcaccctgcggagcacccccctggccagccccagccccagccctggccgcagcccccagaggctgaaggagacccgcatcagctttgtggaggaggatgtgcaccccaagtggatccctggagctgctgatgacagcaagctggaggtgttcaccacccccaagaagtgtgctgtgcctgtggagacagagtggctgaagagcaaggacaggaccaccagcttcttcctgaacagccctgagaaggagcaccaggagatggatgagggcagccagagcctggagaagctggatgtgtccaagggcaacagctctgtgtccatcaccagtgatgagaccaccctggagtaccaggatgcccccagccctgaggacctggaggagaccgtcttcaccgccagcaagcccaagagcagcagcacagccctgaccaccaacgtgacagagcagacagagaaggatggagacaaggatgtgtttgccagcgaggtgacccccagcgacctgcagaagcagatgggcaacctggaggatgctgagaccaaggacctgctggtggccgctgaggccttcagcgagctgaaccacctgagccctgtgcagggcacagaggccagcctgtgtgcccccagcgtgtatgagggcaagatcttcacccagaagagcaaggtgcctgtgctggatgagggcctgacctctgtggagacctacaccccagccatccgggccaatgacaacaagtccatggctgatgtgctgggagatggcggcaacagcagcctgaccatcagcgagggccccatcgtgtctgaaagaaggctgaaccaggaggtggccctgaacctgaaggaggaccacgaggtggaggtgggcgtgctgaaggagagcgtggacctgcctgaggagaagctgcccatcagtgacagccccccagacacccaggagatccacgtgattgagcaggagaagctggaggcccaggacagcggggaggaggccaggaacctgtccttcaatgagctgtaccccagcggcaccctgaagctgcagtacaactttgacaccatcgaccagcagttctgtgacctggccgacaacaaggacacagcagaatgtgacattgctgaggtggatggagagctgtttgtggcccagagcaacttcaccctcatcctggagggggaggagggggaggtggagcccggggactttgccagcagtgatgtgctgcccaaggccgccaacacagccacagaggagaagctggtgtgcagcggggagaatgacaaccacggccagatcgccaacctgcccagcgctgtgaccagtgaccagaagagccagaaggtggacaccctgccctacgtgcctgagcccatcaaggtggccatcgccgagaacctgctggatgtgatcaaggacaccaggagcaaggagatcaccagtgacaccatggagcagagcatccacgagaccatccccctggtgtcccagaacatcatgtgccccaccaagctggtgaagagcgccttcaagacagcccaggagaccagcaccatgaccatgaatgtgtcccaggtggatgatgtggtgagcagcaagaccaggacccggggccagaggatccagaatgtgaatgtgaagagcgcccagcaggaggccagcgcagatgtggccacccccaagatgcctggccagagcgtgaggaagaagaccaggaaggccaaggagatcagcgaggccagcgagaacatctacagtgatgtgcggggcctgagccagaaccagcagatcccccagaacagcgtgaccccaagaagaggccgcaggaagaaggaggtgaaccaggacatcctggagaacaccagctctgtggagcaggagctgcagatcaccaccggccgggagagcaagaggctgaagagcagccagctgctggagcctgctgtggaggagaccaccaagaaggaggtgaaggtgtcctctgtgaccaagaggaccccccggcgcatcaagaggtctgtggagaaccaggagagcgtggagatcatcaatgacctgaaggtgtccacagtgaccagccccagcaggatgatcaggaagctgcggagcaccaacctggatgccagcgagaacacaggcaacaagcaggatgacaagagcagtgacaagcagctgcgcatcaagcacgtgagaagagtgcggggccgggaggtgagccccagtgatgtgcgggaggacagcaacctggagagcagccagctgactgtgcaggccgagtttgacatgtctgccatccccaggaagaggggccggcccaggaagatcaaccccagtgaagatgtgggcagcaaggctgtgaaggaggagaggagccccaagaagaaggaggcccccagcatcagaagaagaagcaccaggaacaccccagccaagtcagaaaatgtggatgtgggcaagccagccctgggcaagagcatcctggtgcccaatgaggagctgtccatggtgatgagcagcaagaagaagctgaccaagaagacagagagccagagccagaagaggagcctgcacagcgtgtctgaggagaggacagatgagatgacccacaaggagaccaatgagcaggaggagcggctgctggccacagccagcttcaccaagagcagccgcagcagcaggaccaggagcagcaaggccatcctgctgcctgacctgtctgagcccaacaatgagcccctcttcagccctgccagcgaggtgcccaggaaggccaaggccaagaagattgaggtgcctgcccagctgaaggagctggtgtctgacctgagcagccagtttgtgatcagccccccagccctgcggagccggcagaagaacaccagcaacaagaacaagctggaggatgagctgaaggatgatgcccagagcgtggagaccctgggcaagcccaaggccaagaggatccgcaccagcaagaccaagcaggccagcaagaacacagagaaggagagcgcctggagccccccacccatcgagatccgcctcatcagccccctggccagccctgcagatggagtgaagagcaagcccaggaagaccacagaggtgactggaacaggcctgggcaggaacaggaagaagctgagcagctaccccaagcagatcctgcggaggaagatgctgtag

SEQ ID NO: 144214 - DNA, 6801 bp, Artificial Sequence
  Description of Artificial Sequence: Synthetic coding sequence
atgagggacctgcgggcccaggtgaccagcggcctgctgcccttccctgaggtgaccctgcaggccctgggagaagatgagatcaccctggagagcgtgctgcggggcaagtttgctgctgggaagaatggcctggcctgcctggcctgtggcccccagctggaggtggtgaacagcatcactggagagcggctgagcgcctaccgcttctctggagtgaatgagcagccccctgtggtgctggccgtgaaggagttctcctggcagaagaggacaggcctgctgattggcctggaggagacagagggctctgtgctgtgcctgtatgacctgggcatcagcaaggtggtgaaggctgtggtgctgcccggccgggtgacagccatcgagcccatcatcaaccacggcggggccagcgccagcacccagcacctgcaccccagcctgcgctggctgtttggagtggccgctgtggtgacagatgtgggccagatcctgctggtggacctgtgcctggatgacctgagctgcaaccagaatgaggtggaggccagtgacctggaggtgctgaccggcatcccagctgaggtgccccacatccgggagagcgtgatgaggcagggccgccacctgtgcttccagctggtgagccccactggaacagctgtgtccaccctgagctacatcagcaggaccaaccagctggccgtgggcttcagtgatggctacctggccctgtggaacatgaagtccatgaagcgggagtactacatccagctggagagcggccaggtgcctgtgtatgctgtgaccttccaggagccagaaaatgaccccaggaactgctgctacctgtgggccgtgcagagcacccaggacagtgaaggagatgtgctgagcctgcacctgctgcagctggccttcggcaacaggaagtgcctggccagcggccagatcctgtatgagggcctggagtactgtgaggagcgctacaccctggacctgaccggcggcatgttccccctgcggggccagaccagcaacaccaagctgctgggctgccagagcattgagaagttccgcagccatggagaccgggaggagggcgtgaatgaggccctgagcccagacacctctgtgtctgtgttcacctggcaggtgaacatctacggccagggcaagcccagcgtgtacctgggcctgtttgacatcaaccgctggtaccacgcccagatgccagacagcctgcggagcggggagtacctgcacaactgcagctactttgccctgtggagcctggagagcgtggtgtccaggaccagcccccacggcatcctggacatcctggtgcatgagaggagcctgaacagaggagtgccccccagctacccacctcctgagcagttcttcaaccccagcacctacaactttgatgccacctgcctgctgaacagcggcgtggtgcacctgacctgcaccggcttccagaaggagaccctgaccttcctgaagaagagcggccccagcctgaatgaactcatcccagatggctacaaccgctgcctggtggccggcctgctgagccccaggtttgtggatgtgcagcccagcagcctgagccaggaggagcagctggaggccatcctgtctgctgccatccagaccagcagcctgggcctgctgaccggctacatccgccgctggatcacagaggagcagcccaacagcgccaccaacctgcgctttgtgctggagtggacctggaacaaggtggtgctgaccaaggaggagtttgaccggctgtgtgtgcccctgtttgatggcagctgccacttcatggacccccagaccatccagagcatccagcagtgctacctgctgctgagcaacctgaacatcgtgctgagctgctttgccagcgaggcccgggagatcacagagcggggcctgattgacctgagcaacaagtttgtggtgagccacctgatctgccagtatgcccaggtggtgctgtggttcagccacagcggcctgctgcctgagggcattgatgacagcgtgcagctgagccggctgtgctacaactaccctgtgatccagaactactacaccagccggcggcagaagtttgagcggctgagccggggcaagtggaacccagactgcctgatgattgatggcctggtgtcccagctgggggagcgcatcgagaagctgtggaagagagatgaaggaggcaccgggaagtaccccccagccagcctgcatgctgtgctggacatgtacctgctggatggagtgacagaggccgccaagcacagcatcaccatctacctgctgctggacatcatgtacagcttccccaacaagacagacacccccatcgagagcttccccaccgtgtttgccatctcctggggccaggtgaagctgatccagggcttctggctgattgaccacaatgactatgaaagtggcctggacctgctcttccacccagccacagccaagcccctgtcctggcagcacagcaagatcatccaggccttcatgagccagggcgagcaccggcaggccctgcgctacatccagaccatgaagcccaccgtgtcctctggaaatgatgtgatcctgcacctgactgtgctgctcttcaaccgctgcatggtggaggcctggaacttcctgcggcagcactgcaaccggctgaacatcgaggagctgctgaagcacatgtatgaggtgtgccaggagatgggcctgatggaggacctgctgaagctgcccttcacagacacagagcaggagtgcctggtgaagttcctgcagagcagcgcctctgtgcagaaccacgagttcctgctggtgcaccacctgcagagggccaactacgtgcctgccctgaagctgaaccagaccctgaagatcaacgtgatgaatgaccgggacccccggctgcgggagaggagcctggccagaaattccatcctggaccagtatggcaagatcctgccccgggtgcacaggaagctggccatcgagcgggccaagccctaccacctgagcaccagctctgtgttccggctggtgtcccggcccaagcccctgtctgctgtgcccaagcaggtggtgactggaacagtgctgaccaggagcgtcttcatcaacaacgtgctgagcaagatcggggaggtgtgggccagcaaggagcccatcaacagcaccacccccttcaacagcagcaagattgaggagcccagccccatcgtgtacagcctgcctgcccctgagctgcctgaggccttcttcggcacccccatcagcaaggccagccagaagatcagccggctgctggacctggtggtgcagcctgtgccccggcccagccagtgcagcgagttcatccagcagagctccatgaagagccccctgtacctggtgagccgcagcctgcccagcagcagccagctgaagggcagcccccaggccatcagccgggccagcgagctgcacctgctggagacccccctggtggtgaagaaggccaagagcctggccatgtctgtgaccaccagcggcttcagcgagttcaccccccagagcatcctgcggagcaccctgcggagcacccccctggccagccccagccccagccctggccgcagcccccagaggctgaaggagacccgcatcagctttgtggaggaggatgtgcaccccaagtggatccctggagctgctgatgacagcaagctggaggtgttcaccacccccaagaagtgtgctgtgcctgtggagacagagtggctgaagagcaaggacaggaccaccagcttcttcctgaacagccctgagaaggagcaccaggagatggatgagggcagccagagcctggagaagctggatgtgtccaaaggaaacagctctgtgtccatcaccagtgatgagaccaccctggagtaccaggatgcccccagccctgaggacctggaggagaccgtcttcaccgccagcaagcccaagagcagcagcacagccctgaccaccaacgtgacagagcagacagagaaggatggagacaaggatgtgtttgccagcgaggtgacccccagcgacctgcagaagcagatgggcaacctggaggatgctgagaccaaggacctgctggtggccgctgaggccttcagcgagctgaaccacctgagccctgtgcagggcacagaggccagcctgtgtgcccccagcgtgtatgagggcaagatcttcacccagaagagcaaggtgcctgtgctggatgagggcctgacctctgtggagacctacaccccagccatccgggccaatgacaacaagtccatggctgatgtgctgggagatggcggcaacagcagcctgaccatcagcgagggccccatcgtgtctgagcggcggctgaaccaggaggtggccctgaacctgaaggaggaccacgaggtggaggtgggcgtgctgaaggagagcgtggacctgcctgaggagaagctgcccatcagtgacagccccccagacacccaggagatccacgtgattgagcaggagaagctggaggcccaggacagcggggaggaggccaggaacctgtccttcaatgagctgtaccccagcggcaccctgaagctgcagtacaactttgacaccatcgaccagcagttctgtgacctggccgacaacaaggacacagcagaatgtgacattgctgaggtggatggagagctgtttgtggcccagagcaacttcaccctcatcctggagggggaggagggggaggtggagcccggggactttgccagcagtgatgtgctgcccaaggccgccaacacagccacagaggagaagctggtgtgcagcggagaaaatgacaaccacggccagatcgccaacctgcccagcgctgtgaccagtgaccagaagagccagaaggtggacaccctgccctacgtgcctgagcccatcaaggtggccatcgccgagaacctgctggatgtgatcaaggacaccaggagcaaggagatcaccagtgacaccatggagcagagcatccacgagaccatccccctggtgtcccagaacatcatgtgccccaccaagctggtgaagagcgccttcaagacagcccaggagaccagcaccatgaccatgaatgtgtcccaggtggatgatgtggtgagcagcaagaccaggacccggggccagaggatccagaatgtgaatgtgaagagcgcccagcaggaggccagcgcagatgtggccacccccaagatgcctggccagagcgtgaggaagaagaccaggaaggccaaggagatcagcgaggccagcgagaacatctacagtgatgtgcggggcctgagccagaaccagcagatcccccagaacagcgtgaccccccggcggggccgcaggaagaaggaggtgaaccaggacatcctggagaacaccagctctgtggagcaggagctgcagatcaccaccggccgggagagcaagaggctgaagagcagccagctgctggagcctgctgtggaggagaccaccaagaaggaggtgaaggtgtcctctgtgaccaagaggaccccccggcgcatcaagaggtctgtggagaaccaggagagcgtggagatcatcaatgacctgaaggtgtccacagtgaccagccccagcaggatgatcaggaagctgcggagcaccaacctggatgcctctgaaaatactggaaacaagcaggatgacaagagcagtgacaagcagctgcgcatcaagcacgtgcggcgggtgcggggccgggaggtgagccccagtgatgtgcgggaggacagcaacctggagagcagccagctgactgtgcaggccgagtttgacatgtctgccatccccaggaagaggggccggcccaggaagatcaaccccagtgaagatgtgggcagcaaggctgtgaaggaggagaggagccccaagaagaaggaggcccccagcatcagaagaagaagcaccaggaacaccccagccaagtcagaaaatgtggatgtgggcaagccagccctgggcaagagcatcctggtgcccaatgaggagctgtccatggtgatgagcagcaagaagaagctgaccaagaagacagagagccagagccagaagaggagcctgcacagcgtgtctgaggagaggacagatgagatgacccacaaggagaccaatgagcaggaggagcggctgctggccacagccagcttcaccaagagcagccgcagcagcaggaccaggagcagcaaggccatcctgctgcctgacctgtctgagcccaacaatgagcccctcttctccccagccagcgaggtgcccaggaaggccaaggccaagaagattgaggtgcctgcccagctgaaggagctggtgtctgacctgagcagccagtttgtgatcagccccccagccctgcggagccggcagaagaacaccagcaacaagaacaagctggaggatgagctgaaggatgatgcccagagcgtggagaccctgggcaagcccaaggccaagaggatccgcaccagcaagaccaagcaggccagcaagaacacagagaaggagagcgcctggagccccccacccatcgagatccgcctcatcagccccctggccagccctgcagatggagtgaagagcaagcccaggaagaccacagaggtgacaggcaccggcctgggcaggaacaggaagaagctgagcagctaccccaagcagatcctgcggaggaagatgctgtag

SEQ ID NO: 144215 - DNA, 3567 bp, Artificial Sequence
  Description of Artificial Sequence: Synthetic coding sequence
atgaaggccgcagatgagcccgcctacctgactgtgggcacagatgtgtctgccaagtacagaggagccttctgtgaggccaagatcaagacagtgaagaggctggtgaaggtgaaggtgctgctgaagcaggacaacaccacccagctggtgcaggatgaccaggtgaagggccccctgcgggtgggcgccatcgtggagaccaggaccagtgatggcagcttccaggaggccatcatcagcaagctgacagatgcctcctggtacacagtggtgtttgatgatggagatgagaggaccctgcggaggaccagcctgtgcctgaagggggagcggcactttgctgagagcgagaccctggaccagctgcccctgaccaaccctgagcacttcggcacccctgtgattgccaagaagaccaacagaggccgccgcagcagcctgcctgtgacagaagatgagaaggaggaggagagcagcgaggaggaggatgaggacaagaggcggctgaatgatgagctgctgggcaaggtggtgtctgtggtgtctgccacagagaggacagagtggtacccagccctggtgatcagccccagctgcaatgatgacatcaccgtgaagaaggaccagtgcctggtgcgctccttcatcgacagcaagttctacagcatcgccaggaaggacatcaaggaggtggacatcctgaacctgcctgagagcgagctgagcaccaagccaggcctgcagaaggccagcatcttcctgaagaccagggtggtgcctgacaactggaagatggacatcagcgagatcctggagagcagcagcagtgatgatgaagatggccctgctgaggagaatgatgaggagaaggagaaggaggccaagaagacagaggaggaggtgcctgaggaggagctggaccctgaggagcgggacaacttcctgcagcagctgtacaagttcatggaggaccggggcacccccatcaacaagccccctgtgctgggctacaaggacctgaacctcttcaagctgttccggctggtgtaccaccagggcggctgtgacaacattgattctggagctgtgtggaagcagatctacatggacctgggcatccccatcctgaacagcgctgccagctacaacgtgaagacagcctacaggaagtacctgtatggctttgaggagtactgccgcagcgccaacatccagttcagaacagtgcaccaccacgagcccaaggtgaaggaggagaagaaggacctggaggagagcatggaggaggccctgaagctggaccaggagatgcccctgacagaggtgaagtctgagccagaagaaaatattgacagcaacagcgagagcgagcgggaggagattgagctgaagagcccccggggcagaagaagaattgccagagatgtgaacagcatcaagaaggagattgaggaggagaagacagaggacaagctgaaggacaatgacacagagaacaaggatgtggatgatgattatgaaacagctgagaagaaggaaaatgagctgctgctgggcaggaagaacacccccaagcagaaggagaagaagatcaagaagcaggaggacagcgacaaggacagtgatgaggaggaggagaagagccaggagcgggaggagacagagagcaaatgtgacagcgagggggaggaggatgaggaggacatggagccctgcctgaccggcaccaaggtgaaggtgaagtatggccggggcaagacccagaagatctatgaggccagcatcaagagcacagaaattgatgatggagaggtgctgtacctggtgcactactacggctggaatgtgcgctatgatgagtgggtgaaggctgaccgcatcatctggcccctggacaagggcggccccaagaagaagcagaagaagaaggccaagaacaaggaggacagcgagaaggatgagaagagagatgaggagcggcagaagagcaagaggggccggccccccctgaagagcaccctgagcagcaacatgccctacggcctgagcaagacagccaacagcgagggcaagagtgacagctgcagcagtgacagcgagacagaagatgccctggagaagaacctgatcaatgaggagctgagcctgaaggatgagctggagaagaatgaaaacctgaatgatgacaagctggatgaggagaaccccaagatcagcgcccacatcctgaaggaaaatgacaggacccagatgcagcccctggagaccctgaagctggaggtgggggagaatgagcagatcgtgcagatcttcggcaacaagatggagaagacagaggaggtgaagaaggaggccgagaagagccccaagggcaaaggaagaagaagcaagaccaaggacctgagcctggagatcatcaagatcagcagctttggccagaatgaagctggcagcgagccccacatcgaggcccacagcctggagctgagcagcctggacaacaagaacttcagcagcgccacagaagatgaaattgaccagtgtgtgaaggagaagaagctgaagaggaagatcctgggccagagcagccctgagaagaagatcagaattgaaaatggcatggagatgaccaacacagtgtcccaggagaggaccagtgactgcatcggcagcgagggcatgaagaacctgaactttgagcagcactttgaaagagaaaatgaaggcatgcccagcctgattgctgagagcaaccagtgcatccagcagctgaccagcgagagatttgacagccctgctgaggagaccgtgaacatccccctgaaggaggatgaagatgccatgcccctcatcggccctgagaccctggtgtgccacgaggtggacctggatgacctggatgagaaggacaagaccagcattgaagatgtggccgtggagagcagcgagagcaacagcctggtgtccatccccccagccctgccccctgtggtgcagcacaacttctctgtggccagccccctgaccctgagccaggatgagagccgctctgtgaagtctgagagtgacatcaccatcgaggtggacagcattgctgaggagagccaggagggcctgtgtgagcgggagagcgccaatggatttgagaccaacgtggccagcggcacctgcagcatcatcgtgcaggagcgggagagccgggagaagggccagaagaggcccagtgatggcaacagcggcctgatggccaagaagcagaagaggacccccaagaggaccagcgctgctgccaagaatgagaagaatggaacagatgagctggacaacatgaacagcacagagcgcatctccttcctgcaggagaagctgcaggagatcaggaagtactacatgagcctgaagtctgaggtggccaccatcgacagaagaaggaagaggctgaagaagaaggaccgggaggtgtcccatgctggggcctccatgagcagcgccagcagtgacaccggcatgagccccagcagcagcagccccccccagaatgtgctggccgtggagtgcaggtag

SEQ ID NO: 144216 - DNA, 3774 bp, Artificial Sequence
  Description of Artificial Sequence: Synthetic coding sequence
atgaaggccgcagatgagcccgcctacctgactgtgggcacagatgtgtctgccaagtacagaggagccttctgtgaggccaagatcaagacagtgaagaggctggtgaaggtgaaggtgctgctgaagcaggacaacaccacccagctggtgcaggatgaccaggtgaagggccccctgcgggtgggcgccatcgtggagaccaggaccagtgatggcagcttccaggaggccatcatcagcaagctgacagatgcctcctggtacacagtggtgtttgatgatggagatgagaggaccctgcggaggaccagcctgtgcctgaagggggagcggcactttgctgagagcgagaccctggaccagctgcccctgaccaaccctgagcacttcggcacccctgtgattgccaagaagaccaacagaggccgccgcagcagcctgcctgtgacagaagatgagaaggaggaggagagcagcgaggaggaggatgaggacaagaggcggctgaatgatgagctgctgggcaaggtggtgtctgtggtgtctgccacagagaggacagagtggtacccagccctggtgatcagccccagctgcaatgatgacatcaccgtgaagaaggaccagtgcctggtgcgctccttcatcgacagcaagttctacagcatcgccaggaaggacatcaaggaggtggacatcctgaacctgcctgagagcgagctgagcaccaagccaggcctgcagaaggccagcatcttcctgaagaccagggtggtgcctgacaactggaagatggacatcagcgagatcctggagagcagcagcagtgatgatgaagatggccctgctgaggagaatgatgaggagaaggagaaggaggccaagaagacagaggaggaggtgcctgaggaggagctggaccctgaggagcgggacaacttcctgcagcagctgtacaagttcatggaggaccggggcacccccatcaacaagccccctgtgctgggctacaaggacctgaacctcttcaagctgttccggctggtgtaccaccagggcggctgtgacaacattgattctggagctgtgtggaagcagatctacatggacctgggcatccccatcctgaacagcgctgccagctacaacgtgaagacagcctacaggaagtacctgtatggctttgaggagtactgccgcagcgccaacatccagttcagaacagtgcaccaccacgagcccaaggtgaaggaggagaagaaggacctggaggagagcatggaggaggccctgaagctggaccaggagatgcccctgacagaggtgaagtctgagccagaagaaaatattgacagcaacagcgagagcgagcgggaggagattgagctgaagagcccccggggcagaagaagaattgccagagatgtgaacagcatcaagaaggagattgaggaggagaagacagaggacaagctgaaggacaatgacacagagaacaaggatgtggatgatgattatgaaacagctgagaagaaggaaaatgagctgctgctgggcaggaagaacacccccaagcagaaggagaagaagatcaagaagcaggaggacagcgacaaggacagtgatgaggaggaggagaagagccaggagcgggaggagacagagagcaaatgtgacagcgagggggaggaggatgaggaggacatggagccctgcctgaccggcaccaaggtgaaggtgaagtatggccggggcaagacccagaagatctatgaggccagcatcaagagcacagaaattgatgatggagaggtgctgtacctggtgcactactacggctggaatgtgcgctatgatgagtgggtgaaggctgaccgcatcatctggcccctggacaagggcggccccaagaagaagcagaagaagaaggccaagaacaaggaggacagcgagaaggatgagaagagagatgaggagcggcagaagagcaagaggggccggccccccctgaagagcaccctgagcagcaacatgccctacggcctgagcaagacagccaacagcgagggcaagagtgacagctgcagcagtgacagcgagacagaagatgccctggagaagaacctgatcaatgaggagctgagcctgaaggatgagctggagaagaatgaaaacctgaatgatgacaagctggatgaggagaaccccaagatcagcgcccacatcctgaaggaaaatgacaggacccagatgcagcccctggagaccctgaagctggaggtgggggagaatgagcagatcgtgcagatcttcggcaacaagatggagaagacagaggaggtgaagaaggaggccgagaagagccccaagggcaaaggaagaagaagcaagaccaaggacctgagcctggagatcatcaagatcagcagctttggccagaatgaagctggcagcgagccccacatcgaggcccacagcctggagctgagcagcctggacaacaagaacttcagcagcgccacagaagatgaaattgaccagtgtgtgaaggagaagaagctgaagaggaagatcctgggccagagcagccctgagaagaagatcagaattgaaaatggcatggagatgaccaacacagtgtcccaggagaggaccagtgactgcatcggcagcgagggcatgaagaacctgaactttgagcagcactttgaaagagaaaatgaaggcatgcccagcctgattgctgagagcaaccagtgcatccagcagctgaccagcgagagatttgacagccctgctgaggagaccgtgaacatccccctgaaggaggatgaagatgccatgcccctcatcggccctgagaccctggtgtgccacgaggtggacctggatgacctggatgagaaggacaagaccagcattgaagatgtggccgtggagagcagcgagagcaacagcctggtgtccatccccccagccctgccccctgtggtgcagcacaacttctctgtggccagccccctgaccctgagccaggatgagagccgctctgtgaagtctgagagtgacatcaccatcgaggtggacagcattgctgaggagagccaggagggcctgtgtgagcgggagagcgccaatggatttgagaccaacgtggccagcggcacctgcagcatcatcgtgcaggagcgggagagccgggagaagggccagaagaggcccagtgatggcaacagcggcctgatggccaagaagcagaagaggacccccaagaggaccagcgctgctgccaagaatgagaagaatggaacaggccagagcagtgacagcgaggacctgcctgtgctggacaacagcagcaagtgcacccctgtgaagcacctgaatgtgtccaagccccagaagctggcccggagccctgcccgcatcagcccccacatcaaggatggagagaaggacaagcaccgggagaagcaccccaacagcagccccaggacctacaagtggagcttccagctgaatgagctggacaacatgaacagcacagagcgcatctccttcctgcaggagaagctgcaggagatcaggaagtactacatgagcctgaagtctgaggtggccaccatcgacagaagaaggaagaggctgaagaagaaggaccgggaggtgtcccatgctggggcctccatgagcagcgccagcagtgacaccggcatgagccccagcagcagcagccccccccagaatgtgctggccgtggagtgcaggtag

SEQ ID NO: 144217 - DNA, 3612 bp, Artificial Sequence
  Description of Artificial Sequence: Synthetic coding sequence
atgaaggccgcagatgagcccgcctacctgactgtgggcacagatgtgtctgccaagtacagaggagccttctgtgaggccaagatcaagacagtgaagaggctggtgaaggtgaaggtgctgctgaagcaggacaacaccacccagctggtgcaggatgaccaggtgaagggccccctgcgggtgggcgccatcgtggagaccaggaccagtgatggcagcttccaggaggccatcatcagcaagctgacagatgcctcctggtacacagtggtgtttgatgatggagatgagaggaccctgcggaggaccagcctgtgcctgaagggggagcggcactttgctgagagcgagaccctggaccagctgcccctgaccaaccctgagcacttcggcacccctgtgattgccaagaagaccaacagaggccgccgcagcagcctgcctgtgacagaagatgagaaggaggaggagagcagcgaggaggaggatgaggacaagaggcggctgaatgatgagctgctgggcaaggtggtgtctgtggtgtctgccacagagaggacagagtggtacccagccctggtgatcagccccagctgcaatgatgacatcaccgtgaagaaggaccagtgcctggtgcgctccttcatcgacagcaagttctacagcatcgccaggaaggacatcaaggaggtggacatcctgaacctgcctgagagcgagctgagcaccaagccaggcctgcagaaggccagcatcttcctgaagaccagggtggtgcctgacaactggaagatggacatcagcgagatcctggagagcagcagcagtgatgatgaagatggccctgctgaggagaatgatgaggagaaggagaaggaggccaagaagacagaggaggaggtgcctgaggaggagctggaccctgaggagcgggacaacttcctgcagcagctgtacaagttcatggaggaccggggcacccccatcaacaagccccctgtgctgggctacaaggacctgaacctcttcaagctgttccggctggtgtaccaccagggcggctgtgacaacattgattctggagctgtgtggaagcagatctacatggacctgggcatccccatcctgaacagcgctgccagctacaacgtgaagacagcctacaggaagtacctgtatggctttgaggagtactgccgcagcgccaacatccagttcagaacagtgcaccaccacgagcccaaggtgaaggaggagaagaaggacctggaggagagcatggaggaggccctgaagctggaccaggagatgcccctgacagaggtgaagtctgagccagaagaaaatattgacagcaacagcgagagcgagcgggaggagattgagctgaagagcccccggggcagaagaagaattgccagagatgtgaacagcatcaagaaggagattgaggaggagaagacagaggacaagctgaaggacaatgacacagagaacaaggatgtggatgatgattatgaaacagctgagaagaaggaaaatgagctgctgctgggcaggaagaacacccccaagcagaaggagaagaagatcaagaagcaggaggacagcgacaaggacagtgatgaggaggaggagaagagccaggagcgggaggagacagagagcaaatgtgacagcgagggggaggaggatgaggaggacatggagccctgcctgaccggcaccaaggtgaaggtgaagtatggccggggcaagacccagaagatctatgaggccagcatcaagagcacagaaattgatgatggagaggtgctgtacctggtgcactactacggctggaatgtgcgctatgatgagtgggtgaaggctgaccgcatcatctggcccctggacaagggcggccccaagaagaagcagaagaagaaggccaagaacaaggaggacagcgagaaggatgagaagagagatgaggagcggcagaagagcaagaggggccggccccccctgaagagcaccctgagcagcaacatgccctacggcctgagcaagacagccaacagcgagggcaagagtgacagctgcagcagtgacagcgagacagaagatgccctggagaagaacctgatcaatgaggagctgagcctgaaggatgagctggagaagaatgaaaacctgaatgatgacaagctggatgaggagaaccccaagatcagcgcccacatcctgaaggaaaatgacaggacccagatgcagcccctggagaccctgaagctggaggtgggggagaatgagcagatcgtgcagatcttcggcaacaagatggagaagacagaggaggtgaagaaggaggccgagaagagccccaagggcaaaggaagaagaagcaagaccaaggacctgagcctggagatcatcaagatcagcagctttggccagaatgaagctggcagcgagccccacatcgaggcccacagcctggagctgagcagcctggacaacaagaacttcagcagcgccacagaagatgaaattgaccagtgtgtgaaggagaagaagctgaagaggaagatcctgggccagagcagccctgagaagaagatcagaattgaaaatggcatggagatgaccaacacagtgtcccaggagaggaccagtgactgcatcggcagcgagggcatgaagaacctgaactttgagcagcactttgaaagagaaaatgaaggcatgcccagcctgattgctgagagcaaccagtgcatccagcagctgaccagcgagagatttgacagccctgctgaggagaccgtgaacatccccctgaaggaggatgaagatgccatgcccctcatcggccctgagaccctggtgtgccacgaggtggacctggatgacctggatgagaaggacaagaccagcattgaagatgtggccgtggagagcagcgagagcaacagcctggtgtccatccccccagccctgccccctgtggtgcagcacaacttctctgtggccagccccctgaccctgagccaggatgagagccgctctgtgaagtctgagagtgacatcaccatcgaggtggacagcattgctgaggagagccaggagggcctgtgtgagcgggagagcgccaatggatttgagaccaacgtggccagcggcacctgcagcatcatcgtgcaggagcgggagagccgggagaagggccagaagaggcccagtgatggcaacagcggcctgatggccaagaagcagaagaggacccccaagaggaccagcgctgctgccaagaatgagaagaatggaacaggccagagcagtgacagcgaggacctgcctgtgctggacaacagcaatgagctggacaacatgaacagcacagagcgcatctccttcctgcaggagaagctgcaggagatcaggaagtactacatgagcctgaagtctgaggtggccaccatcgacagaagaaggaagaggctgaagaagaaggaccgggaggtgtcccatgctggggcctccatgagcagcgccagcagtgacaccggcatgagccccagcagcagcagccccccccagaatgtgctggccgtggagtgcaggtag

SEQ ID NO: 144218 - DNA, 165 bp, Artificial Sequence
  Description of Artificial Sequence: Synthetic coding sequence
atgaaggccgcagatgagcccgcctacctgactgtgggcacagatgtgtctgccaagtacagaggagccttctgtgaggccaagatcaagacagtgaagaggctggtgaaggtgaaggtgctgctgaagcaggacaacaccacccagctggtgcaggatgactag

SEQ ID NO: 144219 - DNA, 3567 bp, Artificial Sequence; identical to SEQ ID NO: 144215
  Description of Artificial Sequence: Synthetic coding sequence

SEQ ID NO: 144220 - DNA, 3939 bp, Artificial Sequence
  Description of Artificial Sequence: Synthetic coding sequence
atgaaggccctggatgagcccccctacctgactgtgggcacagatgtgtctgccaagtacagaggagccttctgtgaggccaagatcaagacagccaagaggctggtgaaggtgaaggtgaccttcagacatgacagcagcacagtggaggtgcaggatgaccacatcaagggccccctgaaggtgggcgccatcgtggaggtgaagaacctggatggagcctaccaggaggccgtcatcaacaagctgacagatgcctcctggtacacagtggtgtttgatgatggagatgagaagaccctgcggcgcagcagcctgtgcctgaagggggagcggcactttgctgagagcgagaccctggaccagctgcccctgaccaaccctgagcacttcggcacccctgtgattggcaagaagaccaacagaggccgccgcagcaaccacatccctgaggaggagagcagcagcagcagcagtgatgaagatgaagatgacaggaagcagattgatgagctgctgggcaaggtggtgtgtgtggactacatcagcctggacaagaagaaggccctgtggttccctgccctggtggtgtgcccagactgcagtgatgaaattgctgtgaagaaggacaacatcctggtgcgctccttcaaggatggcaagttcacctctgtgcccaggaaggatgtgcatgagatcaccagtgacacagcccccaagccagatgctgtgctgaagcaggcctttgagcaggccctggagttccacaagagcaggaccatcccagccaactggaagacagagctgaaggaggacagcagcagcagcgaggccgaggaggaggaggaggaggaggatgatgagaaggagaaggaggacaacagcagcgaggaggaggaggagattgagcccttccctgaggagcgggagaacttcctgcagcagctgtacaagttcatggaggaccggggcacccccatcaacaagaggcctgtgctgggctacagaaacctgaacctcttcaagctgttccggctggtgcacaagctgggcggctttgacaacatcgagagcggggctgtgtggaagcaggtgtaccaggacctgggcatccctgtgctgaacagcgctgctggctacaacgtgaagtgtgcctacaagaagtacctgtatggctttgaggagtactgccgcagcgccaacatcgagttccagatggccctgcctgagaaggtggtgaacaagcagtgcaaggaatgtgaaaatgtgaaggagatcaaggtgaaggaggagaatgaaacagagatcaaggagatcaagatggaggaggagaggaacatcatcccccgggaggagaagcccattgaagatgaaattgaaagaaaagaaaacatcaagcccagcctgggcagcaagaagaacctgctggagagcatccccacccacagcgaccaggagaaggaggtgaacatcaagaagccagaagataatgaaaacctggatgacaaggatgatgacaccaccagggtggatgagagcctgaacatcaaggtggaggccgaggaggagaaggccaagtctggagatgagaccaacaaggaggaggatgaagatgatgaggaggccgaggaggaggaggaggaggaggaggaggaggaggatgaagatgatgatgacaacaatgaggaggaggagtttgagtgctacccacctggcatgaaggtgcaggtgcgctatggccggggcaagaaccagaagatgtatgaggccagcatcaaggacagtgatgtggagggcggggaggtgctgtacctggtgcactactgcggctggaatgtgcgctatgatgagtggatcaaggctgacaagatcgtgcggcctgctgacaagaatgtgcccaagatcaagcacaggaagaagatcaagaacaagctggacaaggagaaggacaaggatgagaagtacagccccaagaactgcaagctgcggcggctgagcaagccacccttccagaccaaccccagccctgagatggtgtccaagctggacctgacagatgccaagaacagcgacacagcccacatcaagagcattgagatcaccagcatcctgaatggcctgcaggccagcgagagcagcgcagaagattctgagcaggaggatgagcggggggcccaggacatggacaacaacgggaaggaggagagcaagattgaccacctgaccaacaacagaaatgacctgatcagcaaggaggagcagaacagcagcagcctgctggaggagaacaaggtgcatgctgacctggtgatcagcaagcctgtgtccaagagccctgagcggctgaggaaggacatcgaggtgctgtctgaggacacagattatgaagaagatgaggtgaccaagaagaggaaggatgtgaagaaggacaccacagacaagagcagcaagccccagatcaagaggggcaagaggcgctactgcaacacagaggagtgcctgaagacaggcagccctgggaagaaggaggagaaggccaagaacaaggagagcctgtgcatggagaacagcagcaacagcagcagtgatgaagatgaggaggagaccaaggccaagatgacccccaccaagaagtacaacggcctggaggagaagaggaagagcctgcggaccaccggcttctacagcggcttcagcgaggtggccgagaagaggatcaagctgctgaacaacagtgatgagcggctgcagaacagccgggccaaggacaggaaggatgtgtggagcagcatccagggccagtggcccaagaagaccctgaaggagctgttcagtgacagcgacacagaagctgctgccagccccccccacccagcccctgaggagggcgtggccgaggagagcctgcagacagtggccgaggaggagagctgcagccccagcgtggagctggagaagcccccacctgtgaatgtggacagcaagcccatcgaggagaagacagtggaggtgaatgacaggaaggccgagttccccagcagcggcagcaacagcgtgctgaacaccccacccaccaccccagagagccccagctctgtgacagtgacagagggcagccggcagcagagctctgtgacagtgtctgagcccctggcccccaaccaggaggaggtgcgcagcatcaagtcagaaacagacagcaccatcgaggtggacagcgtggccggggagctgcaggacctgcagagcgagggcaacagcagccctgctggctttgatgcctctgtgagcagcagcagcagcaaccagcctgagcctgagcaccctgagaaggcctgcaccggccagaagagggtgaaggatgcccagggcggcggcagcagcagcaagaagcagaagaggagccacaaggccaccgtggtgaacaacaagaagaagggcaagggcaccaacagcagtgacagcgaggagctgtctgctggggagagcatcaccaagagccagcctgtgaagtctgtgtccacaggcatgaagagccacagcaccaagagccctgcccggacccagagccctggaaaatgtgggaagaatggagacaaggaccctgacctgaaggagcccagcaaccggctgcccaaggtgtacaagtggagcttccagatgtctgacctggagaacatgaccagcgctgagcgcatcaccatcctgcaggagaagctgcaggagatcaggaagcactacctgagcctgaagtctgaggtggccagcattgacagaagaaggaagaggctgaagaagaaggagcgggagagcgctgccaccagcagcagcagcagcagccccagcagcagcagcatcacagctgctgtgatgctgaccctggccgagcccagcatgagcagcgccagccagaatggcatgtctgtggagtgcaggtag

SEQ ID NO: 144221 - DNA, 3681 bp, Artificial Sequence
  Description of Artificial Sequence: Synthetic coding sequence
atgaaggccctggatgagcccccctacctgactgtgggcacagatgtgtctgccaagtacagaggagccttctgtgaggccaagatcaagacagccaagaggctggtgaaggtgaaggtgaccttcagacatgacagcagcacagtggaggtgcaggatgaccacatcaagggccccctgaaggtgggcgccatcgtggaggtgaagaacctggatggagcctaccaggaggccgtcatcaacaagctgacagatgcctcctggtacacagtggtgtttgatgatggagatgagaagaccctgcggcgcagcagcctgtgcctgaagggggagcggcactttgctgagagcgagaccctggaccagctgcccctgaccaaccctgagcacttcggcacccctgtgattggcaagaagaccaacagaggccgccgcagcaaccacatccctgaggaggagagcagcagcagcagcagtgatgaagatgaagatgacaggaagcagattgatgagctgctgggcaaggtggtgtgtgtggactacatcagcctggacaagaagaaggccctgtggttccctgccctggtggtgtgcccagactgcagtgatgaaattgctgtgaagaaggacaacatcctggtgcgctccttcaaggatggcaagttcacctctgtgcccaggaaggatgtgcatgagatcaccagtgacacagcccccaagccagatgctgtgctgaagcaggcctttgagcaggccctggagttccacaagagcaggaccatcccagccaactggaagacagagctgaaggaggacagcagcagcagcgaggccgaggaggaggaggaggaggaggatgatgagaaggagaaggaggacaacagcagcgaggaggaggaggagattgagcccttccctgaggagcgggagaacttcctgcagcagctgtacaagttcatggaggaccggggcacccccatcaacaagaggcctgtgctgggctacagaaacctgaacctcttcaagctgttccggctggtgcacaagctgggcggctttgacaacatcgagagcggggctgtgtggaagcaggtgtaccaggacctgggcatccctgtgctgaacagcgctgctggctacaacgtgaagtgtgcctacaagaagtacctgtatggctttgaggagtactgccgcagcgccaacatcgagttccagatggccctgcctgagaaggtggtgaacaagcagtgcaaggaatgtgaaaatgtgaaggagatcaaggtgaaggaggagaatgaaacagagatcaaggagatcaagatggaggaggagaggaacatcatcccccgggaggagaagcccattgaagatgaaattgaaagaaaagaaaacatcaagcccagcctgggcagcaagaagaacctgctggagagcatccccacccacagcgaccaggagaaggaggtgaacatcaagaagccagaagataatgaaaacctggatgacaaggatgatgacaccaccagggtggatgagagcctgaacatcaaggtggaggccgaggaggagaaggccaagagcggctatgatgagtggatcaaggctgacaagatcgtgcggcctgctgacaagaatgtgcccaagatcaagcacaggaagaagatcaagaacaagctggacaaggagaaggacaaggatgagaagtacagccccaagaactgcaagctgcggcggctgagcaagccacccttccagaccaaccccagccctgagatggtgtccaagctggacctgacagatgccaagaacagcgacacagcccacatcaagagcattgagatcaccagcatcctgaatggcctgcaggccagcgagagcagcgcagaagattctgagcaggaggatgagcggggggcccaggacatggacaacaacgggaaggaggagagcaagattgaccacctgaccaacaacagaaatgacctgatcagcaaggaggagcagaacagcagcagcctgctggaggagaacaaggtgcatgctgacctggtgatcagcaagcctgtgtccaagagccctgagcggctgaggaaggacatcgaggtgctgtctgaggacacagattatgaagaagatgaggtgaccaagaagaggaaggatgtgaagaaggacaccacagacaagagcagcaagccccagatcaagaggggcaagaggcgctactgcaacacagaggagtgcctgaagacaggcagccctgggaagaaggaggagaaggccaagaacaaggagagcctgtgcatggagaacagcagcaacagcagcagtgatgaagatgaggaggagaccaaggccaagatgacccccaccaagaagtacaacggcctggaggagaagaggaagagcctgcggaccaccggcttctacagcggcttcagcgaggtggccgagaagaggatcaagctgctgaacaacagtgatgagcggctgcagaacagccgggccaaggacaggaaggatgtgtggagcagcatccagggccagtggcccaagaagaccctgaaggagctgttcagtgacagcgacacagaagctgctgccagccccccccacccagcccctgaggagggcgtggccgaggagagcctgcagacagtggccgaggaggagagctgcagccccagcgtggagctggagaagcccccacctgtgaatgtggacagcaagcccatcgaggagaagacagtggaggtgaatgacaggaaggccgagttccccagcagcggcagcaacagcgtgctgaacaccccacccaccaccccagagagccccagctctgtgacagtgacagagggcagccggcagcagagctctgtgacagtgtctgagcccctggcccccaaccaggaggaggtgcgcagcatcaagtcagaaacagacagcaccatcgaggtggacagcgtggccggggagctgcaggacctgcagagcgagggcaacagcagccctgctggctttgatgcctctgtgagcagcagcagcagcaaccagcctgagcctgagcaccctgagaaggcctgcaccggccagaagagggtgaaggatgcccagggcggcggcagcagcagcaagaagcagaagaggagccacaaggccaccgtggtgaacaacaagaagaagggcaagggcaccaacagcagtgacagcgaggagctgtctgctggggagagcatcaccaagagccagcctgtgaagtctgtgtccacaggcatgaagagccacagcaccaagagccctgcccggacccagagccctggaaaatgtgggaagaatggagacaaggaccctgacctgaaggagcccagcaaccggctgcccaaggtgtacaagtggagcttccagatgtctgacctggagaacatgaccagcgctgagcgcatcaccatcctgcaggagaagctgcaggagatcaggaagcactacctgagcctgaagtctgaggtggccagcattgacagaagaaggaagaggctgaagaagaaggagcgggagagcgctgccaccagcagcagcagcagcagccccagcagcagcagcatcacagctgctgtgatgctgaccctggccgagcccagcatgagcagcgccagccagaatggcatgtctgtggagtgcaggtag

SEQ ID NO: 144222 - DNA, 3939 bp, Artificial Sequence; identical to SEQ ID NO: 144220
  Description of Artificial Sequence: Synthetic coding sequence

SEQ ID NO: 144223 - DNA, 3462 bp, Artificial Sequence
  Description of Artificial Sequence: Synthetic coding sequence
atgaaggccctggatgagcccccctacctgactgtgggcacagatgtgtctgccaagtacagaggagccttctgtgaggccaagatcaagacagccaagaggctggtgaaggtgaaggtgaccttcagacatgacagcagcacagtggaggtgcaggatgaccacatcaagggccccctgaaggtgggcgccatcgtggaggtgaagaacctggatggagcctaccaggaggccgtcatcaacaagctgacagatgcctcctggtacacagtggtgtttgatgatggagatgagaagaccctgcggcgcagcagcctgtgcctgaagggggagcggcactttgctgagagcgagaccctggaccagctgcccctgaccaaccctgagcacttcggcacccctgtgattggcaagaagaccaacagaggccgccgcagcaaccacatccctgaggaggagagcagcagcagcagcagtgatgaagatgaagatgacaggaagcagattgatgagctgctgggcaaggtggtgtgtgtggactacatcagcctggacaagaagaaggccctgtggttccctgccctggtggtgtgcccagactgcagtgatgaaattgctgtgaagaaggacaacatcctggtgcgctccttcaaggatggcaagttcacctctgtgcccaggaaggatgtgcatgagatcaccagtgacacagcccccaagccagatgctgtgctgaagcaggcctttgagcaggccctggagttccacaagagcaggaccatcccagccaactggaagacagagctgaaggaggacagcagcagcagcgaggccgaggaggaggaggaggaggaggatgatgagaaggagaaggaggacaacagcagcgaggaggaggaggagattgagcccttccctgaggagcgggagaacttcctgcagcagctgtacaagttcatggaggaccggggcacccccatcaacaagaggcctgtgctgggctacagaaacctgaacctcttcaagctgttccggctggtgcacaagctgggcggctttgacaacatcgagagcggggctgtgtggaagcaggtgtaccaggacctgggcatccctgtgctgaacagcgctgctggctacaacgtgaagtgtgcctacaagaagtacctgtatggctttgaggagtactgccgcagcgccaacatcgagttccagatggccctgcctgagaaggtggtgaacaagcagtgcaaggaatgtgaaaatgtgaaggagatcaaggtgaaggaggagaatgaaacagagatcaaggagatcaagatggaggaggagaggaacatcatcccccgggaggagaagcccattgaagatgaaattgaaagaaaagaaaacatcaagcccagcctgggcagcaagaagaacctgctggagagcatccccacccacagcgaccaggagaaggaggtgaacatcaagaagccagaagataatgaaaacctggatgacaaggatgatgacaccaccagggtggatgagagcctgaacatcaaggtggaggccgaggaggagaaggccaagtctggagatgagaccaacaaggaggaggatgaagatgatgaggaggccgaggaggaggaggaggaggaggaggaggaggaggatgaagatgatgatgacaacaatgaggaggaggagtttgagtgctacccacctggcatgaaggtgcaggtgcgctatggccggggcaagaaccagaagatgtatgaggccagcatcaaggacagtgatgtggagggcggggaggtgctgtacctggtgcactactgcggctggaatgtgcgctatgatgagtggatcaaggctgacaagatcgtgcggcctgctgacaagaatgtgcccaagatcaagcacaggaagaagatcaagaacaagctggacaaggagaaggacaaggatgagaagtacagccccaagaactgcaagctgcggcggctgagcaagccacccttccagaccaaccccagccctgagatggtgtccaagctggacctgacagatgccaagaacagcgacacagcccacatcaagagcattgagatcaccagcatcctgaatggcctgcaggccagcgagagcagcgcagaagattctgagcaggaggatgagcggggggcccaggacatggacaacaacgggaaggaggagagcaagattgaccacctgaccaacaacagaaatgacctgatcagcaaggaggagcagaacagcagcagcctgctggaggagaacaaggtgcatgctgacctggtgatcagcaagcctgtgtccaagagccctgagcggctgaggaaggacatcgaggtgctgtctgaggacacagattatgaagaagatgaggtgaccaagaagaggaaggatgtgaagaaggacaccacagacaagagcagcaagccccagatcaagaggggcaagaggcgctactgcaacacagaggagtgcctgaagacaggcagccctgggaagaaggaggagaaggccaagaacaaggagagcctgtgcatggagaacagcagcaacagcagcagtgatgaagatgaggaggagaccaaggccaagatgacccccaccaagaagtacaacggcctggaggagaagaggaagagcctgcggaccaccggcttctacagcggcttcagcgaggtggccgagaagaggatcaagctgctgaacaacagtgatgagcggctgcagaacagccgggccaaggacaggaaggatgtgtggagcagcatccagggccagtggcccaagaagaccctgaaggagctgttcagtgacagcgacacagaagctgctgccagccccccccacccagcccctgaggagggcgtggccgaggagagcctgcagacagtggccgaggaggagagctgcagccccagcgtggagctggagaagcccccacctgtgaatgtggacagcaagcccatcgaggagaagacagtggaggtgaatgacaggaaggccgagttccccagcagcggcagcaacagcgtgctgaacaccccacccaccaccccagagagccccagctctgtgacagtgacagagggcagccggcagcagagctctgtgacagtgtctgagcccctggcccccaaccaggaggaggtgcgcagcatcaagtcagaaacagacagcaccatcgaggtggacagcgtggccggggagctgcaggacctgcagagcgagggcaacagcagccctgctggctttgatgcctctgtgagcagcagcagcagcaaccagcctgagcctgagcaccctgagaaggcctgcaccggccagaagagggtgaaggatgcccagggcggcggcagcagcagcaagaagcagaagaggagccacaaggccaccgtggtgaacaacaagaagaagggcaagggcatcctgccccactag

SEQ ID NO: 144224 - DNA, 1452 bp, Artificial Sequence
  Description of Artificial Sequence: Synthetic coding sequence
atgaaggccctggatgagcccccctacctgactgtgggcacagatgtgtctgccaagtacagaggagccttctgtgaggccaagatcaagacagccaagaggctggtgaaggtgaaggtgaccttcagacatgacagcagcacagtggaggtgcaggatgaccacatcaagggccccctgaaggtgggcgccatcgtggaggtgaagaacctggatggagcctaccaggaggccgtcatcaacaagctgacagatgcctcctggtacacagtggtgtttgatgatggagatgagaagaccctgcggcgcagcagcctgtgcctgaagggggagcggcactttgctgagagcgagaccctggaccagctgcccctgaccaaccctgagcacttcggcacccctgtgattggcaagaagaccaacagaggccgccgcagcaaccacatccctgaggaggagagcagcagcagcagcagtgatgaagatgaagatgacaggaagcagattgatgagctgctgggcaaggtggtgtgtgtggactacatcagcctggacaagaagaaggccctgtggttccctgccctggtggtgtgcccagactgcagtgatgaaattgctgtgaagaaggacaacatcctggtgcgctccttcaaggatggcaagttcacctctgtgcccaggaaggatgtgcatgagatcaccagtgacacagcccccaagccagatgctgtgctgaagcaggcctttgagcaggccctggagttccacaagagcaggaccatcccagccaactggaagacagagctgaaggaggacagcagcagcagcgaggccgaggaggaggaggaggaggaggatgatgagaaggagaaggaggacaacagcagcgaggaggaggaggagattgagcccttccctgaggagcgggagaacttcctgcagcagctgtacaagttcatggaggaccggggcacccccatcaacaagaggcctgtgctgggctacagaaacctgaacctcttcaagctgttccggctggtgcacaagctgggcggctttgacaacatcgagagcggggctgtgtggaagcaggtgtaccaggacctgggcatccctgtgctgaacagcgctgctggctacaacgtgaagtgtgcctacaagaagtacctgtatggctttgaggagtactgccgcagcgccaacatcgagttccagatggccctgcctgagaaggtggtgaacaagcagtgcaaggaatgtgaaaatgtgaaggagatcaaggtgaaggaggagaatgaaacagagatcaaggagatcaagatggaggaggagaggaacatcatcccccgggaggagaagcccattgaagatgaaattgaaagaaaagaaaacatcaagcccagcctgggcagcaagaagaacctgctggagagcatccccacccacagctag

SEQ ID NO: 144225 - DNA, 1968 bp, Artificial Sequence
  Description of Artificial Sequence: Synthetic coding sequence
atgaaggccctggatgagcccccctacctgactgtgggcacagatgtgtctgccaagtacagaggagccttctgtgaggccaagatcaagacagccaagaggctggtgaaggtgaaggtgaccttcagacatgacagcagcacagtggaggtgcaggatgaccacatcaagggccccctgaaggtgggcgccatcgtggaggtgaagaacctggatggagcctaccaggaggccgtcatcaacaagctgacagatgcctcctggtacacagtggtgtttgatgatggagatgagaagaccctgcggcgcagcagcctgtgcctgaagggggagcggcactttgctgagagcgagaccctggaccagctgcccctgaccaaccctgagcacttcggcacccctgtgattggcaagaagaccaacagaggccgccgcagcaaccacatccctgaggaggagagcagcagcagcagcagtgatgaagatgaagatgacaggaagcagattgatgagctgctgggcaaggtggtgtgtgtggactacatcagcctggacaagaagaaggccctgtggttccctgccctggtggtgtgcccagactgcagtgatgaaattgctgtgaagaaggacaacatcctggtgcgctccttcaaggatggcaagttcacctctgtgcccaggaaggatgtgcatgagatcaccagtgacacagcccccaagccagatgctgtgctgaagcaggcctttgagcaggccctggagttccacaagagcaggaccatcccagccaactggaagacagagctgaaggaggacagcagcagcagcgaggccgaggaggaggaggaggaggaggatgatgagaaggagaaggaggacaacagcagcgaggaggaggaggagattgagcccttccctgaggagcgggagaacttcctgcagcagctgtacaagttcatggaggaccggggcacccccatcaacaagaggcctgtgctgggctacagaaacctgaacctcttcaagctgttccggctggtgcacaagctgggcggctttgacaacatcgagagcggggctgtgtggaagcaggtgtaccaggacctgggcatccctgtgctgaacagcgctgctggctacaacgtgaagtgtgcctacaagaagtacctgtatggctttgaggagtactgccgcagcgccaacatcgagttccagatggccctgcctgagaaggtggtgaacaagcagtgcaaggaatgtgaaaatgtgaaggagatcaaggtgaaggaggagaatgaaacagagatcaaggagatcaagatggaggaggagaggaacatcatcccccgggaggagaagcccattgaagatgaaattgaaagaaaagaaaacatcaagcccagcctgggcagcaagaagaacctgctggagagcatccccacccacagcgaccaggagaaggaggtgaacatcaagaagccagaagataatgaaaacctggatgacaaggatgatgacaccaccagggtggatgagagcctgaacatcaaggtggaggccgaggaggagaaggccaagtctggagatgagaccaacaaggaggaggatgaagatgatgaggaggccgaggaggaggaggaggaggaggaggaggaggaggatgaagatgatgatgacaacaatgaggaggaggagtttgagtgctacccacctggcatgaaggtgcaggtgcgctatggccggggcaagaaccagaagatgtatgaggccagcatcaaggacagtgatgtggagggcggggaggtgctgtacctggtgcactactgcggctggaatgtgcgctatgatgagtggatcaaggctgacaagatcgtgcggcctgctgacaagaatgtgcccaagatcaagcacaggaagaagatcaagaacagcgtgtacaagaagaagaagaagaagaagaacaagtag

SEQ ID NO: 144226 - DNA, 1785 bp, Artificial Sequence
  Description of Artificial Sequence: Synthetic coding sequence
atggccgcccctgtgaagggcaacaggaagcagagcacagaaggagatgccctggaccccccagccagccccaagccagctgggaagcagaatggcatccagaaccccatcagcctggaggacagccctgaggccggcggggagcgggaggaggagcaggagcgggaggaggagcaggccttcctggtgtccctgtacaagttcatgaaggagcggcacacccccatcgagcgggtgccccacctgggcttcaagcagatcaacctgtggaagatctacaaggctgtggagaagctgggcgcctatgagctggtgacaggccggcggctgtggaagaatgtgtatgatgagctgggcggcagccctggcagcaccagcgctgccacctgcacccggcggcactatgagcggctggtgctgccctacgtgcgccacctgaagggagaagatgacaagcccctgcccaccagcaagcccaggaagcagtacaagatggccaaggagaacagaggagatgatggagccacagagcggcccaagaaggccaaggaggagaggaggatggaccagatgatgcctgggaagaccaaggcagatgctgctgaccctgcccccctgcccagccaggagcccccaagaaacagcacagagcagcagggcctggccagcggcagctctgtgtcctttgtgggcgccagcggctgcccagaggcctacaagaggctgctgagcagcttctactgcaagggcacccacggcatcatgagccccctggccaagaagaagctgctggcccaggtgtccaaggtggaggccctgcagtgccaggaggagggctgccgccacggggctgagccccaggccagccctgctgtgcacctgcctgagagcccccagagccccaagggcctgacagagaacagccgccaccggctgaccccccaggagggcctgcaggcccctgggggcagcctgcgggaggaggcccaggccggcccctgcccagctgcccccatcttcaagggctgcttctacacccaccccacagaggtgctgaagcctgtgtcccagcacccccgggacttcttcagccggctgaaggatggagtgctgctgggccccccaggcaaggagggcctgtctgtgaaggagccccagctggtgtggggcggagatgccaaccggcccagcgccttccacaagggcggcagcaggaagggcatcctgtaccccaagcccaaggcctgctgggtgagccccatggccaaggtgcctgctgagagccccaccctgccccccaccttccccagcagccctggcctgggcagcaagaggagcctggaggaggagggcgccgcccacagcggcaagaggctgcgggctgtgagccccttcctgaaggaggctgatgccaagaagtgtggggccaagccagctggcagcggcctggtgtcctgcctgctgggccctgccctgggccctgtgcccccagaggcctaccggggcaccatgctgcactgccccctgaacttcaccggcaccccaggccccctgaagggccaggccgccctgcccttcagccccctggtgatcccagccttccctgcccacttcctggccacagctggccccagccccatggctgctggcctgatgcacttcccccccaccagctttgattctgccctgcggcaccggctgtgcccagccagcagcgcctggcacgcccctcctgtgaccacctatgctgccccccacttcttccacctgaacaccaagctgtag

SEQ ID NO: 144227 - DNA, 1917 bp, Artificial Sequence
  Description of Artificial Sequence: Synthetic coding sequence
atggccgcccctgtgaagggcaacaggaagcagagcacagaaggagatgccctggaccccccagccagccccaagccagctgggaagcagaatggcatccagaaccccatcagcctggaggacagccctgaggccggcggggagcgggaggaggagcaggagcgggaggaggagcaggccttcctggtgtccctgtacaagttcatgaaggagcggcacacccccatcgagcgggtgccccacctgggcttcaagcagatcaacctgtggaagatctacaaggctgtggagaagctgggcgcctatgagctggtgacaggccggcggctgtggaagaatgtgtatgatgagctgggcggcagccctggcagcaccagcgctgccacctgcacccggcggcactatgagcggctggtgctgccctacgtgcgccacctgaagggagaagatgacaagcccctgcccaccagcaagcccaggaagcagtacaagatggccaaggagaacagaggagatgatggagccacagagcggcccaagaaggccaaggaggagaggaggatggaccagatgatgcctgggaagaccaaggcagatgctgctgaccctgcccccctgcccagccaggagcccccaagaaacagcacagagcagcagggcctggccagcggcagctctgtgtcctttgtgggcgccagcggctgcccagaggcctacaagaggctgctgagcagcttctactgcaagggcacccacggcatcatgagccccctggccaagaagaagctgctggcccaggtgtccaaggtggaggccctgcagtgccaggaggagggctgccgccacggggctgagccccaggccagccctgctgtgcacctgcctgagagcccccagagccccaagggcctgacagagaacagccgccaccggctgaccccccaggagggcctgcaggcccctgggggcagcctgcgggaggaggcccaggccggcccctgcccagctgcccccatcttcaagggctgcttctacacccaccccacagaggtgctgaagcctgtgtcccagcacccccgggacttcttcagccggctgaaggatggagtgctgctgggccccccaggcaaggagggcctgtctgtgaaggagccccagctggtgtggggcggagatgccaaccggcccagcgccttccacaagggcggcagcaggaagggcatcctgtaccccaagcccaaggcctgctgggtgagccccatggccaaggtgcctgctgagagccccaccctgccccccaccttccccagcagccctggcctgggcagcaagaggagcctggaggaggagggcgccgcccacagcggcaagaggctgcgggctgtgagccccttcctgaaggaggctgatgccaagaagtgtggggccaagccagctggcagcggcctggtgtcctgcctgctgggccctgccctgggccctgtgcccccagaggcctaccggggcaccatgctgcactgccccctgaacttcaccggcacccaccaccagagccagcccatgcagaggcccaccagcagcaccagcacccccagctgcaggcctgcccatggagtggtgtacacagtggagagcactggagcctacaaccggcaggtgctgctgcccggcggcagcgagctggtgcctgccacccaggacacccgggccatgcccctggccggccagcccggcaccagcgaggaggagggcagcggcaagacaggcttcatcagccggcagcagcctgagcccaggagccggggccccagctgctacaaggccctgggagaagatggccagctgcccctgccccagagcggggcccggagcacccaggtggcccacggcaagagcaacaagaagacccctgtgtag

SEQ ID NO: 144228 - DNA, 1581 bp, Artificial Sequence
  Description of Artificial Sequence: Synthetic coding sequence
atgaaggagcggcacacccccatcgagcgggtgccccacctgggcttcaagcagatcaacctgtggaagatctacaaggctgtggagaagctgggcgcctatgagctggtgacaggccggcggctgtggaagaatgtgtatgatgagctgggcggcagccctggcagcaccagcgctgccacctgcacccggcggcactatgagcggctggtgctgccctacgtgcgccacctgaagggagaagatgacaagcccctgcccaccagcaagcccaggaagcagtacaagatggccaaggagaacagaggagatgatggagccacagagcggcccaagaaggccaaggaggagaggaggatggaccagatgatgcctgggaagaccaaggcagatgctgctgaccctgcccccctgcccagccaggagcccccaagaaacagcacagagcagcagggcctggccagcggcagctctgtgtcctttgtgggcgccagcggctgcccagaggcctacaagaggctgctgagcagcttctactgcaagggcacccacggcatcatgagccccctggccaagaagaagctgctggcccaggtgtccaaggtggaggccctgcagtgccaggaggagggctgccgccacggggctgagccccaggccagccctgctgtgcacctgcctgagagcccccagagccccaagggcctgacagagaacagccgccaccggctgaccccccaggagggcctgcaggcccctgggggcagcctgcgggaggaggcccaggccggcccctgcccagctgcccccatcttcaagggctgcttctacacccaccccacagaggtgctgaagcctgtgtcccagcacccccgggacttcttcagccggctgaaggatggagtgctgctgggccccccaggcaaggagggcctgtctgtgaaggagccccagctggtgtggggcggagatgccaaccggcccagcgccttccacaagggcggcagcaggaagggcatcctgtaccccaagcccaaggcctgctgggtgagccccatggccaaggtgcctgctgagagccccaccctgccccccaccttccccagcagccctggcctgggcagcaagaggagcctggaggaggagggcgccgcccacagcggcaagaggctgcgggctgtgagccccttcctgaaggaggctgatgccaagaagtgtggggccaagccagctggcagcggcctggtgtcctgcctgctgggccctgccctgggccctgtgcccccagaggcctaccggggcaccatgctgcactgccccctgaacttcaccggcaccccaggccccctgaagggccaggccgccctgcccttcagccccctggtgatcccagccttccctgcccacttcctggccacagctggccccagccccatggctgctggcctgatgcacttcccccccaccagctttgattctgccctgcggcaccggctgtgcccagccagcagcgcctggcacgcccctcctgtgaccacctatgctgccccccacttcttccacctgaacaccaagctgtag

SEQ ID NO: 144229 - DNA, 3567 bp, Artificial Sequence
  Description of Artificial Sequence: Synthetic coding sequence
atggagcccaacagcctgcagtgggtgggcagcccctgtggcctgcacggcccctacatcttctacaaggccttccagttccacctggagggcaagccccgcatcctgagcctgggggacttcttctttgtgcgctgcacccccaaggaccccatctgcatcgccgagctgcagctgctgtgggaggagaggaccagccggcagctgctgagcagcagcaagctgtacttcctgcctgaggacaccccccagggcaggaacagcgaccacggggaggatgaggtgattgctgtgtctgagaaggtgattgtgaagctggaggacctggtgaagtgggtgcacagcgacttcagcaagtggaggtgtggcttccacgccggccctgtgaagacagaggccctgggcagaaatggccagaaggaggccctgctgaagtaccggcagagcaccctgaacagcggcctgaacttcaaggatgtgctgaaggagaaggctgacctgggagaagatgaggaggagaccaacgtgattgtgctgagctacccccagtactgccgctaccgctccatgctgaagaggatccaggacaagcccagcagcatcctgacagaccagtttgccctggccctgggcggcattgctgtggtgtccaggaacccccagatcctgtactgccgggacacctttgaccaccccaccctgattgaaaatgaaagcatctgtgatgaatttgcccccaacctgaagggccggcccaggaagaagaagccctgcccccagaggcgggacagcttcagcggcgtgaaggacagcaacaacaacagtgatggcaaggctgtggccaaggtgaagtgtgaggcccggagcgccctgaccaagcccaagaacaaccacaactgcaagaaggtgtccaatgaggagaagcccaaggtggccatcggggaggagtgcagagcagatgagcaggccttcctggtggccctgtacaagtacatgaaggagaggaagacccccatcgagcgcatcccctacctgggcttcaagcagatcaacctgtggaccatgttccaggccgcccagaagctgggcggctatgagaccatcacagcccggcggcagtggaagcacatctatgatgagctgggcggcaaccctggcagcaccagcgctgccacctgcaccaggaggcactatgaaagactcatcctgccctatgagcgcttcatcaagggggaggaggacaagcccctgccccccatcaagcccaggaagcaggagaacagcagccaggagaatgaaaacaagaccaaggtgtctggcaccaagaggatcaagcatgagatccccaagagcaagaaggagaaggaaaatgcccccaagccccaggatgctgctgaggtgtcctctgagcaggagaaggagcaggagaccctcatcagccagaagagcatccctgagcccctgcctgctgctgacatgaagaagaagattgagggctaccaggagttcagcgccaagcccctggccagccgggtggaccctgagaaggacaatgaaacagaccagggcagcaacagcgagaaggtggccgaggaggccggggagaagggccccaccccacccctgcccagcgcccccctggcccctgagaaggacagcgccctggtgcctggggccagcaagcagcccctgaccagccccagcgccctggtggacagcaagcaggagagcaagctgtgctgcttcacagagagccctgagagcgagccccaggaggccagcttccccagcttccccaccacccagccccccctggccaaccagaatgaaacagaagatgacaagctgcctgccatggctgactacatcgccaactgcaccgtgaaggtggaccagctgggcagtgatgacatccacaatgccctgaagcagacccccaaggtgctggtggtgcagagctttgacatgttcaaggacaaggacctgaccggccccatgaatgaaaaccacggcctgaactacacccccctgctgtacagccggggcaaccctggcatcatgagccccctggccaagaagaagctgctgagccaggtgtctggggccagcctgagcagcagctacccctacggcagccccccacccctcatcagcaagaagaagctgattgccagagatgacctgtgcagcagcctgagccagacccaccacggccagagcacagaccacatggctgtgtcccggcccagcgtcatccagcacgtgcagagcttccgcagcaagcccagcgaggagaggaagaccatcaatgacatcttcaagcatgagaagctgagcagaagtgacccccaccgctgcagcttcagcaagcaccacctgaaccccctggccgacagctatgtgctgaagcaggagatccaggagggcaaggacaagctgctggagaagagggccctgccccacagccacatgcccagcttcctggccgacttctacagcagcccccacctgcacagcctgtaccgccacacagagcaccacctgcacaatgagcagaccagcaagtaccccagccgggacatgtaccgggagagcgagaacagcagcttccccagccaccgccaccaggagaagctgcacgtgaactacctgaccagcctgcacctgcaggacaagaagtctgctgctgctgaggcccccacagatgaccagcccacagacctgagcctgcccaagaacccccacaagcccaccgggaaggtgctgggcctggcccacagcaccaccggcccccaggagagcaagggcatcagccagttccaggtgctgggcagccagagccgggactgccaccccaaggcctgccgggtgagccccatgaccatgagcggccccaagaagtacccagagagcctgagccgcagcggcaagccccaccacgtgcggctggagaacttcaggaagatggagggcatggtgcaccccatcctgcacaggaagatgagcccccagaacatcggggccgcccggcccatcaagaggagcctggaggacctggacctggtgattgctgggaagaaggcccgggctgtgagccccctggaccccagcaaggaggtgtctgggaaggagaaggccagcgagcaggagagcgagggcagcaaggccgcccacggcggccacagcggcggcggcagcgagggccacaagctgcccctgagcagccccatcttccctggcctgtacagcggcagcctgtgcaacagcggcctgaacagccggctgcctgctggctacagccacagcctgcagtacctgaagaaccagacagtgctgagccccctgatgcagcccctggccttccacagcctggtgatgcagaggggcatcttcaccagccccaccaacagccagcagctgtaccgccacctggccgccgccacccctgtgggcagcagctatggagacctgctgcacaacagcatctaccccctggccgccatcaacccccaggccgccttccccagcagccagctgagctctgtgcaccccagcaccaagctgtag

SEQ ID NO: 144230 - DNA, 2838 bp, Artificial Sequence
  Description of Artificial Sequence: Synthetic coding sequence
atggcccccaacctgaagggccggcccaggaagaagaagccctgcccccagaggcgggacagcttctctggagtgaaggacagcaacaacaacagtgatggcaaggctgtggccaaggtgaagtgtgaggcccggagcgccctgaccaagcccaagaacaaccacaactgcaagaaggtgtccaatgaggagaagcccaaggtggccatcggggaggagtgcagagcagatgagcaggccttcctggtggccctgtacaagtacatgaaggagaggaagacccccatcgagcgcatcccctacctgggcttcaagcagatcaacctgtggaccatgttccaggccgcccagaagctgggcggctatgagaccatcacagcccggcggcagtggaagcacatctatgatgagctgggcggcaaccctggcagcaccagcgctgccacctgcacccggcggcactatgagcggctcatcctgccctatgagcgcttcatcaagggggaggaggacaagcccctgccccccatcaagcccaggaagcaggagaacagcagccaggagaatgaaaacaagaccaaggtgtctggcaccaagaggatcaagcatgagatccccaagagcaagaaggagaaggaaaatgcccccaagccccaggatgctgctgaggtgagcagcgagcaggagaaggagcaggagaccctcatcagccagaagagcatccctgagcccctgcctgctgctgacatgaagaagaagattgagggctaccaggagttcagcgccaagcccctggccagccgggtggaccctgagaaggacaatgaaacagaccagggcagcaacagcgagaaggtggccgaggaggccggggagaagggccccaccccacccctgcccagcgcccccctggcccctgagaaggacagcgccctggtgcctggggccagcaagcagcccctgaccagccccagcgccctggtggacagcaagcaggagagcaagctgtgctgcttcacagagagccctgagagcgagccccaggaggccagcttccccagcttccccaccacccagccccccctggccaaccagaatgaaacagaagatgacaagctgcctgccatggctgactacatcgccaactgcaccgtgaaggtggaccagctgggcagtgatgacatccacaatgccctgaagcagacccccaaggtgctggtggtgcagagctttgacatgttcaaggacaaggacctgaccggccccatgaatgaaaatcatggcctgaactacacccccctgctgtacagccggggcaaccctggcatcatgagccccctggccaagaagaagctgctgagccaggtgtctggggccagcctgagcagcagctacccctacggcagccccccacccctcatcagcaagaagaagctgattgccagagatgacctgtgcagcagcctgagccagacccaccacggccagagcacagaccacatggctgtgtcccggcccagcgtcatccagcacgtgcagagcttccgcagcaagcccagcgaggagaggaagaccatcaatgacatcttcaagcatgagaagctgagcagaagtgacccccaccgctgcagcttcagcaagcaccacctgaaccccctggccgacagctatgtgctgaagcaggagatccaggagggcaaggacaagctgctggagaagagggccctgccccacagccacatgcccagcttcctggccgacttctacagcagcccccacctgcacagcctgtaccgccacacagagcaccacctgcacaatgagcagaccagcaagtaccccagccgggacatgtaccgggagagcgagaacagcagcttccccagccaccgccaccaggagaagctgcacgtgaactacctgaccagcctgcacctgcaggacaagaagtctgctgctgctgaggcccccacagatgaccagcccacagacctgagcctgcccaagaacccccacaagcccaccgggaaggtgctgggcctggcccacagcaccaccggcccccaggagagcaagggcatcagccagttccaggtgctgggcagccagagccgggactgccaccccaaggcctgccgggtgagccccatgaccatgagcggccccaagaagtacccagagagcctgagccgcagcggcaagccccaccacgtgcggctggagaacttcaggaagatggagggcatggtgcaccccatcctgcacaggaagatgagcccccagaacattggagctgcccggcccatcaagaggagcctggaggacctggacctggtgattgctgggaagaaggcccgggctgtgagccccctggaccccagcaaggaggtgtctgggaaggagaaggccagcgagcaggagagcgagggcagcaaggccgcccatggaggccacagcggcggcggcagcgagggccacaagctgcccctgagcagccccatcttccctggcctgtacagcggcagcctgtgcaacagcggcctgaacagccggctgcctgctggctacagccacagcctgcagtacctgaagaaccagacagtgctgagccccctgatgcagcccctggccttccacagcctggtgatgcagaggggcatcttcaccagccccaccaacagccagcagctgtaccgccacctggccgccgccacccctgtgggcagcagctatggagacctgctgcacaacagcatctaccccctggccgccatcaacccccaggccgccttccccagcagccagctgagctctgtgcaccccagcaccaagctgtag

SEQ ID NO: 144231 - DNA, 1134 bp, Artificial Sequence
  Description of Artificial Sequence: Synthetic coding sequence
atgggcaccacagaggccaccctgaggatggagaatgtggatgtgaaggaggagtggcaggatgaggacctgccccggcccctgcctgaggagaccggggtggagctgctgggcagccctgtggaggacaccagcagcccccccaacaccctgaacttcaacggggcccacaggaagaggaagaccctggtggcccctgagatcaacatcagcctggaccagagcgagggcagcctgctgagtgatgacttcctggacaccccagatgacctggacatcaacgtggatgacatcgagaccccagatgaaacagacagcctggagttcctgggcaatggaaatgagctggagtgggaggatgacacccctgtggccacagccaagaacatgcctggggacagcgctgacctgtttggagatggcaccacagaagatggcagcgctgccaacggccgcctgtggaggacagtcatcattggagagcaggagcacagaattgacctgcacatgatccggccctacatgaaggtggtgacccacggcggctactacggggagggcctgaatgccatcatcgtgtttgctgcctgcttcctgcctgacagcagcctgcctgactaccactacatcatggagaacctcttcctgtatgtgatcagcagcctggagctgctggtggccgaggactacatgattgtgtacctgaatggagccaccccaagaagaaggatgcctggcatcggctggctgaagaagtgctaccagatgattgaccggcggctgaggaagaacctgaagagcctcatcatcgtgcaccccagctggttcatcagaacagtgctggccatcagccggcccttcatctctgtgaagttcatcaacaagatccagtatgtgcacagcctggaggacctggagcagctgatccccatggagcacgtgcagatcccagactgtgtgctgcagtatgaggaggagcggctgaaggcccggcgggagagcgcccggccccagcctgagtttgtgctgcccaggtctgaggagaagccagaggtggcccctgtggagaacagaagtgccctggtgtctgaggaccaggagaccagcctgcagcccctgcacaggagcagctag

SEQ ID NO: 144232 - DNA, 1116 bp, Artificial Sequence
  Description of Artificial Sequence: Synthetic coding sequence
atgggcaccacagaggccaccctgaggatggagaatgtggatgtgaaggaggagtggcaggatgaggacctgccccggcccctgcctgaggagaccggggtggagctgctgggcagccctgtggaggacaccagcagcccccccaacaccctgaacttcaacggggcccacaggaagaggaagaccctggtggcccctgagatcaacatcagcctggaccagagcgagggcagcctgctgagtgatgacttcctggacaccccagatgacctggacatcaacgtggatgacatcgagaccccagatgaaacagacagcctggagttcctgggcaatggaaatgagctggagtgggaggatgacacccctgtggccacagccaagaacatgcctggggacagcgctgacctgtttggagatggcaccacagaagatggcagcgctgccaacggccgcctgtggaggacagtcatcattggagagcaggagcacagaattgacctgcacatgatccggccctacatgaaggtggtgacccacggcggctactacggggagggcctgaatgccatcatcgtgtttgctgcctgcttcctgcctgacagcagcctgcctgactaccactacatcatggagaacctcttcctgtatgtgatcagcagcctggagctgctggtggccgaggactacatgattgtgtacctgaatggagccaccccaagaagaaggatgcctggcatcggctggctgaagaagtgctaccagatgattgaccggcggctgaggaagaacctgaagagcctcatcatcgtgcaccccagctggttcatcagaacagtgctggccatcagccggcccttcatctctgtgaagttcatcaacaagatccagtatgtgcacagcctggaggacctggagcagctgatccccatggagcacgtgcagatcccagactgtgtgctgcagtatgaggaggagcggctgaaggcccggcgggagagcgcccggccccagcctgagtttgtgctgcccaggtctgaggagaagccagaggtggcccctgtggagaacagaagtgccctggtgtctgaggaccaggagaccaggatgtcctag

SEQ ID NO: 144233 - DNA, 1134 bp, Artificial Sequence
  Description of Artificial Sequence: Synthetic coding sequence
atggccggccgccgcagcagccagcccggcatcgccctgcacaaccctggcaaccaccaggtgcagaacccccagggccgcctggagaccgtgcggcccctgcctgaggagaccggggtggagctgctgggcagccctgtggaggacaccagcagcccccccaacaccctgaacttcaacggggcccacaggaagaggaagaccctggtggcccctgagatcaacatcagcctggaccagagcgagggcagcctgctgagtgatgacttcctggacaccccagatgacctggacatcaacgtggatgacatcgagaccccagatgaaacagacagcctggagttcctgggcaatggaaatgagctggagtgggaggatgacacccctgtggccacagccaagaacatgcctggggacagcgctgacctgtttggagatggcaccacagaagatggcagcgctgccaacggccgcctgtggaggacagtcatcattggagagcaggagcacagaattgacctgcacatgatccggccctacatgaaggtggtgacccacggcggctactacggggagggcctgaatgccatcatcgtgtttgctgcctgcttcctgcctgacagcagcctgcctgactaccactacatcatggagaacctcttcctgtatgtgatcagcagcctggagctgctggtggccgaggactacatgattgtgtacctgaatggagccaccccaagaagaaggatgcctggcatcggctggctgaagaagtgctaccagatgattgaccggcggctgaggaagaacctgaagagcctcatcatcgtgcaccccagctggttcatcagaacagtgctggccatcagccggcccttcatctctgtgaagttcatcaacaagatccagtatgtgcacagcctggaggacctggagcagctgatccccatggagcacgtgcagatcccagactgtgtgctgcagtatgaggaggagcggctgaaggcccggcgggagagcgcccggccccagcctgagtttgtgctgcccaggtctgaggagaagccagaggtggcccctgtggagaacagaagtgccctggtgtctgaggaccaggagacctccatgtcctag

SEQ ID NO: 144234 - DNA, 1116 bp, Artificial Sequence
  Description of Artificial Sequence: Synthetic coding sequence
atgggcaccacagaggccaccctgaggatggagaatgtggatgtgaaggaggagtggcaggatgaggacctgccccggcccctgcctgaggagaccggggtggagctgctgggcagccctgtggaggacaccagcagcccccccaacaccctgaacttcaacggggcccacaggaagaggaagaccctggtggcccctgagatcaacatcagcctggaccagagcgagggcagcctgctgagtgatgacttcctggacaccccagatgacctggacatcaacgtggatgacatcgagaccccagatgaaacagacagcctggagttcctgggcaatggaaatgagctggagtgggaggatgacacccctgtggccacagccaagaacatgcctggggacagcgctgacctgtttggagatggcaccacagaagatggcagcgctgccaacggccgcctgtggaggacagtcatcattggagagcaggagcacagaattgacctgcacatgatccggccctacatgaaggtggtgacccacggcggctactacggggagggcctgaatgccatcatcgtgtttgctgcctgcttcctgcctgacagcagcctgcctgactaccactacatcatggagaacctcttcctgtatgtgatcagcagcctggagctgctggtggccgaggactacatgattgtgtacctgaatggagccaccccaagaagaaggatgcctggcatcggctggctgaagaagtgctaccagatgattgaccggcggctgaggaagaacctgaagagcctcatcatcgtgcaccccagctggttcatcagaacagtgctggccatcagccggcccttcatctctgtgaagttcatcaacaagatccagtatgtgcacagcctggaggacctggagcagctgatccccatggagcacgtgcagatcccagactgtgtgctgcagtatgaggaggagcggctgaaggcccggcgggagagcgcccggccccagcctgagtttgtgctgcccaggtctgaggagaagccagaggtggcccctgtggagaacagaagtgccctggtgtctgaggaccaggagacctccatgtcctag

SEQ ID NO: 144235 - DNA, 1050 bp, Artificial Sequence
  Description of Artificial Sequence: Synthetic coding sequence
atgggcaccacagaggccaccctgaggatggagaatgtggatgtgaaggaggagtggcaggatgaggaccccccacccaacaccctgaacttcaacggggcccacaggaagaggaagaccctggtggcccctgagatcaacatcagcctggaccagagcgagggcagcctgctgagtgatgacttcctggacaccccagatgacctggacatcaacgtggatgacatcgagaccccagatgaaacagacagcctggagttcctgggcaatggaaatgagctggagtgggaggatgacacccctgtggccacagccaagaacatgcctggggacagcgctgacctgtttggagatggcaccacagaagatggcagcgctgccaacggccgcctgtggaggacagtcatcattggagagcaggagcacagaattgacctgcacatgatccggccctacatgaaggtggtgacccacggcggctactacggggagggcctgaatgccatcatcgtgtttgctgcctgcttcctgcctgacagcagcctgcctgactaccactacatcatggagaacctcttcctgtatgtgatcagcagcctggagctgctggtggccgaggactacatgattgtgtacctgaatggagccaccccaagaagaaggatgcctggcatcggctggctgaagaagtgctaccagatgattgaccggcggctgaggaagaacctgaagagcctcatcatcgtgcaccccagctggttcatcagaacagtgctggccatcagccggcccttcatctctgtgaagttcatcaacaagatccagtatgtgcacagcctggaggacctggagcagctgatccccatggagcacgtgcagatcccagactgtgtgctgcagtatgaggaggagcggctgaaggcccggcgggagagcgcccggccccagcctgagtttgtgctgcccaggtctgaggagaagccagaggtggcccctgtggagaacagaagtgccctggtgtctgaggaccaggagaccaggatgtcctag

SEQ ID NO: 144236 - DNA, 2448 bp, Artificial Sequence
  Description of Artificial Sequence: Synthetic coding sequence
atgaagagcaaccaggagaggagcaatgaatgtctgccccccaagaagcgggagatcccagccaccagccgcagcagcgaggagaaggcccccaccctgcccagcgacaaccaccgggtggagggcacagcctggctgcccggcaaccctgggggccggggccatggaggcggccgccacggccctgctggcacctctgtggagctgggcctgcagcagggcatcggcctgcacaaggccctgagcacaggcctggactacagccccccatctgcccccaggtctgtgcctgtggccaccaccctgcctgctgcctatgccaccccccagcccggcacccctgtgtcccctgtgcagtatgcccacctgccccacaccttccagttcatcggcagcagccagtacagcggcacctacgccagcttcatccccagccagctgatccccccaacagccaaccctgtgaccagcgctgtggccagcgctgctggggccaccacccccagccagaggagccagctggaggcctacagcaccctgctggccaacatgggcagcctgagccagaccccaggccacaaggccgagcagcagcagcagcagcagcagcagcagcagcagcagcaccagcaccagcagcagcagcagcagcagcagcagcagcagcagcagcagcacctgagccgggcccctggcctcatcaccccaggcagccccccaccagcccagcagaaccagtatgtgcacatcagcagcagcccccagaacacaggccgcacagccagccccccagccatccctgtgcacctgcacccccaccagaccatgatcccccacaccctgaccctgggcccccccagccaggtggtgatgcagtatgctgacagcggcagccactttgtgccccgggaggccaccaagaaggccgagagcagccggctgcagcaggccatccaggccaaggaggtgctgaatggagagatggagaagagccgccgctacggggcccccagcagcgctgacctgggcctgggcaaggccggcggcaagtctgtgccccacccctatgagagccgccacgtggtggtgcaccccagccccagcgactacagcagccgggaccccagcggcgtgcgggcctctgtgatggtgctgcccaacagcaacaccccagctgctgacctggaggtgcagcaggccacccaccgggaggccagccccagcaccctgaatgacaagagcggcctgcacctgggcaagccaggccacaggagctatgccctgagcccccacacagtcatccagaccacccacagcgccagcgagcccctgcctgtgggcctgcctgccacagccttctacgccggcacccagccccctgtgattggctacctgagcggccagcagcaggccatcacctacgccggcagcctgccccagcacctggtgattcctggcacccagcccctgctgatccctgtgggcagcacagacatggaggccagcggggccgccccagccatcgtgaccagcagcccccagtttgctgctgtgccccacacctttgtgaccacagccctgcccaagtctgagaacttcaaccctgaggccctggtgacccaggccgcctacccagccatggtgcaggcccagatccacctgcctgtggtgcagagcgtggccagccctgctgctgccccacccaccctgcccccctacttcatgaagggcagcatcatccagctggccaacggggagctgaagaaggtggaggacctgaagacagaggacttcatccagagcgctgagatcagcaatgacctgaagattgacagcagcacagtggagagaattgaggacagccacagccctggggtggccgtcatccagtttgctgtgggggagcaccgggcccaggtgtctgtggaggtgctggtggagtaccccttctttgtgtttggccagggctggagcagctgctgcccagagaggaccagccagctgtttgacctgccctgcagcaagctgtctgtgggagatgtgtgcatcagcctgaccctgaagaacctgaagaatggatctgtgaagaagggccagcctgtggaccctgcctctgtgctgctgaagcacagcaaggcagatggcctggccggcagccgccacagatatgcagagcaggagaatggcatcaaccagggcagcgcccagatgctgtctgaaaatggagagctgaagtttcctgagaagatgggcctgcctgctgcccccttcctgaccaagattgagcccagcaagccagctgccaccaggaagaggcgctggagcgcccctgagagcaggaagctggagaagtcagaagatgagccccccctgaccctgcccaagcccagcctcatcccccaggaggtgaagatctgcatcgagggccgcagcaatgtgggcaagtag

SEQ ID NO: 144237 - DNA, 2448 bp, Artificial Sequence; identical to SEQ ID NO: 144236
  Description of Artificial Sequence: Synthetic coding sequence

SEQ ID NO: 144238 - DNA, 2448 bp, Artificial Sequence; identical to SEQ ID NO: 144236
  Description of Artificial Sequence: Synthetic coding sequence

SEQ ID NO: 144239 - DNA, 1428 bp, Artificial Sequence
  Description of Artificial Sequence: Synthetic coding sequence
atggccgccccccggcccccaccagcccggctgagcggcgtgatggtgcctgcccccatccaggacctggaggccctgcgggccctgacagccctcttcaaggagcagaggaaccgggagacagcccccaggaccatcttccagagggtgctggacatcctgaagaagagcagccatgctgtggagctggcctgccgggaccccagccaggtggagaacctggccagcagcctgcagctgatcacagagtgcttccgctgcctgagaaatgcctgcatcgagtgcagcgtgaaccagaacagcatccggaacctggacaccatcggcgtggccgtggacctgatcctgctcttccgggagctgcgggtggagcaggagagcctgctgacagccttccgctgtggcctgcagttcctgggcaacatcgccagcagaaatgaagacagccagagcatcgtgtgggtgcacgccttccctgagctgttcctgagctgcctgaaccacccagacaagaagatcgtggcctacagctccatgatcctcttcaccagcctgaaccacgagaggatgaaggagctggaggagaacctgaacatcgccattgatgtgattgatgcctaccagaagcaccctgagagcgagtggcccttcctgatcatcacagacctcttcctgaagagccctgagctggtgcaggccatgttccccaagctgaacaaccaggagcgggtgaccctgctggacctgatgattgccaagatcaccagtgatgagcccctgaccaaggatgacatccctgtgttcctgcggcatgctgagctgattgccagcacctttgtggaccagtgcaagacagtgctgaagctggccagcgaggagcccccagatgatgaggaggccctggccaccatccggctgctggatgtgctgtgtgagatgacagtgaacacagagctgctgggctacctgcaggtgtttcctggcctgctggagagggtcatcgacctgctgcgggtcatccacgtggccggcaaggagaccaccaacatcttcagcaactgtggctgtgtgcgggcagagggggacatcagcaatgtggccaacggcttcaagagccacctgatccgcctcatcggcaacctgtgctacaagaacaaggacaaccaggacaaggtgaatgagctggatggcatccccctcatcctggacaactgcaacatcagtgacagcaaccccttcctgacccagtgggtgatctatgccatccggaacctgacagaggacaacagccagaaccaggacctgattgccaagatggaggagcagggcctggctgatgccagcctgctgaagaaggtgggctttgaggtggagaagaagggggagaagctgatcctgaagagcacccgggacacccccaagccctag

SEQ ID NO: 144240 - DNA, 1236 bp, Artificial Sequence
  Description of Artificial Sequence: Synthetic coding sequence
atggccgccccccggcccccaccagcccggctgagcggcgtgatggtgcctgcccccatccaggacctggaggccctgcgggccctgacagccctcttcaaggagcagaggaacagaaacctggacaccatcggcgtggccgtggacctgatcctgctcttccgggagctgcgggtggagcaggagagcctgctgacagccttccgctgtggcctgcagttcctgggcaacatcgccagcagaaatgaagacagccagagcatcgtgtgggtgcacgccttccctgagctgttcctgagctgcctgaaccacccagacaagaagatcgtggcctacagctccatgatcctcttcaccagcctgaaccacgagaggatgaaggagctggaggagaacctgaacatcgccattgatgtgattgatgcctaccagaagcaccctgagagcgagtggcccttcctgatcatcacagacctcttcctgaagagccctgagctggtgcaggccatgttccccaagctgaacaaccaggagcgggtgaccctgctggacctgatgattgccaagatcaccagtgatgagcccctgaccaaggatgacatccctgtgttcctgcggcatgctgagctgattgccagcacctttgtggaccagtgcaagacagtgctgaagctggccagcgaggagcccccagatgatgaggaggccctggccaccatccggctgctggatgtgctgtgtgagatgacagtgaacacagagctgctgggctacctgcaggtgtttcctggcctgctggagagggtcatcgacctgctgcgggtcatccacgtggccggcaaggagaccaccaacatcttcagcaactgtggctgtgtgcgggcagagggggacatcagcaatgtggccaacggcttcaagagccacctgatccgcctcatcggcaacctgtgctacaagaacaaggacaaccaggacaaggtgaatgagctggatggcatccccctcatcctggacaactgcaacatcagtgacagcaaccccttcctgacccagtgggtgatctatgccatccggaacctgacagaggacaacagccagaaccaggacctgattgccaagatggaggagcagggcctggctgatgccagcctgctgaagaaggtgggctttgaggtggagaagaagggggagaagctgatcctgaagagcacccgggacacccccaagccctag

SEQ ID NO: 144241 - DNA, 1362 bp, Artificial Sequence
  Description of Artificial Sequence: Synthetic coding sequence
atggccgccccccggcccccaccagcccggctgagcggcgtgatggtgcctgcccccatccaggacctggaggccctgcgggccctgacagccctcttcaaggagcagaggaaccgggagacagcccccaggaccatcttccagagggtgctggacatcctgaagaagagcagccatgctgtggagctggcctgccgggaccccagccaggtggagaacctggccagcagcctgcagctgatcacagagtgcttccgctgcctgagaaatgcctgcatcgagtgcagcgtgaaccagaacagcatccggaacctggacaccatcggcgtggccgtggacctgatcctgctcttccgggagctgcgggtggagcaggagagcctgctgacagccttccgctgtggcctgcagttcctgggcaacatcgccagcagaaatgaagacagccagagcatcgtgtgggtgcacgccttccctgagctgttcctgagctgcctgaaccacccagacaagaagatcgtggcctacagctccatgatcctcttcaccagcctgaaccacgagaggatgaaggagctggaggagaacctgaacatcgccattgatgtgattgatgcctaccagaagcaccctgagagcgagtggcccttcctgatcatcacagacctcttcctgaagagccctgagctggtgcaggccatgttccccaagctgaacaaccaggagcgggtgaccctgctggacctgatgattgccaagatcaccagtgatgagcccctgaccaaggatgacatccctgtgttcctgcggcatgctgagctgattgccagcacctttgtggaccagtgcaagacagtgctgaagctggccagcgaggagccccctgtgatgtacccctacatgagaattgtgggcaagttccggctgctggatgtgctgtgtgagatgacagtgaacacagagctgctgggctacctgcaggtgtttcctggcctgctggagcgggtgattgacctgctgcgggtcatccacgtggccggcaaggagaccaccaacatcttcagcaactgtggctgtgtgcgggcagagggggacatcagcaatgtggccaacggcttcaagagccacctgatccggctgattggcaacctgtgctacaagaacaaggacaaccaggacaaggtgaatgagctggatggcatccccctcatcctggacaactgcaacatcagtgacagcaacccctgcagcgaccctgtgggggacatctgccaccccaagccctaccgccggcagcagcccaagcccaggtttgactgcaaggatggcggcactggagctggccgctgcatccccacctag

SEQ ID NO: 144242 - DNA, 2070 bp, Artificial Sequence
  Description of Artificial Sequence: Synthetic coding sequence
atgaagcctgtgcatgagaggagccaggagtgcctgccccccaagaagagggacctgcctgtgaccagcgaggacatgggccgcaccaccagctgcagcaccaaccacacccccagcagtgatgccagcgagtggagccggggcgtggtggtggccggccagagccaggccggggcccgggtgtccctgggcggagatggagctgaggccatcaccggcctgactgtggaccagtatggcatgctgtacaaggtggccgtgcccccagccaccttcagccccaccggcctgcccagcgtggtgaacatgagccccctgccccccaccttcaacgtggccagcagcctcatccagcaccctggcatccactacccacccctgcactacgcccagctgcccagcaccagcctgcagttcatcggcagcccctacagcctgccctatgctgtgccccccaacttcctgcccagccccctgctgagccccagcgccaacctggccaccagccacctgccccactttgtgccctatgccagcctgctggccgagggcgccaccccaccaccccaggcccccagccctgcccacagcttcaacaaggcccccagcgccaccagccccagcggccagctgccccaccacagcagcacccagcccctggacctggcccctggccgcatgcccatctactaccagatgagccggctgcctgctggctacaccctgcacgagaccccacctgctggggccagccctgtgctgaccccccaggagagccagagcgccctggaggccgctgctgccaatggaggccagaggccccgggagaggaacctggtgagaagagagagcgaggccctggacagccccaacagcaaaggagagggccagggcctggtgcctgtggtggagtgtgtggtggatggccagctgttcagcggcagccagaccccccgggtggaggtggccgccccagcccaccggggcaccccagacacagacctggaggtgcagagggtggtgggcgccctggccagccaggactacagagtggtggccgcccagaggaaggaggagcccagccccctgaacctgagccaccacaccccagaccaccagggcgagggccggggcagcgccagaaatcctgctgagctggccgagaagagccaggcccggggcttctacccccagagccaccaggagcctgtgaagcaccggcccctgcccaaggccatggtggtggccaatggaaacctggtgcccactggaacagattctggcctgctgcctgtgggcagcgagatcctggtggccagcagcctggatgtgcaggcccgggccaccttcccagacaaggagcccaccccaccacccatcaccagcagccacctgcccagccacttcatgaagggggccatcatccagctggccactggagagctgaagagggtggaggacctgcagacccaggactttgtgcgctctgctgaggtgtctgggggcctgaagattgacagcagcacagtggtggacatccaggagagccagtggccaggctttgtgatgctgcactttgtggtgggggagcagcagagcaaggtgtccattgaggtgcccccagagcaccccttctttgtgtatggccagggctggagcagctgcagccctggccgcaccacccagctgttcagcctgccctgccaccggctgcaggtgggagatgtgtgcatcagcatcagcctgcagagcctgaacagcaacagcgtgtcccaggccagctgtgccccacccagccagctgggccccccccgggagaggcctgagaggacagtgctgggcagccgggagctgtgtgacagcgagggcaagagccagcctgctggggagggcagccgggtggtggagcccagccagcctgagagcggggcccaggcctgctggccagcccccagcttccagcgctacagcatgcagggcgaggaggcccgggccgccctgctgcggcccagcttcatcccccaggaggtgaagctgagcattgagggccgcagcaatgccggcaagtag

SEQ ID NO: 144243 - DNA, 3942 bp, Artificial Sequence
  Description of Artificial Sequence: Synthetic coding sequence
atgaggtctgctgctgctgcccccaggagccctgctgtggccacagagagccgccgctttgctgctgcccgctggccaggctggaggagcctgcagaggcctgcccggcgcagcggccggggcggcggcggggccgcccctggcccctaccccagcgctgcccctcctcctcctggccctggccccccacccagccggcagagcagcccccccagcgccagtgactgcttcggcagcaatggaaatggaggaggagccttccggcccggcagccggcggctgctgggcctgggcggccccccccggccctttgtggtgctgctgctgcccctggccagccctggggcccctcctgctgcccccacccgggccagccccctgggcgcccgggccagccccccaagaagtggagtgtccctggcccggcctgcccctggctgccccaggcctgcctgtgagcctgtgtatggccccctgaccatgagcctgaagccccagcagcagcagcagcagcagcagcagcagcagcagcagcagcagcagcagcagcagcagcagcagcagcccccacctgctgctgccaacgtgaggaagccaggcggcagcggcctgctggccagccctgctgctgcccccagccccagcagcagctctgtgagcagcagcagcgccacagcccccagctctgtggtggccgccaccagcggcggcggccggcccggcctgggccggggcaggaacagcaacaagggcctgccccagagcaccatcagctttgatggcatctatgccaacatgaggatggtgcacatcctgacctctgtggtgggcagcaaatgtgaggtgcaggtgaagaatggaggcatctatgagggcgtcttcaagacctacagccccaagtgtgacctggtgctggatgctgcccacgagaagagcacagagagcagcagcggccccaagcgggaggagatcatggagagcatcctcttcaagtgcagcgactttgtggtggtgcagttcaaggacatggacagcagctatgccaagagagatgccttcacagacagcgccatcagcgccaaggtgaatggagagcacaaggagaaggacctggagccctgggatgctggggagctgacagccaatgaggagctggaggccctggagaatgatgtgtccaatggctgggaccccaatgacatgttccgctacaatgaagaaaattatggagtggtgtccacctatgacagcagcctgagcagctacacagtgcccctggagcgggacaacagcgaggagttcctgaagcgggaggcccgggccaaccagctggccgaggagattgagagcagcgcccagtacaaggcccgggtggccctggagaatgatgacagaagtgaggaggagaagtacacagctgtgcagaggaacagcagcgagcgggagggccacagcatcaacacccgggagaacaagtacatccccccaggccagaggaaccgggaggtgatctcctggggcagcggccggcagaacagccccaggatgggccagcccggcagcggctccatgcccagccgcagcaccagccacaccagtgacttcaaccccaacagcggcagtgaccagagggtggtgaatggaggagtgccctggcccagcccctgccccagccccagcagcaggcctcccagccgctaccagagcggccccaacagcctgcccccccgggccgccacccccacccggccccccagccggccccccagccggcccagcaggcctcccagccaccccagcgcccacggcagccctgcccctgtgtccaccatgcccaagaggatgagcagcgagggcccccccaggatgagccccaaggcccagaggcaccccaggaaccaccgggtgtctgctggccggggcagcatcagcagcggcctggagtttgtgagccacaacccccccagcgaggccgccaccccacctgtggcccggaccagccccagcggcggcacctggagctctgtggtgtctggagtgccccggctgagccccaagacccaccggcccaggagcccccggcagaacagcatcggcaacaccccatctggccctgtgctggccagcccccaggccggcatcatccccacagaagctgtggccatgcccatcccagctgccagccccaccccagccagccctgccagcaacagagctgtgacccccagcagcgaggccaaggacagccggctgcaggaccagaggcagaacagccctgctggcaacaaggagaacatcaagcccaatgagaccagccccagcttcagcaaggcagaaaataaaggcatcagccctgtggtgtctgagcacaggaagcagattgatgacctgaagaagttcaagaatgacttccggctgcagcccagcagcaccagcgagagcatggaccagctgctgaacaagaaccgggagggggagaagagccgggacctgatcaaggacaagattgagcccagcgccaaggacagcttcatcgagaacagcagcagcaactgcaccagcggcagcagcaagcccaacagccccagcatcagccccagcatcctgagcaacacagagcacaagaggggccctgaggtgaccagccagggcgtgcagaccagcagccctgcctgcaagcaggagaaggatgacaaggaggagaagaaggatgctgctgagcaggtgaggaagagcaccctgaaccccaatgccaaggagttcaaccccaggagcttcagccagcccaagcccagcaccacccccaccagcccccggccccaggcccagcccagccccagcatggtgggccaccagcagcccacccctgtgtacacccagcctgtgtgctttgcccccaacatgatgtaccctgtgcctgtgtcccctggggtgcagcccctgtaccccatccccatgacccccatgcctgtgaaccaggccaagacctacagagctgtgcccaacatgccccagcagaggcaggaccagcaccaccagagcgccatgatgcacccagccagcgctgctggcccccccatcgccgccaccccaccagcctacagcacccagtatgtggcctacagcccccagcagttccccaaccagcccctggtgcagcacgtgccccactaccagagccagcacccccacgtgtacagccctgtgatccagggcaatgccaggatgatggccccacccacccacgcccagcccggcctggtgagcagcagcgccacccagtatggagcccacgagcagacccacgccatgtatgcctgccccaagctgccctacaacaaggagaccagccccagcttctactttgccatcagcacaggcagcctggcccagcagtatgcccaccccaatgccaccctgcacccccacaccccccacccccagcccagcgccacccccaccggccagcagcagagccagcacggcggcagccacccagcccccagccctgtgcagcaccaccagcaccaggccgcccaggccctgcacctggccagcccccagcagcagagcgccatctaccacgccggcctggcccccaccccacccagcatgaccccagccagcaacacccagagcccccagaacagcttccctgctgcccagcagaccgtcttcaccatccaccccagccacgtgcagcctgcctacaccaaccccccccacatggcccacgtgccccaggcccacgtgcagagcggcatggtgcccagccaccccacagcccacgcccccatgatgctgatgaccacccagcccccaggcggcccccaggccgccctggcccagagcgccctgcagcccatccctgtgtccaccacagcccacttcccctacatgacccaccccagcgtgcaggcccaccaccagcagcagctgtag

SEQ ID NO: 144244 - DNA, 2988 bp, Artificial Sequence
  Description of Artificial Sequence: Synthetic coding sequence
atgaggtctgctgctgctgcccccaggagccctgctgtggccacagagagccgccgctttgctgctgcccgctggccaggctggaggagcctgcagaggcctgcccggcgcagcggccggggcggcggcggggccgcccctggcccctaccccagcgctgcccctcctcctcctggccctggccccccacccagccggcagagcagcccccccagcgccagtgactgcttcggcagcaatggaaatggaggaggagccttccggcccggcagccggcggctgctgggcctgggcggccccccccggccctttgtggtgctgctgctgcccctggccagccctggggcccctcctgctgcccccacccgggccagccccctgggcgcccgggccagccccccaagaagtggagtgtccctggcccggcctgcccctggctgccccaggcctgcctgtgagcctgtgtatggccccctgaccatgagcctgaagccccagcagcagcagcagcagcagcagcagcagcagcagcagcagcagcagcagcagcagcagcagcagcagcccccacctgctgctgccaacgtgaggaagccaggcggcagcggcctgctggccagccctgctgctgcccccagccccagcagcagctctgtgagcagcagcagcgccacagcccccagctctgtggtggccgccaccagcggcggcggccggcccggcctgggccggggcaggaacagcaacaagggcctgccccagagcaccatcagctttgatggcatctatgccaacatgaggatggtgcacatcctgacctctgtggtgggcagcaaatgtgaggtgcaggtgaagaatggaggcatctatgagggcgtcttcaagacctacagccccaagtgtgacctggtgctggatgctgcccacgagaagagcacagagagcagcagcggccccaagcgggaggagatcatggagagcatcctcttcaagtgcagcgactttgtggtggtgcagttcaaggacatggacagcagctatgccaagagagatgccttcacagacagcgccatcagcgccaaggtgaatggagagcacaaggagaaggacctggagccctgggatgctggggagctgacagccaatgaggagctggaggccctggagaatgatgtgtccaatggctgggaccccaatgacatgttccgctacaatgaagaaaattatggagtggtgtccacctatgacagcagcctgagcagctacacagtgcccctggagcgggacaacagcgaggagttcctgaagcgggaggcccgggccaaccagctggccgaggagattgagagcagcgcccagtacaaggcccgggtggccctggagaatgatgacagaagtgaggaggagaagtacacagctgtgcagaggaacagcagcgagcgggagggccacagcatcaacacccgggagaacaagtacatccccccaggccagaggaaccgggaggtgatctcctggggcagcggccggcagaacagccccaggatgggccagcccggcagcggctccatgcccagccgcagcaccagccacaccagtgacttcaaccccaacagcggcagtgaccagagggtggtgaatggaggagtgccctggcccagcccctgccccagccccagcagcaggcctcccagccgctaccagagcggccccaacagcctgcccccccgggccgccacccccacccggccccccagccggccccccagccggcccagcaggcctcccagccaccccagcgcccacggcagccctgcccctgtgtccaccatgcccaagaggatgagcagcgagggcccccccaggatgagccccaaggcccagaggcaccccaggaaccaccgggtgtctgctggccggggcagcatcagcagcggcctggagtttgtgagccacaacccccccagcgaggccgccaccccacctgtggcccggaccagccccagcggcggcacctggagctctgtggtgtctggagtgccccggctgagccccaagacccaccggcccaggagcccccggcagaacagcatcggcaacaccccatctggccctgtgctggccagcccccaggccggcatcatccccacagaagctgtggccatgcccatcccagctgccagccccaccccagccagccctgccagcaacagagctgtgacccccagcagcgaggccaaggacagccggctgcaggaccagaggcagaacagccctgctggcaacaaggagaacatcaagcccaatgagaccagccccagcttcagcaaggcagaaaataaaggcatcagccctgtggtgtctgagcacaggaagcagattgatgacctgaagaagttcaagaatgacttccggctgcagcccagcagcaccagcgagagcatggaccagctgctgaacaagaaccgggagggggagaagagccgggacctgatcaaggacaagattgagcccagcgccaaggacagcttcatcgagaacagcagcagcaactgcaccagcggcagcagcaagcccaacagccccagcatcagccccagcatcctgagcaacacagagcacaagaggggccctgaggtgaccagccagggcgtgcagaccagcagccctgcctgcaagcaggagaaggatgacaaggaggagaagaaggatgctgctgagcaggtgaggaagagcaccctgaaccccaatgccaaggagttcaaccccaggagcttcagccagcccaagcccagcaccacccccaccagcccccggccccaggcccagcccagccccagcatggtgggccaccagcagcccacccctgtgtacacccagcctgtgtgctttgcccccaacatgatgtaccctgtgcctgtgtcccctggggtgcagtaccagatctgccccaacagcggcaagaccagcatcatccgggtgccctag

SEQ ID NO: 144245 - DNA, 3189 bp, Artificial Sequence
  Description of Artificial Sequence: Synthetic coding sequence
atgctgaagccccagcccctgcagcagcccagccagccccagcagcccccacccacccagcaggccgtggcccggcggcccccaggcggcaccagccccccaaatggaggcctgcccggccccctggccaccagcgctgcccctcctggccccccagctgctgccagcccctgcctgggccctgtggccgctgctggcagcggcctgcggagaggagctgagggcatcctggccccccagcccccaccaccccagcagcaccaggagaggcctggagctgctgccatcggcagcgcccggggccagagcacaggcaagggccccccccagagccctgtgtttgagggcgtgtacaacaacagcaggatgctgcacttcctgacagctgtggtgggcagcacctgtgatgtgaaggtgaagaatggcaccacctatgagggcatcttcaagaccctgagcagcaagtttgagctggccgtggatgctgtgcacaggaaggccagcgagcctgctgggggccccaggagagaagatattgtggacaccatggtgttcaagcccagtgatgtgatgctggtgcacttcagaaatgtggacttcaactatgccaccaaggacaagttcacagattctgccatcgccatgaacagcaaggtgaatggagagcacaaggagaaggtgctgcagcgctgggagggcggggacagcaacagtgatgattatgacctggagagtgacatgagcaatggctgggaccccaatgagatgttcaagttcaatgaggagaactacggcgtgaagaccacctatgacagcagcctgagcagctacacagtgcccctggagaaggacaacagcgaggagttccggcagcgggagctgcgggccgcccagctggcccgggagattgagagcagcccccagtaccgcctgagaattgccatggagaatgatgatggccgcacagaggaggagaagcacagcgctgtgcagaggcagggcagcggccgggagagccccagcctggccagccgggagggcaagtacatccccctgccccagagggtgcgggagggcccccggggcggcgtgcgctgcagcagcagcagaggaggccggcccggcctgagcagcctgcccccccggggcccccaccacctggacaacagcagccctggccctggcagcgaggcccggggcatcaatggaggccccagcaggatgagccccaaggcccagaggcccctgcggggggccaagaccctgagcagccccagcaaccggcccagcggggagacctctgtgcccccacctcctgctgtgggccgcatgtacccacccaggagccccaagtctgctgccccagcccccatcagcgccagctgcccagagccccccatcggcagcgctgtgcccaccagcagcgccagcatccctgtgaccagctctgtgtctgaccccggggtgggcagcatcagccctgccagccccaagatcagcctggcccccacagatgtgaaggagctgagcaccaaggagcccggccgcaccctggagccccaggagctggccagaattgctgggaaggtgcccggcctgcagaatgagcagaagcgcttccagctggaggagctgaggaagtttggagcccagttcaagctgcagcccagcagcagccctgagaacagcctggaccccttccccccacgcatcctgaaggaggagcccaagggcaaggagaaggaggtggatggcctgctgaccagcgagcccatgggcagccctgtgagcagcaagacagagagcgtgtctgacaaggaggacaagccacccctggcccccagcggcggcacagagggccctgagcagcccccaccaccctgccccagccagacaggcagcccccctgtgggcctcatcaagggggaggacaaggatgagggccctgtggccgagcaggtgaagaagagcaccctgaaccccaatgccaaggagttcaaccccaccaagcccctgctgtctgtgaacaagagcaccagcacccccaccagccctggccccaggacccacagcacccccagcatccctgtgctgacagctggccagagcggcctgtacagcccccagtacatctcctacatcccccagatccacatgggccctgctgtgcaggccccccagatgtacccctaccctgtgagcaacagcgtgcccggccagcagggcaagtacagaggagccaagggcagcctgcccccccagaggagtgaccagcaccagcctgccagcgccccacccatgatgcaggccgctgctgctgctggcccccccctggtggccgccaccccctacagcagctacatcccctacaacccccagcagtttcctggccagcctgccatgatgcagcccatggcccactaccccagccagcctgtgtttgcccccatgctgcagagcaaccccaggatgctgaccagcggcagccacccccaggccatcgtgagcagcagcaccccccagtaccccagcgctgagcagcccaccccccaggccctgtatgccaccgtgcaccagagctacccccaccacgccacccagctgcacgcccaccagccccagcctgccaccacccccaccggcagccagccccagagccagcacgccgcccccagccctgtgcagcaccaggccggccaggccccccacctgggcagcggccagccccagcagaacctgtaccaccctggggccctgaccggcaccccacccagcctgcccccaggccccagcgcccagagcccccagagcagcttcccccagcctgctgctgtgtatgccatccaccaccagcagctgccccacggcttcaccaacatggcccacgtgacccaggcccacgtgcagacaggcatcacagctgcccccccaccccaccctggggccccccaccccccccaggtgatgctgctgcaccccccccagagccatggaggccccccccagggcgctgtgccccagagcggcgtgcctgccctgagcgccagcacccccagcccctacccctacatcggccacccccagggcgagcagcccggccaggcccctggcttccctggaggagcagatgaccgcatcccccccctgcccccacctggagagctgaagatcgtgctggccgccacctag

SEQ ID NO: 144246 - DNA, 3228 bp, Artificial Sequence
  Description of Artificial Sequence: Synthetic coding sequence
atgctgaagccccagcccctgcagcagcccagccagccccagcagcccccacccacccagcaggccgtggcccggcggcccccaggcggcaccagccccccaaatggaggcctgcccggccccctggccaccagcgctgcccctcctggccccccagctgctgccagcccctgcctgggccctgtggccgctgctggcagcggcctgcggagaggagctgagggcatcctggccccccagcccccaccaccccagcagcaccaggagaggcctggagctgctgccatcggcagcgcccggggccagagcacaggcaagggccccccccagagccctgtgtttgagggcgtgtacaacaacagcaggatgctgcacttcctgacagctgtggtgggcagcacctgtgatgtgaaggtgaagaatggcaccacctatgagggcatcttcaagaccctgagcagcaagtttgagctggccgtggatgctgtgcacaggaaggccagcgagcctgctgggggccccaggagagaagatattgtggacaccatggtgttcaagcccagtgatgtgatgctggtgcacttcagaaatgtggacttcaactatgccaccaaggacaagttcacagattctgccatcgccatgaacagcaaggtgaatggagagcacaaggagaaggtgctgcagcgctgggagggcggggacagcaacagtgatgattatgacctggagagtgacatgagcaatggctgggaccccaatgagatgttcaagttcaatgaggagaactacggcgtgaagaccacctatgacagcagcctgagcagctacacagtgcccctggagaaggacaacagcgaggagttccggcagcgggagctgcgggccgcccagctggcccgggagattgagagcagcccccagtaccgcctgagaattgccatggagaatgatgatggccgcacagaggaggagaagcacagcgctgtgcagaggcagggcagcggccgggagagccccagcctggccagccgggagggcaagtacatccccctgccccagagggtgcgggagggcccccggggcggcgtgcgctgcagcagcagcagaggaggccggcccggcctgagcagcctgcccccccggggcccccaccacctggacaacagcagccctggccctggcagcgaggcccggggcatcaatggaggccccagcaggatgagccccaaggcccagaggcccctgcggggggccaagaccctgagcagccccagcaaccggcccagcggggagacctctgtgcccccacctcctgctgtgggccgcatgtacccacccaggagccccaagtctgctgccccagcccccatcagcgccagctgcccagagccccccatcggcagcgctgtgcccaccagcagcgccagcatccctgtgaccagctctgtgtctgaccccggggtgggcagcatcagccctgccagccccaagatcagcctggcccccacagatgtgaaggagctgagcaccaaggagcccggccgcaccctggagccccaggagctggccagaattgctgggaaggtgcccggcctgcagaatgagcagaagcgcttccagctggaggagctgaggaagtttggagcccagttcaagctgcagcccagcagcagccctgagaacagcctggaccccttccccccacgcatcctgaaggaggagcccaagggcaaggagaaggaggtggatggcctgctgaccagcgagcccatgggcagccctgtgagcagcaagacagagagcgtgtctgacaaggaggacaagccacccctggcccccagcggcggcacagagggccctgagcagcccccaccaccctgccccagccagacaggcagcccccctgtgggcctcatcaagggggaggacaaggatgagggccctgtggccgagcaggtgaagaagagcaccctgaaccccaatgccaaggagttcaaccccaccaagcccctgctgtctgtgaacaagagcaccagcacccccaccagccctggccccaggacccacagcacccccagcatccctgtgctgacagctggccagagcggcctgtacagcccccagtacatctcctacatcccccagatccacatgggccctgctgtgcaggccccccagatgtacccctaccctgtgagcaacagcgtgcccggccagcagggcaagtacagaggagccaagggcagcctgcccccccagaggagtgaccagcaccagcctgccagcgccccacccatgatgcaggccgctgctgctgctggcccccccctggtggccgccaccccctacagcagctacatcccctacaacccccagcagtttcctggccagcctgccatgatgcagcccatggcccactaccccagccagcctgtgtttgcccccatgctgcagagcaaccccaggatgctgaccagcggcagccacccccaggccatcgtgagcagcagcaccccccagtaccccagcgctgagcagcccaccccccaggccctgtatgccaccgtgcaccagagctacccccaccacgccacccagctgcacgcccaccagccccagcctgccaccacccccaccggcagccagccccagagccagcacgccgcccccagccctgtgcagcaccaggccggccaggccccccacctgggcagcggccagccccagcagaacctgtaccaccctggggccctgaccggcaccccacccagcctgcccccaggccccagcgcccagagcccccagagcagcttcccccagcctgctgctgtgtatgccatccaccaccagcagctgccccacggcttcaccaacatggcccacgtgacccaggcccacgtgcagacaggcatcacagctgcccccccaccccaccctggggccccccaccccccccaggtgatgctgctgcaccccccccagagccatggaggccccccccagggcgctgtgccccagagcggcgtgcctgccctgagcgccagcacccccagcccctacccctacatcggccacccccagggcgagcagcccggccaggcccctggcttccctggaggagcagatgaccgcatccgggagttcagcctggccggcggcatctggcacggccgggcagagggcctgcaggtgggccaggatgcccgggtgctgggcggggagtag

SEQ ID NO: 144247 - DNA, 3135 bp, Artificial Sequence
  Description of Artificial Sequence: Synthetic coding sequence
atgctgaagccccagcccctgcagcagcccagccagccccagcagcccccacccacccagcaggccgtggcccggcggcccccaggcggcaccagccccccaaatggaggcctgcccggccccctggccaccagcgctgcccctcctggccccccagctgctgccagcccctgcctgggccctgtggccgctgctggcagcggcctgcggagaggagctgagggcatcctggccccccagcccccaccaccccagcagcaccaggagaggcctggagctgctgccatcggcagcgcccggggccagagcacaggcaagggccccccccagagccctgtgtttgagggcgtgtacaacaacagcaggatgctgcacttcctgacagctgtggtgggcagcacctgtgatgtgaaggtgaagaatggcaccacctatgagggcatcttcaagaccctgagcagcaagtttgagctggccgtggatgctgtgcacaggaaggccagcgagcctgctgggggccccaggagagaagatattgtggacaccatggtgttcaagcccagtgatgtgatgctggtgcacttcagaaatgtggacttcaactatgccaccaaggacaagttcacagattctgccatcgccatgaacagcaaggtgaatggagagcacaaggagaaggtgctgcagcgctgggagggcggggacagcaacagtgatgattatgacctggagagtgacatgagcaatggctgggaccccaatgagatgttcaagttcaatgaggagaactacggcgtgaagaccacctatgacagcagcctgagcagctacacagtgcccctggagaaggacaacagcgaggagttccggcagcgggagctgcgggccgcccagctggcccgggagattgagagcagcccccagtaccgcctgagaattgccatggagaatgatgatggccgcacagaggaggagaagcacagcgctgtgcagaggcagggcagcggccgggagagccccagcctggccagccgggagggcaagtacatccccctgccccagagggtgcgggagggcccccggggcggcgtgcgctgcagcagcagcagaggaggccggcccggcctgagcagcctgcccccccggggcccccaccacctggacaacagcagccctggccctggcagcgaggcccggggcatcaatggaggccccagcaggatgagccccaaggcccagaggcccctgcggggggccaagaccctgagcagccccagcaaccggcccagcggggagacctctgtgcccccacctcctgctgtgggccgcatgtacccacccaggagccccaagtctgctgccccagcccccatcagcgccagctgcccagagccccccatcggcagcgctgtgcccaccagcagcgccagcatccctgtgaccagctctgtgtctgaccccggggtgggcagcatcagccctgccagccccaagatcagcctggcccccacagatgtgaaggagctgagcaccaaggagcccggccgcaccctggagccccaggagctggccagaattgctgggaaggtgcccggcctgcagaatgagcagaagcgcttccagctggaggagctgaggaagtttggagcccagttcaagctgcagcccagcagcagccctgagaacagcctggaccccttccccccacgcatcctgaaggaggagcccaagggcaaggagaaggaggtggatggcctgctgaccagcgagcccatgggcagccctgtgagcagcaagacagagagcgtgtctgacaaggaggacaagccacccctggcccccagcggcggcacagagggccctgagcagcccccaccaccctgccccagccagacaggcagcccccctgtgggcctcatcaagggggaggacaaggatgagggccctgtggccgagcaggtgaagaagagcaccctgaaccccaatgccaaggagttcaaccccaccaagcccctgctgtctgtgaacaagagcaccagcacccccaccagccctggccccaggacccacagcacccccagcatccctgtgctgacagctggccagagcggcctgtacagcccccagtacatctcctacatcccccagatccacatgggccctgctgtgcaggccccccagatgtacccctaccctgtgagcaacagcgtgcccggccagcagggcaagtacagaggagccaagggcagcctgcccccccagaggagtgaccagcaccagcctgccagcgccccacccatgatgcaggccgctgctgctgctggcccccccctggtggccgccaccccctacagcagctacatcccctacaacccccagcagtttcctggccagcctgccatgatgcagcccatggcccactaccccagccagcctgtgtttgcccccatgctgcagagcaaccccaggatgctgaccagcggcagccacccccaggccatcgtgagcagcagcaccccccagtaccccagcgctgagcagcccaccccccaggccctgtatgccaccgtgcaccagagctacccccaccacgccacccagctgcacgcccaccagccccagcctgccaccacccccaccggcagccagccccagagccagcacgccgcccccagccctgtgcagcaccaggccggccaggccccccacctgggcagcggccagccccagcagaacctgtaccaccctggggccctgaccggcaccccacccagcctgcccccaggccccagcgcccagagcccccagagcagcttcccccagcctgctgctgtgtatgccatccaccaccagcagctgccccacggcttcaccaacatggcccacgtgacccaggcccacgtgcagacaggcatcacagctgcccccccaccccaccctggggccccccaccccccccaggtgatgctgctgcaccccccccagagccatggaggccccccccagggcgctgtgccccagagcggcgtgcctgccctgagcgccagcacccccagcccctacccctacatcggccacccccaggtgcagagccaccccagccagcagctgcccttccaccccccaggcaactag

SEQ ID NO: 144248 - DNA, 1203 bp, Artificial Sequence
  Description of Artificial Sequence: Synthetic coding sequence
atgctgaagccccagcccctgcagcagcccagccagccccagcagcccccacccacccagcaggccgtggcccggcggcccccaggcggcaccagccccccaaatggaggcctgcccggccccctggccaccagcgctgcccctcctggccccccagctgctgccagcccctgcctgggccctgtggccgctgctggcagcggcctgcggagaggagctgagggcatcctggccccccagcccccaccaccccagcagcaccaggagaggcctggagctgctgccatcggcagcgcccggggccagagcacaggcaagggccccccccagagccctgtgtttgagggcgtgtacaacaacagcaggatgctgcacttcctgacagctgtggtgggcagcacctgtgatgtgaaggtgaagaatggcaccacctatgagggcatcttcaagaccctgagcagcaagtttgagctggccgtggatgctgtgcacaggaaggccagcgagcctgctgggggccccaggagagaagatattgtggacaccatggtgttcaagcccagtgatgtgatgctggtgcacttcagaaatgtggacttcaactatgccaccaaggacaagttcacagattctgccatcgccatgaacagcaaggtgaatggagagcacaaggagaaggtgctgcagcgctgggagggcggggacagcaacagtgatgattatgacctggagagtgacatgagcaatggctgggaccccaatgagatgttcaagttcaatgaggagaactacggcgtgaagaccacctatgacagcagcctgagcagctacacagtgcccctggagaaggacaacagcgaggagttccggcagcgggagctgcgggccgcccagctggcccgggagattgagagcagcccccagtaccgcctgagaattgccatggagaatgatgatggccgcacagaggaggagaagcacagcgctgtgcagaggcagggcagcggccgggagagccccagcctggccagccgggagggcaagtacatccccctgcccccccaccggggccagggccagggccctgctggggtgggcggcagctgcagcgccccagcccggccccaccctgtgctgcccagccaccccctcatctacagccctgctggagatggccgctccttcatcttctactacctgtag

SEQ ID NO: 144249 - DNA, 3135 bp, Artificial Sequence
  Description of Artificial Sequence: Synthetic coding sequence
atgctgaagccccagcccctgcagcagcccagccagccccagcagcccccacccacccagcaggccgtggcccggcggcccccaggcggcaccagccccccaaatggaggcctgcccggccccctggccaccagcgctgcccctcctggccccccagctgctgccagcccctgcctgggccctgtggccgctgctggcagcggcctgcggagaggagctgagggcatcctggccccccagcccccaccaccccagcagcaccaggagaggcctggagctgctgccatcggcagcgcccggggccagagcacaggcaagggccccccccagagccctgtgtttgagggcgtgtacaacaacagcaggatgctgcacttcctgacagctgtggtgggcagcacctgtgatgtgaaggtgaagaatggcaccacctatgagggcatcttcaagaccctgagcagcaagtttgagctggccgtggatgctgtgcacaggaaggccagcgagcctgctgggggccccaggagagaagatattgtggacaccatggtgttcaagcccagtgatgtgatgctggtgcacttcagaaatgtggacttcaactatgccaccaaggacaagttcacagattctgccatcgccatgaacagcaaggtgaatggagagcacaaggagaaggtgctgcagcgctgggagggcggggacagcaacagtgatgattatgacctggagagtgacatgagcaatggctgggaccccaatgagatgttcaagttcaatgaggagaactacggcgtgaagaccacctatgacagcagcctgagcagctacacagtgcccctggagaaggacaacagcgaggagttccggcagcgggagctgcgggccgcccagctggcccgggagattgagagcagcccccagtaccgcctgagaattgccatggagaatgatgatggccgcacagaggaggagaagcacagcgctgtgcagaggcagggcagcggccgggagagccccagcctggccagccgggagggcaagtacatccccctgccccagagggtgcgggagggcccccggggcggcgtgcgctgcagcagcagcagaggaggccggcccggcctgagcagcctgcccccccggggcccccaccacctggacaacagcagccctggccctggcagcgaggcccggggcatcaatggaggccccagcaggatgagccccaaggcccagaggcccctgcggggggccaagaccctgagcagccccagcaaccggcccagcggggagacctctgtgcccccacctcctgctgtgggccgcatgtacccacccaggagccccaagtctgctgccccagcccccatcagcgccagctgcccagagccccccatcggcagcgctgtgcccaccagcagcgccagcatccctgtgaccagctctgtgtctgaccccggggtgggcagcatcagccctgccagccccaagatcagcctggcccccacagatgtgaaggagctgagcaccaaggagcccggccgcaccctggagccccaggagctggccagaattgctgggaaggtgcccggcctgcagaatgagcagaagcgcttccagctggaggagctgaggaagtttggagcccagttcaagctgcagcccagcagcagccctgagaacagcctggaccccttccccccacgcatcctgaaggaggagcccaagggcaaggagaaggaggtggatggcctgctgaccagcgagcccatgggcagccctgtgagcagcaagacagagagcgtgtctgacaaggaggacaagccacccctggcccccagcggcggcacagagggccctgagcagcccccaccaccctgccccagccagacaggcagcccccctgtgggcctcatcaagggggaggacaaggatgagggccctgtggccgagcaggtgaagaagagcaccctgaaccccaatgccaaggagttcaaccccaccaagcccctgctgtctgtgaacaagagcaccagcacccccaccagccctggccccaggacccacagcacccccagcatccctgtgctgacagctggccagagcggcctgtacagcccccagtacatctcctacatcccccagatccacatgggccctgctgtgcaggccccccagatgtacccctaccctgtgagcaacagcgtgcccggccagcagggcaagtacagaggagccaagggcagcctgcccccccagaggagtgaccagcaccagcctgccagcgccccacccatgatgcaggccgctgctgctgctggcccccccctggtggccgccaccccctacagcagctacatcccctacaacccccagcagtttcctggccagcctgccatgatgcagcccatggcccactaccccagccagcctgtgtttgcccccatgctgcagagcaaccccaggatgctgaccagcggcagccacccccaggccatcgtgagcagcagcaccccccagtaccccagcgctgagcagcccaccccccaggccctgtatgccaccgtgcaccagagctacccccaccacgccacccagctgcacgcccaccagccccagcctgccaccacccccaccggcagccagccccagagccagcacgccgcccccagccctgtgcagcaccaggccggccaggccccccacctgggcagcggccagccccagcagaacctgtaccaccctggggccctgaccggcaccccacccagcctgcccccaggccccagcgcccagagcccccagagcagcttcccccagcctgctgctgtgtatgccatccaccaccagcagctgccccacggcttcaccaacatggcccacgtgacccaggcccacgtgcagacaggcatcacagctgcccccccaccccaccctggggccccccaccccccccaggtgatgctgctgcaccccccccagagccatggaggccccccccagggcgctgtgccccagagcggcgtgcctgccctgagcgccagcacccccagcccctacccctacatcggccacccccaggcccccctgcccccacctggagagctgaagatcgtgctggccgccacctag

SEQ ID NO: 144250 - DNA, 3294 bp, Artificial Sequence
  Description of Artificial Sequence: Synthetic coding sequence
atgctgaagccccagcccctgcagcagcccagccagccccagcagcccccacccacccagcaggccgtggcccggcggcccccaggcggcaccagccccccaaatggaggcctgcccggccccctggccaccagcgctgcccctcctggccccccagctgctgccagcccctgcctgggccctgtggccgctgctggcagcggcctgcggagaggagctgagggcatcctggccccccagcccccaccaccccagcagcaccaggagaggcctggagctgctgccatcggcagcgcccggggccagagcacaggcaagggccccccccagagccctgtgtttgagggcgtgtacaacaacagcaggatgctgcacttcctgacagctgtggtgggcagcacctgtgatgtgaaggtgaagaatggcaccacctatgagggcatcttcaagaccctgagcagcaagtttgagctggccgtggatgctgtgcacaggaaggccagcgagcctgctgggggccccaggagagaagatattgtggacaccatggtgttcaagcccagtgatgtgatgctggtgcacttcagaaatgtggacttcaactatgccaccaaggacaagttcacagattctgccatcgccatgaacagcaaggtgaatggagagcacaaggagaaggtgctgcagcgctgggagggcggggacagcaacagtgatgattatgacctggagagtgacatgagcaatggctgggaccccaatgagatgttcaagttcaatgaggagaactacggcgtgaagaccacctatgacagcagcctgagcagctacacagtgcccctggagaaggacaacagcgaggagttccggcagcgggagctgcgggccgcccagctggcccgggagattgagagcagcccccagtaccgcctgagaattgccatggagaatgatgatggccgcacagaggaggagaagcacagcgctgtgcagaggcagggcagcggccgggagagccccagcctggccagccgggagggcaagtacatccccctgccccagagggtgcgggagggcccccggggcggcgtgcgctgcagcagcagcagaggaggccggcccggcctgagcagcctgcccccccggggcccccaccacctggacaacagcagccctggccctggcagcgaggcccggggcatcaatggaggccccagcaggatgagccccaaggcccagaggcccctgcggggggccaagaccctgagcagccccagcaaccggcccagcggggagacctctgtgcccccacctcctgctgtgggccgcatgtacccacccaggagccccaagtctgctgccccagcccccatcagcgccagctgcccagagccccccatcggcagcgctgtgcccaccagcagcgccagcatccctgtgaccagctctgtgtctgaccccggggtgggcagcatcagccctgccagccccaagatcagcctggcccccacagatgtgaaggagctgagcaccaaggagcccggccgcaccctggagccccaggagctggccagaattgctgggaaggtgcccggcctgcagaatgagcagaagcgcttccagctggaggagctgaggaagtttggagcccagttcaagctgcagcccagcagcagccctgagaacagcctggaccccttccccccacgcatcctgaaggaggagcccaagggcaaggagaaggaggtggatggcctgctgaccagcgagcccatgggcagccctgtgagcagcaagacagagagcgtgtctgacaaggaggacaagccacccctggcccccagcggcggcacagagggccctgagcagcccccaccaccctgccccagccagacaggcagcccccctgtgggcctcatcaagggggaggacaaggatgagggccctgtggccgagcaggtgaagaagagcaccctgaaccccaatgccaaggagttcaaccccaccaagcccctgctgtctgtgaacaagagcaccagcacccccaccagccctggccccaggacccacagcacccccagcatccctgtgctgacagctggccagagcggcctgtacagcccccagtacatctcctacatcccccagatccacatgggccctgctgtgcaggccccccagatgtacccctaccctgtgagcaacagcgtgcccggccagcagggcaagtacagaggagccaagggcagcctgcccccccagaggagtgaccagcaccagcctgccagcgccccacccatgatgcaggccgctgctgctgctggcccccccctggtggccgccaccccctacagcagctacatcccctacaacccccagcagtttcctggccagcctgccatgatgcagcccatggcccactaccccagccagcctgtgtttgcccccatgctgcagagcaaccccaggatgctgaccagcggcagccacccccaggccatcgtgagcagcagcaccccccagtaccccagcgctgagcagcccaccccccaggccctgtatgccaccgtgcaccagagctacccccaccacgccacccagctgcacgcccaccagccccagcctgccaccacccccaccggcagccagccccagagccagcacgccgcccccagccctgtgcagcaccaggccggccaggccccccacctgggcagcggccagccccagcagaacctgtaccaccctggggccctgaccggcaccccacccagcctgcccccaggccccagcgcccagagcccccagagcagcttcccccagcctgctgctgtgtatgccatccaccaccagcagctgccccacggcttcaccaacatggcccacgtgacccaggcccacgtgcagacaggcatcacagctgcccccccaccccaccctggggccccccaccccccccaggtgatgctgctgcaccccccccagagccatggaggccccccccagggcgctgtgccccagagcggcgtgcctgccctgagcgccagcacccccagcccctacccctacatcggccacccccagggcgagcagcccggccaggcccctggcttccctggaggagcagatgaccgcatcctgtgccgggtgggccgcagccacagcagaagacggcagggcctggcccctggctctgtgctgtgcttcccccccagcagcctgagctgtgaccctgctgcccccctgcccacagccagccctgccctgagtgaccctgactgcctgctgacctag

SEQ ID NO: 144251 - DNA, 2679 bp, Artificial Sequence
  Description of Artificial Sequence: Synthetic coding sequence
atgtctgaaagagctgctgatgatgtgcggggggagccccggcgggctgctgctgctgctgggggcgctgctgctgctgctgcccggcagcagcagcagcagcagcagcagcagcagcccccaccaccccagccccagaggcagcagcaccccccacctccacccaggaggaccaggccagaagatggcggccctggagctgccagcaccagcgctgctgccatggccaccgtgggggagcggcggcccctgcccagccctgaggtgatgctgggccagagctggaacctgtgggtggaggccagcaagctgcccgggaaggatggaacagagctggatgagagcttcaaggagtttgggaagaaccgggaggtgatgggcctgtgccgggaggacatgcccatcttcggcttctgcccagcccatgatgacttctacctggtggtgtgcaatgactgcaaccaggtggtgaagccccaggccttccagagccactatgaaagaagacacagcagcagcagcaagccacccctggccgtgccccccaccagcgtcttctccttcttccccagcctgagcaagagcaagggcggcagcgccagcggcagcaacagaagcagcagcggcggcgtgctgagcgccagcagcagcagcagcaagctgctgaagagccccaaggagaagctgcagctgcggggcaacacccggcccatgcaccccatccagcagagccgggtgccccacggccgcatcatgaccccatctgtgaaggtggagaagatccaccccaagatggatggcaccctgctgaagtctgctgtgggccccacctgcccagccaccgtgagcagcctggtgaagccaggcctgaactgccccagcatccccaagcccaccctgcccagccctggccagatcctgaatggcaagggcctgcctgccccacccaccctggagaagaagccagaggacaacagcaacaacaggaagttcctgaacaagaggctgtctgagcgggagtttgatcctgacatccactgtggggtcatcgacctggacaccaagaagccctgcaccaggagcctgacctgcaagacccacagcctgacccagaggagagctgtgcagggccgcaggaagagatttgatgtgctgctggccgagcacaagaacaagacccgggagaaggagctgatccgccacccagacagccagcagcccccccagcccctgcgggacccccacccagccccacccaggaccagccaggagccccaccagaacccccacggcgtcatccccagcgagagcaagccctttgtggccagcaagcccaagccccacacccccagcctgcccaggcctcctggctgcccagcccagcagggcggcagcgcccccatcgaccccccacctgtgcatgagagcccccacccccccctgcctgccacagagcccgccagccggctgagcagcgaggagggggagggagatgacaaggaggagagcgtggagaagctggactgccactacagcggccaccacccccagcctgccagcttctgcaccttcggcagccggcagatcggccggggctactacgtgtttgacagccgctggaaccggctgcgctgtgccctgaacctgatggtggagaagcacctgaatgcccagctgtggaagaagatcccccctgtgcccagcaccaccagccccatcagcacccgcatcccccacaggaccaacagcgtgcccaccagccagtgtggggtgtcctacctggccgccgccaccgtgtccaccagccctgtgctgctgagcagcacctgcatcagccccaacagcaagtctgtgcctgcccacggcaccaccctgaatgcccagcctgctgccagcggggccatggaccctgtgtgcagcatgcagagccggcaggtgagcagcagcagcagcagccccagcaccccatctggcctgagctctgtgcccagcagccccatgagcaggaagccccagaagctgaagagcagcaagagcctgcggcccaaggagagcagcggcaacagcaccaactgccagaatgccagcagcagcaccagcggcggcagcggcaagaagaggaagaacagcagccccctgctggtgcacagcagcagcagcagcagcagcagcagcagcagcagccacagcatggagagcttcaggaagaactgtgtggcccacagcggccccccctaccccagcacagtgaccagcagccacagcatcggcctgaactgtgtgaccaacaaggccaatgctgtgaatgtgagacatgaccagagcggccggggccccccaacaggcagccctgctgagagcatcaagaggatgtctgtgatggtgaacagcagtgacagcaccctgagcctgggccccttcatccaccagagcaatgagctgcctgtgaacagccacggcagcttcagccacagccacacccccctggacaagctgattggcaagaagaggaagtgcagccccagcagcagcagcatcaacaacagcagcagcaagcccaccaaggtggccaaggtgcctgctgtgaacaacgtgcacatgaagcacacaggcaccatccctggggcccagggcctgatgaacagcagcctgctgcaccagcccaaggcccggccctag

SEQ ID NO: 144252 - DNA, 2838 bp, Artificial Sequence
  Description of Artificial Sequence: Synthetic coding sequence
atgtctgaaagagctgctgatgatgtgcggggggagccccggcgggctgctgctgctgctgggggcgctgctgctgctgctgcccggcagcagcagcagcagcagcagcagcagcagcccccaccaccccagccccagaggcagcagcaccccccacctccacccaggaggaccaggccagaagatggcggccctggagctgccagcaccagcgctgctgccatggccaccgtgggggagcggcggcccctgcccagccctgaggtgatgctgggccagagctggaacctgtgggtggaggccagcaagctgcccgggaaggatggaacagagctggatgagagcttcaaggagtttgggaagaaccgggaggtgatgggcctgtgccgggaggacatgcccatcttcggcttctgcccagcccatgatgacttctacctggtggtgtgcaatgactgcaaccaggtggtgaagccccaggccttccagagccactatgaaagaagacacagcagcagcagcaagccacccctggccgtgccccccaccagcgtcttctccttcttccccagcctgagcaagagcaagggcggcagcgccagcggcagcaacagaagcagcagcggcggcgtgctgagcgccagcagcagcagcagcaagctgctgaagagccccaaggagaagctgcagctgcggggcaacacccggcccatgcaccccatccagcagagccgggtgccccacggccgcatcatgaccccatctgtgaaggtggagaagatccaccccaagatggatggcaccctgctgaagtctgctgtgggccccacctgcccagccaccgtgagcagcctggtgaagccaggcctgaactgccccagcatccccaagcccaccctgcccagccctggccagatcctgaatggcaagggcctgcctgccccacccaccctggagaagaagccagaggacaacagcaacaacaggaagttcctgaacaagaggctgtctgagcgggagtttgatcctgacatccactgtggggtcatcgacctggacaccaagaagccctgcaccaggagcctgacctgcaagacccacagcctgacccagaggagagctgtgcagggccgcaggaagagatttgatgtgctgctggccgagcacaagaacaagacccgggagaaggagctgatccgccacccagacagccagcagcccccccagcccctgcgggacccccacccagccccacccaggaccagccaggagccccaccagaacccccacggcgtcatccccagcgagagcaagccctttgtggccagcaagcccaagccccacacccccagcctgcccaggcctcctggctgcccagcccagcagggcggcagcgcccccatcgaccccccacctgtgcatgagagcccccacccccccctgcctgccacagagcccgccagccggctgagcagcgaggagggggagggagatgacaaggaggagagcgtggagaagctggactgccactacagcggccaccacccccagcctgccagcttctgcaccttcggcagccggcagatcggccggggctactacgtgtttgacagccgctggaaccggctgcgctgtgccctgaacctgatggtggagaagcacctgaatgcccagctgtggaagaagatcccccctgtgcccagcaccaccagccccatcagcacccgcatcccccacaggaccaacagcgtgcccaccagccagtgtggggtgtcctacctggccgccgccaccgtgtccaccagccctgtgctgctgagcagcacctgcatcagccccaacagcaagtctgtgcctgcccacggcaccaccctgaatgcccagcctgctgccagcggggccatggaccctgtgtgcagcatgcagagccggcaggtgagcagcagcagcagcagccccagcaccccatctggcctgagctctgtgcccagcagccccatgagcaggaagccccagaagctgaagagcagcaagagcctgcggcccaaggagagcagcggcaacagcaccaactgccagaatgccagcagcagcaccagcggcggcagcggcaagaagaggaagaacagcagccccctgctggtgcacagcagcagcagcagcagcagcagcagcagcagcagccacagcatggagagcttcaggaagaactgtgtggcccacagcggccccccctaccccagcacagtgaccagcagccacagcatcggcctgaactgtgtgaccaacaaggccaatgctgtgaatgtgagacatgaccagagcggccggggccccccaacaggcagccctgctgagagcatcaagaggatgtctgtgatggtgaacagcagtgacagcaccctgagcctgggccccttcatccaccagagcaatgagctgcctgtgaacagccacggcagcttcagccacagccacacccccctggacaagctgattggcaagaagaggaagtgcagccccagcagcagcagcatcaacaacagcagcagcaagcccaccaaggtggccaaggtgcctgctgtgaacaacgtgcacatgaagcacacaggcaccatccctggggcccagggcctgatgaacagcagcctgctgcaccaggacatcagcagcccctgcctgaggacaggcatcagcgccaccagcccccagagcccagacctgaagagcaagggcaccagcctgacagctgagaacagcactggaagaaataatgctgacacctttgaggacaagctgcacctgcacagcgccctgtggaccccccgctgcctgtag

SEQ ID NO: 144253 - DNA, 81 bp, Artificial Sequence
  Description of Artificial Sequence: Synthetic coding sequence
atgtctgaaagagctgctgatgatgtgcggggggagccccggcgggctgctgctgctgctgggggcgctgctgctgcctag

SEQ ID NO: 144254 - DNA, 2679 bp, Artificial Sequence; identical to SEQ ID NO: 144251
  Description of Artificial Sequence: Synthetic coding sequence

SEQ ID NO: 144255 - DNA, 2838 bp, Artificial Sequence; identical to SEQ ID NO: 144252
  Description of Artificial Sequence: Synthetic coding sequence

SEQ ID NO: 144256 - DNA, 393 bp, Artificial Sequence
  Description of Artificial Sequence: Synthetic coding sequence
atgtctgaaagagctgctgatgatgtgcggggggagccccggcgggctgctgctgctgctgggggcgctgctgctgctgctgcccggcagcagcagcagcagcagcagcagcagcagcccccaccaccccagccccagaggcagcagcaccccccacctccacccaggaggaccaggccagaagatggcggccctggagctgccagcaccagcgctgctgccatggccaccgtgggggagcggcggcccctgcccagccctgaggtgatgctgggccagagctggaacctgtgggtggaggccagcaagctgcccgggaaggatggagaccgcatcggcaggaagttccagggcgtgtggaaccgggaggtgatgggcctgtgccgggagtag

SEQ ID NO: 144257 - DNA, 2244 bp, Artificial Sequence
  Description of Artificial Sequence: Synthetic coding sequence
atggagggcagcaagacccccctgcagagcagccccagcgcccaggagctgaaggcccccctggagaggaggcacagcagcagcagcaagccacccctggccgtgccccccacctctgtgttctccttcttccccagcctgagcaagagcaaaggaggcagcgccagcggcagcaacagaagcagcagtggaggagtgctgagcgccagcagcagcagcagcaagctgctgaagagccccaaggagaagctgcagctgcggggcaacacccggcccatgcaccccatccagcagagccgggtgccccacggccgcatcatgacccccagcgtgaaggtggagaagatccaccccaagatggatggcaccctgctgaagtctgctgtgggccccacctgcccagccaccgtgagcagcctggtgaagccaggcctgaactgccccagcatccccaagcccaccctgcccagccctggccagatcctgaatggcaagggcctgcctgccccacccaccctggagaagaagccagaggacaacagcaacaacaggaagttcctgaacaagaggctgtctgagcgggagtttgatcctgacatccactgcggcgtgattgacctggacaccaagaagccctgcaccaggagcctgacctgcaagacccacagcctgacccagaggagagctgtgcagggccgcaggaagagatttgatgtgctgctggccgagcacaagaacaagacccgggagaaggagctgatccgccacccagacagccagcagcccccccagcccctgcgggacccccacccagccccacccaggaccagccaggagccccaccagaacccccatggagtcatccccagcgagagcaagccctttgtggccagcaagcccaagccccacacccccagcctgccccggcccccaggctgcccagcccagcagggcggcagcgcccccattgatcctcctcctgtgcatgagagcccccacccccccctgcctgccacagagcccgccagccggctgagcagcgaggagggggagggagatgacaaggaggagagcgtggagaagctggactgccactacagcggccaccacccccagcctgccagcttctgcaccttcggcagccggcagatcggccggggctactacgtgtttgacagccgctggaaccggctgcgctgtgccctgaacctgatggtggagaagcacctgaatgcccagctgtggaagaagatcccccctgtgcccagcaccaccagccccatcagcacccgcatcccccacaggaccaacagcgtgcccaccagccagtgtggggtgtcctacctggccgccgccaccgtgtccaccagccctgtgctgctgagcagcacctgcatcagccccaacagcaagtctgtgcctgcccacggcaccaccctgaatgcccagcctgctgccagcggggccatggaccctgtgtgcagcatgcagagccggcaggtgagcagcagcagcagcagccccagcacccccagcggcctgagctctgtgcccagcagccccatgagcaggaagccccagaagctgaagagcagcaagagcctgcggcccaaggagagcagcggcaacagcaccaactgccagaatgccagcagcagcaccagcggcggcagcggcaagaagaggaagaacagcagccccctgctggtgcacagcagcagcagcagcagcagcagcagcagcagcagccacagcatggagagcttcaggaagaactgtgtggcccacagcggccccccctaccccagcacagtgaccagcagccacagcatcggcctgaactgtgtgaccaacaaggccaatgctgtgaatgtgagacatgaccagagcggccggggcccccccaccggcagccctgctgagagcatcaagaggatgtctgtgatggtgaacagcagtgacagcaccctgagcctgggccccttcatccaccagagcaatgagctgcctgtgaacagccacggcagcttcagccacagccacacccccctggacaagctgattggcaagaagaggaagtgcagccccagcagcagcagcatcaacaacagcagcagcaagcccaccaaggtggccaaggtgcctgctgtgaacaacgtgcacatgaagcacacaggcaccatccctggggcccagggcctgatgaacagcagcctgctgcaccagcccaaggcccggccctag

SEQ ID NO: 144258 - DNA, 663 bp, Artificial Sequence
  Description of Artificial Sequence: Synthetic coding sequence
atggaggaggatgagttcatcggggagaagaccttccagcgctactgtgccgagttcatcaagcacagccagcagatcggggacagctgggagtggaggcccagcaaggactgcagtgatggctacatgtgcaagatccacttccagatcaagaatggatctgtgatgagccacctgggcgccagcacccacggccagacctgcctgcccatggaggaggcctttgagctgcccctggatgactgtgaggtgattgaaacagctgctgccagcgaggtgatcaagtatgagtaccacgtgctgtacagctgcagctaccaggtgcctgtgctgtacttccgggccagcttcctggatggccggcccctgaccctgaaggacatctgggagggcgtgcatgagtgctacaagatgaggctgctgcagggcccctgggacaccatcacccagcaggagcaccccatcctgggccagcccttctttgtgctgcacccctgcaagaccaatgagttcatgacccctgtgctgaagaacagccagaagatcaacaagaatgtgaactacatcacctcctggctgagcatcgtgggccctgtggtgggcctgaacctgcccctgtcctatgccaaggccaccagccaggatgaaagaaatgtgccctag

SEQ ID NO: 144259 - DNA, 378 bp, Artificial Sequence
  Description of Artificial Sequence: Synthetic coding sequence
atggaggaggatgagttcatcggggagaagaccttccagcgctactgtgccgagttcatcaagcacagccagcagatcggggacagctgggagtggaggcccagcaaggactgcagtgatggctacatgtgcaagatccacttccagatcaagaatggatctgtgatgagccacctgggcgccagcacccacggccagacctgcctgcccatggaggtgaagagctgcagcgtgacccaggccggcgtgcagctgcgggacctgagcagcctgcagcccccacccagcggcttcaagcagttcagctgcctgagcctgcccagcaactgggactaccggggcagccccctgcacctggccaacttcctgtacttctag

SEQ ID NO: 144260 - DNA, 663 bp, Artificial Sequence; identical to SEQ ID NO: 144258
  Description of Artificial Sequence: Synthetic coding sequence

SEQ ID NO: 144261 - DNA, 882 bp, Artificial Sequence
  Description of Artificial Sequence: Synthetic coding sequence
atggacagaagagtgaagctgtgggaggtgtttggagagaagtgtgagttcaagggcagcctgagcggcagcaatgccggcatcaccagcattgaatttgattctgctggcagctacctgctggccgccagcaatgactttgccagccgcatctggacagtggatgactaccgcctgcggcacaccctgaccggccacagcggcaaggtgctgagcgccaagttcctgctggacaatgcccgcatcgtgtctggcagccatgacaggaccctgaagctgtgggacctgcggagcaaggtgtgcatcaagacagtgtttgctggcagcagctgcaatgacatcgtgtgcacagagcagtgtgtgatgagcggccactttgacaagaagatccgcttctgggacatccgctctgagagcatcgtgcgggagatggagctgctgggcaagatcacagccctggacctgaaccctgagaggacagagctgctgagctgcagcagagatgacctgctgaaggtgattgacctgcggaccaatgccatcaagcagaccttcagcgcccctggcttcaagtgtggcagtgactggaccagggtggtgttctccccagatggcagctatgtggccgccggcagcgctgagggcagcctgtacatctggagcgtgctgaccgggaaggtggagaaggtgctgagcagcagcacagcccaccccagcatgcgctggaggggccggcccctggcccggaccctgtctgtgtggaccaaggatgccaagctgtgctgcggccacagcacagatggagccctgcgggccggccgcacccctgtgcccagcagcgaggaggcccacggcctgctgcagccctgccctggaagatag

SEQ ID NO: 144262 - DNA, 1335 bp, Artificial Sequence
  Description of Artificial Sequence: Synthetic coding sequence
atgagcagcggcctgcgggctgctgacttcccccgctggaagaggcacatcagcgagcagctgcggcggcgggaccggctgcagaggcaggcctttgaggagatcatcctgcagtacaacaagctgctggagaagagtgacctgcacagcgtgctggcccagaagctgcaggccgagaagcatgatgtgcccaacagacatgagatcagaagacggcaggcccggctgcagaaggagctggccgaggccgccaaggagcccctgcctgtggagcaggatgatgacatcgaggtgattgtggatgagaccagtgaccacacagaggagaccagccctgtgcgggccatcagcagagctgccacccggcgctctgtgtcctccttccctgtgccccaggacaacgtggacacccaccctggcagcggcaaggaggtgcgggtgcctgccacagccctgtgtgtgtttgatgcccatgatggagaggtgaatgctgtgcagttcagccctggcagccggctgctggccaccggcggcatggacagaagagtgaagctgtgggaggtgtttggagagaagtgtgagttcaagggcagcctgagcggcagcaatgccggcatcaccagcattgaatttgattctgctggcagctacctgctggccgccagcaatgactttgccagccgcatctggacagtggatgactaccgcctgcggcacaccctgaccggccacagcggcaaggtgctgagcgccaagttcctgctggacaatgcccgcatcgtgtctggcagccatgacaggaccctgaagctgtgggacctgcggagcaaggtgtgcatcaagacagtgtttgctggcagcagctgcaatgacatcgtgtgcacagagcagtgtgtgatgagcggccactttgacaagaagatccgcttctgggacatccgctctgagagcatcgtgcgggagatggagctgctgggcaagatcacagccctggacctgaaccctgagaggacagagctgctgagctgcagcagagatgacctgctgaaggtgattgacctgcggaccaatgccatcaagcagaccttcagcgcccctggcttcaagtgtggcagtgactggaccagggtggtgttctccccagatggcagctatgtggccgccggcagcgctgagggcagcctgtacatctggagcgtgctgaccgggaaggtggagaaggtgctgagcaagcagcacagcagcagcatcaatgctgtggcctggagccccagcggcagccacgtggtgtctgtggacaagggctgcaaggctgtgctgtgggcccagtactag

SEQ ID NO: 144263 - DNA, 1287 bp, Artificial Sequence
  Description of Artificial Sequence: Synthetic coding sequence
atgagcagcggcctgcgggctgctgacttcccccgctggaagaggcacatcagcgagcagctgcggcggcgggaccggctgcagaggcaggcctttgaggagatcatcctgcagtacaacaagctgctggagaagagtgacctgcacagcgtgctggcccagaagctgcaggccgagaagcatgatgtgcccaacagacatgagatcagaagacggcaggcccggctgcagaaggagctggccgaggccgccaaggagcccctgcctgtggagcaggatgatgacatcgaggtgattgtggatgagaccagtgaccacacagaggagaccagccctgtgcgggccatcagcagagctgccaccaagaggctgagccagcctgctgggggcctgctggacagcatcaccaacatctttggaagaagatctgtgagcagcttccctgtgccccaggacaacgtggacacccaccctggcagcggcaaggaggtgcgggtgcctgccacagccctgtgtgtgtttgatgcccatgatggagaggtgaatgctgtgcagttcagccctggcatcaccagcattgaatttgattctgctggcagctacctgctggccgccagcaatgactttgccagccgcatctggacagtggatgactaccgcctgcggcacaccctgaccggccacagcggcaaggtgctgagcgccaagttcctgctggacaatgcccgcatcgtgtctggcagccatgacaggaccctgaagctgtgggacctgcggagcaaggtgtgcatcaagacagtgtttgctggcagcagctgcaatgacatcgtgtgcacagagcagtgtgtgatgagcggccactttgacaagaagatccgcttctgggacatccgctctgagagcatcgtgcgggagatggagctgctgggcaagatcacagccctggacctgaaccctgagaggacagagctgctgagctgcagcagagatgacctgctgaaggtgattgacctgcggaccaatgccatcaagcagaccttcagcgcccctggcttcaagtgtggcagtgactggaccagggtggtgttctccccagatggcagctatgtggccgccggcagcgctgagggcagcctgtacatctggagcgtgctgaccgggaaggtggagaaggtgctgagcaagcagcacagcagcagcatcaatgctgtggcctggagccccagcggcagccacgtggtgtctgtggacaagggctgcaaggctgtgctgtgggcccagtactag

SEQ ID NO: 144264 - DNA, 1824 bp, Artificial Sequence
  Description of Artificial Sequence: Synthetic coding sequence
atgagcagcggcctgcgggctgctgacttcccccgctggaagaggcacatcagcgagcagctgcggcggcgggaccggctgcagaggcaggcctttgaggagatcatcctgcagtacaacaagctgctggagaagagtgacctgcacagcgtgctggcccagaagctgcaggccgagaagcatgatgtgcccaacagacatgagatcagccctggccatgatggcacctggaatgacaaccagctgcaggagatggcccagctgcgcatcaagcaccaggaggagctgacagagctgcacaagaagagaggagagctggcccagctggtgattgacctgaacaaccagatgcagaggaaggaccgggagatgcagatgaatgaggccaagattgctgaatgtctgcagaccatcagtgacctggagacagagtgcctggacctgcggaccaagctgtgtgacctggagcgggccaaccagaccctgaaggatgaatatgatgccctgcagatcaccttcaccgccctggagggcaagctgaggaagaccacagaggagaaccaggagctggtgacccgctggatggccgagaaggcccaggaggccaaccggctgaatgcagaaaatgagaaggacagcagaagacggcaggcccggctgcagaaggagctggccgaggccgccaaggagcccctgcctgtggagcaggatgatgacatcgaggtgattgtggatgagaccagtgaccacacagaggagaccagccctgtgcgggccatcagcagagctgccaccaagaggctgagccagcctgctgggggcctgctggacagcatcaccaacatctttggaagaagatctgtgagcagcttccctgtgccccaggacaacgtggacacccaccctggcagcggcaaggaggtgcgggtgcctgccacagccctgtgtgtgtttgatgcccatgatggagaggtgaatgctgtgcagttcagccctggcagccggctgctggccactggaggcatggaccggcgggtgaagctgtgggaggtgtttggagagaagtgtgagttcaagggcagcctgagcggcagcaatgccggcatcaccagcattgaatttgacagcgctggcagctacctgctggccgccagcaatgactttgccagccgcatctggacagtggatgactaccgcctgcggcacaccctgaccggccacagcggcaaggtgctgagcgccaagttcctgctggacaatgccagaattgtgtctggcagccatgacaggaccctgaagctgtgggacctgcggagcaaggtgtgcatcaagacagtgtttgctggcagcagctgcaatgacatcgtgtgcacagagcagtgtgtgatgagcggccactttgacaagaagatccgcttctgggacatccgctctgagagcatcgtgcgggagatggagctgctgggcaagatcacagccctggacctgaaccctgagaggacagagctgctgagctgcagcagagatgacctgctgaaggtgattgacctgcggaccaatgccatcaagcagaccttcagcgcccctggcttcaagtgtggcagtgactggaccagggtggtgttctccccagatggcagctatgtggccgccggcagcgctgagggcagcctgtacatctggagcgtgctgaccgggaaggtggagaaggtgctgagcaagcagcacagcagcagcatcaatgctgtggcctggagccccagcggcagccacgtggtgtctgtggacaagggctgcaaggctgtgctgtgggcccagtactag

SEQ ID NO: 144265 - DNA, 1875 bp, Artificial Sequence
  Description of Artificial Sequence: Synthetic coding sequence
atgagcagcggcctgcgggctgctgacttcccccgctggaagaggcacatcagcgagcagctgcggcggcgggaccggctgcagaggcaggcctttgaggagatcatcctgcagtacaacaagctgctggagaagagtgacctgcacagcgtgctggcccagaagctgcaggccgagaagcatgatgtgcccaacagacatgagatcagccctggccatgatggcacctggaatgacaaccagctgcaggagatggcccagctgcgcatcaagcaccaggaggagctgacagagctgcacaagaagagaggagagctggcccagctggtgattgacctgaacaaccagatgcagaggaaggaccgggagatgcagatgaatgaggccaagattgctgaatgtctgcagaccatcagtgacctggagacagagtgcctggacctgcggaccaagctgtgtgacctggagcgggccaaccagaccctgaaggatgaatatgatgccctgcagatcaccttcaccgccctggagggcaagctgaggaagaccacagaggagaaccaggagctggtgacccgctggatggccgagaaggcccaggaggccaaccggctgaatgcagaaaatgagaaggacagcagaagacggcaggcccggctgcagaaggagctggccgaggccgccaaggagcccctgcctgtggagcaggatgatgacatcgaggtgattgtggatgagaccagtgaccacacagaggagaccagccctgtgcgggccatcagcagagctgccaccaagaggctgagccagcctgctgggggcctgctggacagcatcaccaacatcttcggcctgtctgagagccccctgctgggccaccacagcagcagtgatgctgcccggcggcgctctgtgtcctccttccctgtgccccaggacaacgtggacacccaccctggcagcggcaaggaggtgcgggtgcctgccacagccctgtgtgtgtttgatgcccatgatggagaggtgaatgctgtgcagttcagccctggcagccggctgctggccaccggcggcatggacagaagagtgaagctgtgggaggtgtttggagagaagtgtgagttcaagggcagcctgagcggcagcaatgccggcatcaccagcattgaatttgattctgctggcagctacctgctggccgccagcaatgactttgccagccgcatctggacagtggatgactaccgcctgcggcacaccctgaccggccacagcggcaaggtgctgagcgccaagttcctgctggacaatgcccgcatcgtgtctggcagccatgacaggaccctgaagctgtgggacctgcggagcaaggtgtgcatcaagacagtgtttgctggcagcagctgcaatgacatcgtgtgcacagagcagtgtgtgatgagcggccactttgacaagaagatccgcttctgggacatccgctctgagagcatcgtgcgggagatggagctgctgggcaagatcacagccctggacctgaaccctgagaggacagagctgctgagctgcagcagagatgacctgctgaaggtgattgacctgcggaccaatgccatcaagcagaccttcagcgcccctggcttcaagtgtggcagtgactggaccagggtggtgttctccccagatggcagctatgtggccgccggcagcgctgagggcagcctgtacatctggagcgtgctgaccgggaaggtggagaaggtgctgagcaagcagcacagcagcagcatcaatgctgtggcctggagccccagcggcagccacgtggtgtctgtggacaagggctgcaaggctgtgctgtgggcccagtactag

SEQ ID NO: 144266 - DNA, 1767 bp, Artificial Sequence
  Description of Artificial Sequence: Synthetic coding sequence
atgagcagcggcctgcgggctgctgacttcccccgctggaagaggcacatcagcgagcagctgcggcggcgggaccggctgcagaggcaggcctttgaggagatcatcctgcagtacaacaagctgctggagaagagtgacctgcacagcgtgctggcccagaagctgcaggccgagaagcatgatgtgcccaacagacatgagatcagccctggccatgatggcacctggaatgacaaccagctgcaggagatggcccagctgcgcatcaagcaccaggaggagctgacagagctgcacaagaagagaggagagctggcccagctggtgattgacctgaacaaccagatgcagaggaaggaccgggagatgcagatgaatgaggccaagattgctgaatgtctgcagaccatcagtgacctggagacagagtgcctggacctgcggaccaagctgtgtgacctggagcgggccaaccagaccctgaaggatgaatatgatgccctgcagatcaccttcaccgccctggagggcaagctgaggaagaccacagaggagaaccaggagctggtgacccgctggatggccgagaaggcccaggaggccaaccggctgaatgcagaaaatgagaaggacagcagaagacggcaggcccggctgcagaaggagctggccgaggccgccaaggagcccctgcctgtggagcaggatgatgacatcgaggtgattgtggatgagaccagtgaccacacagaggagaccagccctgtgcgggccatcagcagagctgccacccggcgctctgtgtcctccttccctgtgccccaggacaacgtggacacccaccctggcagcggcaaggaggtgcgggtgcctgccacagccctgtgtgtgtttgatgcccatgatggagaggtgaatgctgtgcagttcagccctggcagccggctgctggccaccggcggcatggacagaagagtgaagctgtgggaggtgtttggagagaagtgtgagttcaagggcagcctgagcggcagcaatgccggcatcaccagcattgaatttgattctgctggcagctacctgctggccgccagcaatgactttgccagccgcatctggacagtggatgactaccgcctgcggcacaccctgaccggccacagcggcaaggtgctgagcgccaagttcctgctggacaatgcccgcatcgtgtctggcagccatgacaggaccctgaagctgtgggacctgcggagcaaggtgtgcatcaagacagtgtttgctggcagcagctgcaatgacatcgtgtgcacagagcagtgtgtgatgagcggccactttgacaagaagatccgcttctgggacatccgctctgagagcatcgtgcgggagatggagctgctgggcaagatcacagccctggacctgaaccctgagaggacagagctgctgagctgcagcagagatgacctgctgaaggtgattgacctgcggaccaatgccatcaagcagaccttcagcgcccctggcttcaagtgtggcagtgactggaccagggtggtgttctccccagatggcagctatgtggccgccggcagcgctgagggcagcctgtacatctggagcgtgctgaccgggaaggtggagaaggtgctgagcaagcagcacagcagcagcatcaatgctgtggcctggagccccagcggcagccacgtggtgtctgtggacaagggctgcaaggctgtgctgtgggcccagtactag

SEQ ID NO: 144267 - DNA, 2520 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagcctcatcaccatcctggtgattgctggggtcttctggatccacaggctcatcaagttcatctacaacatctgctgctactgggagatccacagcttctacctgcacgccctgcgcatccccatgtctgccctgccctactgcacctggcaggaggtgcaggccagaattgtgcagacccagaaggagcaccagatctgcatccacaagcgggagctgacagagctggacatctaccaccgcatcctgcgcttccagaactacatggtggccctggtgaacaagagcctgctgcccctgcgcttccggctgcccggcctgggggaggccgtgttcttcacccggggcctgaagtacaactttgagctgatcctcttctggggccctggcagcctcttcctgaatgagtggagcctgaaggccgagtacaagaggggcggccagaggctggagctggcccagaggctgagcaaccgcatcctgtggattggaattgccaacttcctgctgtgccccctcatcctgatctggcagatcctgtatgccttcttctcctatgcagaggtgctgaagcgggagcccggggccctgggcgcccgctgctggagcctgtatggccgctgctacctgcggcacttcaatgagctggagcacgagctgcagagccggctgaacagaggctacaagccagccagcaagtacatgaactgcttcctgagccccctgctgaccctgctggccaagaatggagccttctttgctggcagcatcctggccgtgctgattgccctgaccatctatgatgaagatgtgctggccgtggagcacgtgctgaccaccgtgaccctgctgggcgtgacagtgacagtgtgccgctccttcatcccagaccagcacatggtgttctgcccagagcagctgctgcgggtcatcctggcccacatccactacatgccagaccactggcagggcaatgcccacaggagccagaccagagatgaatttgcccagctgttccagtacaaggctgtgttcatcctggaggagctgctgagccccatcgtgacccccctcatcctgatcttctgcctgcggccccgggccctggagatcatcgacttcttcaggaacttcaccgtggaggtggtgggcgtgggggacacctgcagctttgcccagatggatgtgcggcagcacggccacccccagtggctgtctgctggccagacagaggcctctgtgtaccagcaggctgaagatggcaagacagagctgagcctgatgcactttgccatcaccaaccctggctggcagcccccccgggagagcacagccttcctgggcttcctgaaggagcaggtgcagagagatggagctgctgccagcctggcccagggcggcctgctgcctgaaaatgccctcttcaccagcatccagagcctgcagagcgagagcgagcccctgagcctgattgccaacgtggtggccggcagcagctgccggggcccccccctgccccgggacctgcagggcagccgccacagagctgaggtggccagcgccctgcggagcttcagccccctgcagcccggccaggcccccaccggccgggcccacagcaccatgactggaagtggagtggatgccaggacagccagcagcggcagctctgtgtgggagggccagctgcagagcctggtgctgtctgaatatgccagcacagagatgagcctgcacgccctgtacatgcaccagctgcacaagcagcaggcccaggccgagcctgagcggcacgtgtggcaccggcgggagagtgatgagagcggggagagcgccccagatgagggcggggagggcgcccgggccccccagagcatccccaggtctgccagctacccctgtgccgcccccaggcctggggcccctgagaccacagccctgcacggcggcttccagaggagatatggaggcatcacagatcctggcaccgtgccccgggtgcccagccacttcagccggctgcccctgggcggctgggccgaggatggccagagcgccagccgccaccctgagcctgtgcctgaggagggctctgaagatgagctgcccccccaggtgcacaaggtgtag

SEQ ID NO: 144268 - DNA, 2520 bp, Artificial Sequence; identical to SEQ ID NO: 144267
  Description of Artificial Sequence: Synthetic coding sequence

SEQ ID NO: 144269 - DNA, 2337 bp, Artificial Sequence
  Description of Artificial Sequence: Synthetic coding sequence
atgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagcctcatcaccatcctggtgattgctggggtcttctggatccacaggctcatcaagttcatctacaacatctgctgctactgggagatccacagcttctacctgcacgccctgcgcatccccatgtctgccctgccctactgcacctggcaggaggtgcaggcccgcatcgtgcagacccagaaggagcaccagatctgcatccacaagcgggagctgacagagctggacatctaccaccgcatcctgcgcttccagaactacatggtggccctggtgaacaagagcctgctgcccctgcgcttccggctgcccggcctgggggaggccgtgttcttcacccggggcctgaagtacaactttgagctgatcctcttctggggccctggcagcctcttcctgaatgagtggagcctgaaggccgagtacaagagaggaggccagaggctggagctggcccagaggctgagcaaccgcatcctgtggattggcatcgccaacttcctgctgtgccccctcatcctgatctggcagatcctgtatgccttcttctcctatgcagaggtgctgaagcgggagcccggggccctgggcgcccgctgctggagcctgtatggccgctgctacctgcggcacttcaatgagctggagcacgagctgcagagccggctgaacagaggctacaagccagccagcaagtacatgaactgcttcctgagccccctgctgaccctgctggccaagaatggagccttctttgctggcagcatcctggccgtgctgattgccctgaccatctatgatgaagatgtgctggccgtggagcacgtgctgaccaccgtgaccctgctgggcgtgacagtgacagtgtgccgctccttcatcccagaccagcacatggtgttctgcccagagcagctgctgcgggtcatcctggcccacatccactacatgccagaccactggcagggcaatgcccacaggagccagaccagagatgaatttgcccagctgttccagtacaaggctgtgttcatcctggaggagctgctgagccccatcgtgacccccctcatcctgatcttctgcctgcggccccgggccctggagatcatcgacttcttcaggaacttcaccgtggaggtggtgggcgtgggggacacctgcagctttgcccagatggatgtgcggcagcacggccacccccagtggctgtctgctggccagacagaggcctctgtgtaccagcaggccgaggatggcaagacagagctgagcctgatgcactttgccatcaccaaccctggctggcagcccccccgggagagcacagccttcctgggcttcctgaaggagcaggtgcagagagatggagctgctgccagcctggcccagggcggcctgctgcctgaaaatgccctcttcaccagcatccagagcctgcagagcgagagcgagcccctgagcctcatcgccaacgtggtggccggcagcagctgccggggcccccccctgccccgggacctgcagggcagccgccacagagctgaggtggccagcgccctgcgctccttcagccccctgcagcccggccaggcccccaccggccgggcccacagcaccatgacaggcagcggcgtggatgccaggacagccagcagcggcagctctgtgtgggagggccagctgcagagcctggtgctgtctgaatatgccagcacagagatgagcctgcacgccctgtacatgcaccagctgcacaagcagcaggcccaggccgagcctgagagacatgtgtggcacagaagagaaagtgatgaaagtggagagagcgccccagatgaaggaggagagggcgcccgggccccccagagcatccccaggtctgccagctacccctgtgccgcccccaggcctggggcccctgagaccacagccctgcatggaggcttccagaggagatatggaggcatcacagaccccggcaccgtgccccgggtgcccagccacttcagccggctgcccctgggcggctgggccgaggatggccagagcgccagccgccaccctgagcctgtgcctgaggagggctctgaagatgagctgcccccccaggtgcacaaggtgtag

SEQ ID NO: 144270 - DNA, 2520 bp, Artificial Sequence; identical to SEQ ID NO: 144267
  Description of Artificial Sequence: Synthetic coding sequence

SEQ ID NO: 144271 - DNA, 510 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagcctcatcaccatcctggtgattgctggggtcttctggatccacaggctcatcaagttcatctacaacatctgctgctactgggagatccacagcttctacctgcacgccctgaggtag

SEQ ID NO: 144272 - DNA, 435 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagcctcatcaccatcctggtgattgctggggtcttctggatctag

SEQ ID NO: 144273 - DNA, 282 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctcttctag

SEQ ID NO: 144274 - DNA, 567 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagcctcatcaccatcctggtgattgctggggtcttctggatccacaggctcatcaagttcatctacaacatctgctgctactgggagatccacagcttctacctgcacgccctgcgcatccccatgtctgccctgccctactgcacctggcaggaggtgcaggccagaattgtgtag

SEQ ID NO: 144275 - DNA, 396 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagctag

SEQ ID NO: 144276 - DNA, 294 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatgtag

SEQ ID NO: 144277 - DNA, 519 bp, Artificial Sequence
  Description of Artificial Sequence: Synthetic coding sequence
atggcccagtttgacacagagtaccagaggctggaggccagctacagcgacagccccccaggagaggaggacctgctggtgcacgtggccgagggcagcaagagcccctggcaccacatcgagaacctggacctcttcttcagccgggtgtacaacctgcaccagaagaatggcttcacctgcatgctgattggagagatctttgagctgatgcagttcctgtttgtggtggccttcaccaccttcctggtgtcctgtgtggactatgacatcctgtttgccaacaagatggtgaaccacagcctgcaccccacagagcctgtgaaggtgaccctgcctgatgccttcctgcctgcccaggtgtgcagcgcccgcatccaggagaatggcagcctcatcaccatcctggtgattgctggggtcttctggatccacaggctcatcaagttcatctacaacatctgctgctactgggagatccacagcttctacctgcacgccctgcgcatccccatgtag

SEQ ID NO: 144278 - DNA, 1662 bp, Artificial Sequence
  Description of Artificial Sequence: Synthetic coding sequence
atggccaagaacagaagagacaggaacagctggggcggcttcagcgagaagacctatgagtggagcagcgaggaggaggagcctgtgaagaaggccggccctgtgcaggtgctgattgtgaaggatgaccacagctttgagctggatgaaacagccctgaaccgcatcctgctgtctgaggccgtgcgggacaaggaggtggtggccgtgtctgtggccggggccttcaggaagggcaagagcttcctgatggacttcatgctgcgctacatgtacaaccaggagagcgtggactgggtgggggactacaatgagcccctgaccggcttctcctggaggggcggcagcgagcgggagaccaccggcatccagatctggagcgagatcttcctgatcaacaagccagatggcaagaaggtggccgtgctgctgatggacacccagggcacctttgacagccagagcaccctgcgggacagcgccaccgtgtttgccctgagcaccatgatcagcagcatccaggtgtacaacctgagccagaatgtgcaggaggatgacctgcagcacctgcagctgttcacagaatatggccgcctggccatggaggagaccttcctgaagcccttccagagcctcatcttcctggtgcgggactggagcttcccctatgagttctcctatggagcagatggaggagccaagttcctggagaagaggctgaaggtgtctggcaaccagcacgaggagctgcagaatgtgaggaagcacatccacagctgcttcaccaacatcagctgcttcctgctgccccaccctggcctgaaggtggccaccaaccccaactttgatggcaagctgaaggagattgatgatgagttcatcaagaacctgaagatcctgatcccctggctgctgagccctgagagcctggacatcaaggagatcaatggaaacaagatcacctgccggggcctggtggagtacttcaaggcctacatcaagatctaccagggcgaggagctgccccaccccaagtccatgctgcaggccacagctgaggccaacaacctggccgctgtggccacagccaaggacacctacaacaagaagatggaggagatctgtggcggggacaagcccttcctggccccaaatgacctgcagaccaagcacctgcagctgaaggaggagagcgtgaagctgttccggggcgtgaagaagatgggcggggaggagttcagccgccgctacctgcagcagctggagagcgagattgatgagctgtacatccagtacatcaagcacaatgacagcaagaacatcttccacgccgcccggaccccagccaccctgtttgtggtgatcttcatcacctacgtgattgctggggtgacaggcttcatcggcctggacatcatcgccagcctgtgcaacatgatcatgggcctgaccctcatcaccctgtgcacctgggcctacatccgctacagcggggagtaccgggagctgggcgctgtgattgaccaggtggccgccgccctgtgggaccaggccctgtacaagctgtacagcgctgctgccacccaccgccacctgtaccaccaggccttccccacccccaagtctgagagcacagagcagagcgagaagaagaagatgtag

SEQ ID NO: 144279 - DNA, 1677 bp, Artificial Sequence
  Description of Artificial Sequence: Synthetic coding sequence
atggccaagaacagaagagacaggaacagctggggcggcttcagcgagaagacctatgagtggagcagcgaggaggaggagcctgtgaagaaggccggccctgtgcaggtgctgattgtgaaggatgaccacagctttgagctggatgaaacagccctgaaccgcatcctgctgtctgaggccgtgcgggacaaggaggtggtggccgtgtctgtggccggggccttcaggaagggcaagagcttcctgatggacttcatgctgcgctacatgtacaaccaggagagcgtggactgggtgggggactacaatgagcccctgaccggcttctcctggaggggcggcagcgagcgggagaccaccggcatccagatctggagcgagatcttcctgatcaacaagccagatggcaagaaggtggccgtgctgctgatggacacccagggcacctttgacagccagagcaccctgcgggacagcgccaccgtgtttgccctgagcaccatgatcagcagcatccaggtgtacaacctgagccagaatgtgcaggaggatgacctgcagcacctgcagctgttcacagaatatggccgcctggccatggaggagaccttcctgaagcccttccagagcctcatcttcctggtgcgggactggagcttcccctatgagttctcctatggagcagatggaggagccaagttcctggagaagaggctgaaggtgtctggcaaccagcacgaggagctgcagaatgtgaggaagcacatccacagctgcttcaccaacatcagctgcttcctgctgccccaccctggcctgaaggtggccaccaaccccaactttgatggcaagctgaaggagattgatgatgagttcatcaagaacctgaagatcctgatcccctggctgctgagccctgagagcctggacatcaaggagatcaatggaaacaagatcacctgccggggcctggtggagtacttcaaggcctacatcaagatctaccagggcgaggagctgccccaccccaagtccatgctgcaggccacagctgaggccaacaacctggccgctgtggccacagccaaggacacctacaacaagaagatggaggagatctgtggcggggacaagcccttcctggccccaaatgacctgcagaccaagcacctgcagctgaaggaggagagcgtgaagctgttccggggcgtgaagaagatgggcggggaggagttcagccgccgctacctgcagcagctggagagcgagattgatgagctgtacatccagtacatcaagcacaatgacagcaagaacatcttccacgccgcccggaccccagccaccctgtttgtggtgatcttcatcacctacgtgattgctggggtgacaggcttcatcggcctggacatcatcgccagcctgtgcaacatgatcatgggcctgaccctcatcaccctgtgcacctgggcctacatccgctacagcggggagtaccgggagctgggcgctgtgattgaccaggtggccgccgccctgtgggaccagggccccagccaccaggccctgtacaagctgtacagcgctgctgccacccaccgccacctgtaccaccaggccttccccacccccaagtctgagagcacagagcagagcgagaagaagaagatgtag

SEQ ID NO: 144280 - DNA, 1677 bp, Artificial Sequence
  Description of Artificial Sequence: Synthetic coding sequence
atggccaagaacagaagagacaggaacagctggggcggcttcagcgagaagacctatgagtggagcagcgaggaggaggagcctgtgaagaaggccggccctgtgcaggtgctgattgtgaaggatgaccacagctttgagctggatgaaacagccctgaaccgcatcctgctgtctgaggccgtgcgggacaaggaggtggtggccgtgtctgtggccggggccttcaggaagggcaagagcttcctgatggacttcatgctgcgctacatgtacaaccaggagagcgtggactgggtgggggactacaatgagcccctgaccggcttctcctggaggggcggcagcgagcgggagaccaccggcatccagatctggagcgagatcttcctgatcaacaagccagatggcaagaaggtggccgtgctgctgatggacacccagggcacctttgacagccagagcaccctgcgggacagcgccaccgtgtttgccctgagcaccatgatcagcagcatccaggtgtacaacctgagccagaatgtgcaggaggatgacctgcagcacctgcagctgttcacagaatatggccgcctggccatggaggagaccttcctgaagcccttccagagcctcatcttcctggtgcgggactggagcttcccctatgagttctcctatggagcagatggaggagccaagttcctggagaagaggctgaaggtgtctggcaaccagcacgaggagctgcagaatgtgaggaagcacatccacagctgcttcaccaacatcagctgcttcctgctgccccaccctggcctgaaggtggccaccaaccccaactttgatggcaagctgaaggagattgatgatgagttcatcaagaacctgaagatcctgatcccctggctgctgagccctgagagcctggacatcaaggagatcaatggaaacaagatcacctgccggggcctggtggagtacttcaaggcctacatcaagatctaccagggcgaggagctgccccaccccaagtccatgctgcaggccacagctgaggccaacaacctggccgctgtggccacagccaaggacacctacaacaagaagatggaggagatctgtggcggggacaagcccttcctggccccaaatgacctgcagaccaagcacctgcagctgaaggaggagagcgtgaagctgttccggggcgtgaagaagatgggcggggaggagttcagccgccgctacctgcagcagctggagagcgagattgatgagctgtacatccagtacatcaagcacaatgacagcaagaacatcttccacgccgcccggaccccagccaccctgtttgtggtgatcttcatcacctacgtgattgctggggtgacaggcttcatcggcctggacatcatcgccagcctgtgcaacatgatcatgggcctgaccctcatcaccctgtgcacctgggcctacatccgctacagcggggagtaccgggagctgggcgctgtgattgaccaggtggccgccgccctgtgggaccagggcagcaccaatgaggccctgtacaagctgtacagcgctgctgccacccaccgccacctgtaccaccaggccttccccacccccaagtctgagagcacagagcagagcgagaagaagaagatgtag

SEQ ID NO: 144281 - DNA, 1662 bp, Artificial Sequence; identical to SEQ ID NO: 144278
  Description of Artificial Sequence: Synthetic coding sequence

SEQ ID NO: 144282 - DNA, 90 bp, Artificial Sequence
  Description of Artificial Sequence: Synthetic coding sequence
atggccaagaacagaagagacaggaacagctggggcggcttcagcgagaagacctatgagtggagcagcgaggaggaggagcctgtgtag

SEQ ID NO: 144283 - DNA, 303 bp, Artificial Sequence
  Description of Artificial Sequence: Synthetic coding sequence
atggccaagaacagaagagacaggaacagctggggcggcttcagcgagaagacctatgagtggagcagcgaggaggaggagcctgtgaagaaggccggccctgtgcaggtgctgattgtgaaggatgaccacagctttgagctggatgaaacagccctgaaccgcatcctgctgtctgaggccgtgcgggacaaggaggtggtggccgtgtctgtggccggggccttcaggaagggcaagagcttcctgatggacttcatgctgcgctacatgtacaaccaggagagcgtggactgggtgtag

SEQ ID NO: 144284 - DNA, 1701 bp, Artificial Sequence
  Description of Artificial Sequence: Synthetic coding sequence
atggtgctgaagaagggcatcaagttcttccagaggctcatcaacagcaagagcctgcgctttggagaaaattatgaagatgatgacctggtgaacagtgatgaggtgatgaagaagccctgccctgtgcagatcgtgctggcccatgaagatgaccacaactttgagctggatgaggaggccctggagcagatcctgctgcaggagcacatccgggacctgaacatcgtggtggtgtctgtggccggggccttcaggaagggcaagagcttcctgctggacttcatgctgcgctacatgtacaacaaggacagccagagctggattggaggcaacaatgagcccctgaccggcttcacctggaggggcggctgtgagcgggagaccaccggcatccaggtgtggaatgaggtgtttgtgattgaccggcccaacggcaccaaggtggccgtgctgctgatggacacccagggcgcctttgacagccagagcaccatcaaggactgtgccaccgtgtttgccctgagcaccatgaccagctctgtgcaggtgtacaacctgagccagaacatccaggaggatgacctgcagcacctgcagctgttcacagaatatggccgcctggccatggaggagatctaccagaagcccttccagaccctgatgttcctgatccgggactggagctacccctatgagcacagctatggcctggagggcggcaagcagttcctggagaagaggctgcaggtgaagcagaaccagcacgaggagctgcagaatgtgaggaagcacatccacaactgcttcagcaacctgggctgcttcctgctgccccaccctggcctgaaggtggccaccaaccccagctttgatggccgcctgaaggacattgatgaggacttcaagcgggagctgaggaacctggtgcccctgctgctggcccctgagaacctggtggagaaggagatcagcggcagcaaggtgacctgccgggacctggtggagtacttcaaggcctacatcaagatctaccagggcgaggagctgccccaccccaagtccatgctgcaggccacagctgaggccaacaacctggccgctgtggccggggcccgggacacctactgcaagtccatggagcaggtgtgtggcggggacaagccctacatcgcccccagcgacctggagaggaagcacctggacctgaaggaggtggccatcaagcagttccgctctgtgaagaagatgggaggagatgagttctgccgccgctaccaggaccagctggaggccgagattgaggagacctacgccaacttcatcaagcacaatgatggcaagaacatcttctatgctgcccggaccccagccaccctgtttgctgtgatgtttgccatgtacatcatcagcggcctgaccggcttcatcggcctgaacagcattgctgtgctgtgcaacctggtgatgggcctggccctgatcttcctgtgcacctgggcctacgtgaagtacagcggggagttccgggagatcggcaccgtcatcgaccagattgctgagaccctgtgggagcagaggagccccaggaaggtgttcagcaagctgtttgaggtgaccaggaggaggatggtgcaccgggccctgagcagcgcccagaggcagaggctgagcagcaacaacaacaagaagaagaactag

SEQ ID NO: 144285 - DNA, 1752 bp, Artificial Sequence
  Description of Artificial Sequence: Synthetic coding sequence
atggccgagggagatgaagctgcccggggccagcagccccaccagggcctgtggaggagaagaaggaccagtgaccccagcgctgctgtgaaccacgtgagcagcaccaccagcctgggagaaaattatgaagatgatgacctggtgaacagtgatgaggtgatgaagaagccctgccctgtgcagatcgtgctggcccatgaagatgaccacaactttgagctggatgaggaggccctggagcagatcctgctgcaggagcacatccgggacctgaacatcgtggtggtgtctgtggccggggccttcaggaagggcaagagcttcctgctggacttcatgctgcgctacatgtacaacaaggacagccagagctggattggaggcaacaatgagcccctgaccggcttcacctggaggggcggctgtgagcgggagaccaccggcatccaggtgtggaatgaggtgtttgtgattgaccggcccaacggcaccaaggtggccgtgctgctgatggacacccagggcgcctttgacagccagagcaccatcaaggactgtgccaccgtgtttgccctgagcaccatgaccagctctgtgcaggtgtacaacctgagccagaacatccaggaggatgacctgcagcacctgcagctgttcacagaatatggccgcctggccatggaggagatctaccagaagcccttccagaccctgatgttcctgatccgggactggagctacccctatgagcacagctatggcctggagggcggcaagcagttcctggagaagaggctgcaggtgaagcagaaccagcacgaggagctgcagaatgtgaggaagcacatccacaactgcttcagcaacctgggctgcttcctgctgccccaccctggcctgaaggtggccaccaaccccagctttgatggccgcctgaaggacattgatgaggacttcaagcgggagctgaggaacctggtgcccctgctgctggcccctgagaacctggtggagaaggagatcagcggcagcaaggtgacctgccgggacctggtggagtacttcaaggcctacatcaagatctaccagggcgaggagctgccccaccccaagtccatgctgcaggccacagctgaggccaacaacctggccgctgtggccggggcccgggacacctactgcaagtccatggagcaggtgtgtggcggggacaagccctacatcgcccccagcgacctggagaggaagcacctggacctgaaggaggtggccatcaagcagttccgctctgtgaagaagatgggaggagatgagttctgccgccgctaccaggaccagctggaggccgagattgaggagacctacgccaacttcatcaagcacaatgatggcaagaacatcttctatgctgcccggaccccagccaccctgtttgctgtgatgtttgccatgtacatcatcagcggcctgaccggcttcatcggcctgaacagcattgctgtgctgtgcaacctggtgatgggcctggccctgatcttcctgtgcacctgggcctacgtgaagtacagcggggagttccgggagatcggcaccgtcatcgaccagattgctgagaccctgtgggagcaggtgctgaagcccctgggggacaacctgatggaggagaacatccggcagagcgtgaccaacagcatcaaggccggcctgacagaccaggtgagccaccacgcccggctgaagacagactag

SEQ ID NO: 144286 - DNA, 1239 bp, Artificial Sequence
  Description of Artificial Sequence: Synthetic coding sequence
atggacacccagggcgcctttgacagccagagcaccatcaaggactgtgccaccgtgtttgccctgagcaccatgaccagctctgtgcaggtgtacaacctgagccagaacatccaggaggatgacctgcagcacctgcagctgttcacagaatatggccgcctggccatggaggagatctaccagaagcccttccagaccctgatgttcctgatccgggactggagctacccctatgagcacagctatggcctggagggcggcaagcagttcctggagaagaggctgcaggtgaagcagaaccagcacgaggagctgcagaatgtgaggaagcacatccacaactgcttcagcaacctgggctgcttcctgctgccccaccctggcctgaaggtggccaccaaccccagctttgatggccgcctgaaggacattgatgaggacttcaagcgggagctgaggaacctggtgcccctgctgctggcccctgagaacctggtggagaaggagatcagcggcagcaaggtgacctgccgggacctggtggagtacttcaaggcctacatcaagatctaccagggcgaggagctgccccaccccaagtccatgctgcaggccacagctgaggccaacaacctggccgctgtggccggggcccgggacacctactgcaagtccatggagcaggtgtgtggcggggacaagccctacatcgcccccagcgacctggagaggaagcacctggacctgaaggaggtggccatcaagcagttccgctctgtgaagaagatgggaggagatgagttctgccgccgctaccaggaccagctggaggccgagattgaggagacctacgccaacttcatcaagcacaatgatggcaagaacatcttctacgccgcccggaccccagccaccctgtttgctgtgatgtttgccatgtacatcatcagcggcctgaccggcttcatcggcctgaacagcattgctgtgctgtgcaacctggtgatgggcctggccctgatcttcctgtgcacctgggcctacgtgaagtacagcggggagttccgggagattggaacagtgattgaccagattgctgagaccctgtgggagcaggtgctgaagcccctgggggacaacctgatggaggagaacatccggcagagcgtgaccaacagcatcaaggccggcctgacagaccaggtgagccaccacgcccggctgaagacagactag

SEQ ID NO: 144287 - DNA, 1740 bp, Artificial Sequence
  Description of Artificial Sequence: Synthetic coding sequence
atggccgagggagatgaagctgcccggggccagcagccccaccagggcctgtggaggagaagaaggaccagtgaccccagcgctgctgtgaaccacgtgagcagcaccaccagcctgggagaaaattatgaagatgatgacctggtgaacagtgatgaggtgatgaagaagccctgccctgtgcagatcgtgctggcccatgaagatgaccacaactttgagctggatgaggaggccctggagcagatcctgctgcaggagcacatccgggacctgaacatcgtggtggtgtctgtggccggggccttcaggaagggcaagagcttcctgctggacttcatgctgcgctacatgtacaacaaggacagccagagctggattggaggcaacaatgagcccctgaccggcttcacctggaggggcggctgtgagcgggagaccaccggcatccaggtgtggaatgaggtgtttgtgattgaccggcccaacggcaccaaggtggccgtgctgctgatggacacccagggcgcctttgacagccagagcaccatcaaggactgtgccaccgtgtttgccctgagcaccatgaccagctctgtgcaggtgtacaacctgagccagaacatccaggaggatgacctgcagcacctgcagctgttcacagaatatggccgcctggccatggaggagatctaccagaagcccttccagaccctgatgttcctgatccgggactggagctacccctatgagcacagctatggcctggagggcggcaagcagttcctggagaagaggctgcaggtgaagcagaaccagcacgaggagctgcagaatgtgaggaagcacatccacaactgcttcagcaacctgggctgcttcctgctgccccaccctggcctgaaggtggccaccaaccccagctttgatggccgcctgaaggacattgatgaggacttcaagcgggagctgaggaacctggtgcccctgctgctggcccctgagaacctggtggagaaggagatcagcggcagcaaggtgacctgccgggacctggtggagtacttcaaggcctacatcaagatctaccagggcgaggagctgccccaccccaagtccatgctgcaggccacagctgaggccaacaacctggccgctgtggccggggcccgggacacctactgcaagtccatggagcaggtgtgtggcggggacaagccctacatcgcccccagcgacctggagaggaagcacctggacctgaaggaggtggccatcaagcagttccgctctgtgaagaagatgggaggagatgagttctgccgccgctaccaggaccagctggaggccgagattgaggagacctacgccaacttcatcaagcacaatgatggcaagaacatcttctatgctgcccggaccccagccaccctgtttgctgtgatgtttgccatgtacatcatcagcggcctgaccggcttcatcggcctgaacagcattgctgtgctgtgcaacctggtgatgggcctggccctgatcttcctgtgcacctgggcctacgtgaagtacagcggggagttccgggagatcggcaccgtcatcgaccagattgctgagaccctgtgggagcaggtgttcagcaagctgtttgaggtgaccaggaggaggatggtgcaccgggccctgagcagcgcccagaggcagaggctgagcagcaacaacaacaagaagaagaactag

SEQ ID NO: 144288 - DNA, 1239 bp, Artificial Sequence; identical to SEQ ID NO: 144286
  Description of Artificial Sequence: Synthetic coding sequence

SEQ ID NO: 144289 - DNA, 1242 bp, Artificial Sequence
  Description of Artificial Sequence: Synthetic coding sequence
atggacacccagggcgcctttgacagccagagcaccatcaaggactgtgccaccgtgtttgccctgagcaccatgaccagctctgtgcaggtgtacaacctgagccagaacatccaggaggatgacctgcagcacctgcagctgttcacagaatatggccgcctggccatggaggagatctaccagaagcccttccagaccctgatgttcctgatccgggactggagctacccctatgagcacagctatggcctggagggcggcaagcagttcctggagaagaggctgcaggtgaagcagaaccagcacgaggagctgcagaatgtgaggaagcacatccacaactgcttcagcaacctgggctgcttcctgctgccccaccctggcctgaaggtggccaccaaccccagctttgatggccgcctgaaggacattgatgaggacttcaagcgggagctgaggaacctggtgcccctgctgctggcccctgagaacctggtggagaaggagatcagcggcagcaaggtgacctgccgggacctggtggagtacttcaaggcctacatcaagatctaccagggcgaggagctgccccaccccaagtccatgctgcaggccacagctgaggccaacaacctggccgctgtggccggggcccgggacacctactgcaagtccatggagcaggtgtgtggcggggacaagccctacatcgcccccagcgacctggagaggaagcacctggacctgaaggaggtggccatcaagcagttccgctctgtgaagaagatgggaggagatgagttctgccgccgctaccaggaccagctggaggccgagattgaggagacctacgccaacttcatcaagcacaatgatggcaagaacatcttctacgccgcccggaccccagccaccctgtttgctgtgatgtttgccatgtacatcatcagcggcctgaccggcttcatcggcctgaacagcattgctgtgctgtgcaacctggtgatgggcctggccctgatcttcctgtgcacctgggcctacgtgaagtacagcggggagttccgggagattggaacagtgattgaccagattgctgagaccctgtgggagcagaggagccccaggaaggtgttcagcaagctgtttgaggtgaccaggaggaggatggtgcaccgggccctgagcagcgcccagaggcagaggctgagcagcaacaacaacaagaagaagaactag

SEQ ID NO: 144290 - DNA, 1707 bp, Artificial Sequence
  Description of Artificial Sequence: Synthetic coding sequence
atgaggacagctggccgggaccctgtgtctgctggcctgcagttccccaaggatggcagcacccagaggcctgccaacagagccaggtttgtgcctgcccggacccggcccagccccctgcacccctgctgcttctgctttgaaggaggcggctccatgctgagcccccagagggtggccgccgccgccagcagaggagcagatgatgccatggagagcagcaacatcctgctgcaggaccacatccgggacctggatgtggtggtggtgtctgtggccggggccttcaggaagggcaagagcttcatcctggacttcatgctgcgctacctgtacagccagaaggagagcggccacagcaactggctgggggaccctgaggagcccctgaccggcttctcctggaggggcggcagtgaccctgagaccaccggcatccagatctggagcgaggtgttcaccgtggagaagccaggcggcaagaaggtggccgtggtgctgatggacacccagggcgcctttgacagccagagcacagtgaaggactgtgccaccatctttgccctgagcaccatgaccagctctgtgcagatctacaacctgagccagaacatccaggaggatgacctgcagcagctgcagctgttcacagaatatggccgcctggccatggatgagatcttccagaagcccttccagaccctgatgttcctggtgcgggactggagcttcccctatgagtacagctatggcctgcagggcggcatggccttcctggacaagaggctgcaggtgaaggagcaccagcacgaggagatccagaatgtgaggaaccacatccacagctgcttcagtgatgtgacctgcttcctgctgccccaccctggcctgcaggtggccaccagcccagactttgatggcaagctgaaggacattgctggggagttcaaggagcagctgcaggccctgatcccctacgtgctgaaccccagcaagctgatggagaaggagatcaatggcagcaaggtgacctgccggggcctgctggagtacttcaaggcctacatcaagatctaccagggcgaggacctgccccaccccaagtccatgctgcaggccacagctgaggccaacaacctggccgctgctgccagcgccaaggacatctactacaacaacatggaggaggtgtgtggcggggagaagccctacctgagcccagacatcctggaggagaagcactgtgagttcaagcagctggccctggaccacttcaagaagaccaagaagatgggcggcaaggacttctccttccgctaccagcaggagctggaggaggagatcaaggagctgtatgagaacttctgcaagcacaacggcagcaagaatgtgttcagcaccttccgcaccccagctgtgctcttcaccggcatcgtggccctgtacatcgccagcggcctgaccggcttcatcggcctggaggtggtggcccagctgttcaactgcatggtgggcctgctgctgattgccctgctgacctggggctacatccgctacagcggccagtaccgggagctgggcggggccatcgactttggagctgcctacgtgctggagcaggccagcagccacatcggcaacagcacccaggccaccgtgagagatgctgtggtgggccggcccagcatggacaagaaggcccagtag

SEQ ID NO: 144291 - DNA, 1626 bp, Artificial Sequence
  Description of Artificial Sequence: Synthetic coding sequence
atgctgagcccccagagggtggccgccgccgccagcagaggagcagatgatgccatggagagcagcaagccaggccctgtgcaggtggtgctggtgcagaaggaccagcacagctttgagctggatgagaaggccctggccagcatcctgctgcaggaccacatccgggacctggatgtggtggtggtgtctgtggccggggccttcaggaagggcaagagcttcatcctggacttcatgctgcgctacctgtacagccagaaggagagcggccacagcaactggctgggggaccctgaggagcccctgaccggcttctcctggaggggcggcagtgaccctgagaccaccggcatccagatctggagcgaggtgttcaccgtggagaagccaggcggcaagaaggtggccgtggtgctgatggacacccagggcgcctttgacagccagagcacagtgaaggactgtgccaccatctttgccctgagcaccatgaccagctctgtgcagatctacaacctgagccagaacatccaggaggatgacctgcagcagctgcagctgttcacagaatatggccgcctggccatggatgagatcttccagaagcccttccagaccctgatgttcctggtgcgggactggagcttcccctatgagtacagctatggcctgcagggcggcatggccttcctggacaagaggctgcaggtgaaggagcaccagcacgaggagatccagaatgtgaggaaccacatccacagctgcttcagtgatgtgacctgcttcctgctgccccaccctggcctgcaggtggccaccagcccagactttgatggcaagctgaaggacattgctggggagttcaaggagcagctgcaggccctgatcccctacgtgctgaaccccagcaagctgatggagaaggagatcaatggcagcaaggtgacctgccggggcctgctggagtacttcaaggcctacatcaagatctaccagggcgaggacctgccccaccccaagtccatgctgcaggccacagctgaggccaacaacctggccgccgccgccagcgccaaggacatctactacaacaacatggaggaggtgtgtggcggggagaagccctacctgagcccagacatcctggaggagaagcactgtgagttcaagcagctggccctggaccacttcaagaagaccaagaagatgggcggcaaggacttctccttccgctaccagcaggagctggaggaggagatcaaggagctgtatgagaacttctgcaagcacaacggcagcaagaatgtgttcagcaccttccgcaccccagctgtgctcttcaccggcatcgtggccctgtacatcgccagcggcctgaccggcttcatcggcctggaggtggtggcccagctgttcaactgcatggtgggcctgctgctgattgccctgctgacctggggctacatccgctacagcggccagtaccgggagctgggcggggccatcgactttggagctgcctacgtgctggagcaggccagcagccacatcggcaacagcacccaggccaccgtgagagatgctgtggtgggccggcccagcatggacaagaaggcccagtag

SEQ ID NO: 144292 - DNA, 1065 bp, Artificial Sequence
  Description of Artificial Sequence: Synthetic coding sequence
atgagccggctgctgcatgctgaggagtgggccgaggtgaaggagctgggggaccaccaccggcagccccagccccaccacctgccccagcccccacctccaccccagcccccagccaccctgcaggcccgggagcaccctgtgtacccacctgagctgagcctgctggacagcacagacccccgggcctggctggcccccaccctgcagggcatctgcacagcccgggccgcccagtacctgctgcacagccctgagctgggcgccagcgaggccgccgcccccagagatgaggtggatggccgcggggagctggtgagaagaagcagcggcggggccagcagcagcaagagccctggccctgtgaaggtgcgggagcagctgtgcaagctgaagggcggcgtggtggtggatgagctgggctgcagccggcagagggcccccagcagcaagcaggtgaatggagtgcagaagcagaggcggctggccgccaatgcccgggagaggaggaggatgcacggcctgaaccacgcctttgaccagctgagaaatgtcatccccagcttcaacaatgacaagaagctgagcaaatatgagaccctgcagatggcccagatctacatcaatgccctgtctgagctgctgcagaccccatctggaggagagcagcccccacctcctccagccagctgcaagagtgaccaccaccacctgaggacagctgccagctatgagggcggcgctggaaatgccacagctgctggggcccagcaggccagcggcggcagccagaggcccaccccacctggcagctgcaggacccgcttcagcgccccagccagcgctgggggctacagcgtgcagctggatgccctgcacttcagcacctttgaggacagcgccctgacagccatgatggcccagaagaacctgagccccagcctgcccggcagcatcctgcagcctgtgcaggaggagaacagcaagaccagccccaggagccacagaagtgatggagagttcagcccccacagccactacagcgacagtgatgaggccagctag

SEQ ID NO: 144293 - DNA, 459 bp, Artificial Sequence
  Description of Artificial Sequence: Synthetic coding sequence
atgaagagctgcaagcccagcggccccccagctggggcccgggtggccccaccctgtgccggcggcacagaatgtgccggcacctgtgccggggccggccgcctggagagcgctgcccggcggcggctggccgccaatgcccgggagaggaggaggatgcagggcctgaacacagcctttgaccggctgcggcgggtggtgccccagtggggccaggacaagaagctgagcaaatatgagaccctgcagatggccctgagctacatcatggccctgacccgcatcctggccgaggccgagcgcttcggcagcgagcgggactgggtgggcctgcactgtgagcacttcggccgggaccactacctgcccttccctggggccaagctgcccggggagagcgagctgtacagccagaggctgtttggcttccagcctgagcccttccagatggccacctag

SEQ ID NO: 144294 - DNA, 627 bp, Artificial Sequence
  Description of Artificial Sequence: Synthetic coding sequence
atgtggaggagctgcctgcggctgagagatggcggccgccgcctgctgaacagacctgctgggggccccagcgcctccatgagccctggccccaccatccccagccctgcccgggcctatgccccacccacagagaggaagcgcttctaccagaatgtgtccatcacccagggcgagggcggctttgagatcaacctggaccacaggaagctgaagaccccccaggccaagctgttcaccgtgcccagcgaggccctggccatcgctgtggccacagagtgggacagccagcaggacaccatcaagtactacaccatgcacctgaccaccctgtgcaacaccagcctggacaaccccacccagaggaacaaggaccagctgatccgggctgctgtgaagttcctggacacagacaccatctgctacagagtggaggagcctgagaccctggtggagctgcagagaaatgagtgggaccccatcatcgagtgggccgagaagagatatggagtggagatcagcagcagcaccagcatcatgggccccagcatcccagccaagacccgggaggtgctggtgagccacctggccagctacaacacctgggccctgcagggcatggactag

SEQ ID NO: 144295 - DNA, 618 bp, Artificial Sequence
  Description of Artificial Sequence: Synthetic coding sequence
atgtggaggagctgcctgcggctgagagatggcggccgccgcctgctgaacagacctgctgggggccccagcgcctccatgagccctggccccaccatccccagccctgcccgggcctatgccccacccacagagaggaagcgcttctaccagaatgtgtccatcacccagggcgagggcggctttgagatcaacctggaccacaggaagctgaagaccccccaggccaagctgttcaccgtgcccagcgaggccctggccatcgctgtggccacagagtgggacagccagcaggacaccatcaagtactacaccatgcacctgaccaccctgtgcaacaccagcctggacaaccccacccagaggaacaaggaccagctgatccgggctgctgtgaagttcctggacacagacaccatctgctacagagtggaggagcctgagaccctggtggagctgcagagaaatgagtgggaccccatcatcgagtgggccgagaagagatatggagtggagatcagcagcagcaccagcatcatgggccccagcatcccagccaagacccgggaggtgctggtgagccacctggccagctacaacacctgggccctgcagtag

SEQ ID NO: 144296 - DNA, 870 bp, Artificial Sequence
  Description of Artificial Sequence: Synthetic coding sequence
atgtggaggagctgcctgcggctgagagatggcggccgccgcctgctgaacagacctgctgggggccccagcgcctccatgagccctggccccaccatccccagccctgcccgggcctatgccccacccacagagaggaagcgcttctaccagaatgtgtccatcacccagggcgagggcggctttgagatcaacctggaccacaggaagctgaagaccccccaggccaagctgttcaccgtgcccagcgaggccctggccatcgctgtggccacagagtgggacagccagcaggacaccatcaagtactacaccatgcacctgaccaccctgtgcaacaccagcctggacaaccccacccagaggaacaaggaccagctgatccgggctgctgtgaagttcctggacacagacaccatctgctacagagtggaggagcctgagaccctggtggagctgcagagaaatgagtgggaccccatcatcgagtgggccgagaagagatatggagtggagatcagcagcagcaccagcatcatgggccccagcatcccagccaagacccgggaggtgctggtgagccacctggccagctacaacacctgggccctgcagggcattgaatttgtggccgcccagctgaagtccatggtgctgaccctgggcctgattgacctgcggctgactgtggagcaggccgtgctgctgagccggctggaggaggagtaccagatccagaagtggggcaacatcgagtgggcccatgactatgagctgcaggagctgcgggccaggacagctgctggcaccctcttcatccacctgtgcagcgagagcaccaccgtgaagcacaagctgctgaaggagtag

SEQ ID NO: 144297 - DNA, 1590 bp, Artificial Sequence
  Description of Artificial Sequence: Synthetic coding sequence
atgctgggctttgtgggccgggtggccgccgccccagccagcggggccctgcggcggctgaccccatctgccagcctgcccccagcccagctgctgctgcgggccgcccccacagctgtgcaccctgtgcgggactatgctgcccagaccagccccagccccaaggccggggccgccaccggcagaattgtggccgtgattggagctgtggtggatgtgcagtttgatgagggcctgccccccatcctgaatgccctggaggtgcagggccgggagacccggctggtgctggaggtggcccagcacctgggggagagcacagtgaggaccatcgccatggatggaacagagggcctggtgcggggccagaaggtgctggacagcggggcccccatcaagatccctgtgggccctgagaccctgggccgcatcatgaatgtcatcggggagcccattgatgagcggggccccatcaagaccaagcagtttgcccccatccacgccgaggcccctgagttcatggagatgtctgtggagcaggagatcctggtgacaggcatcaaggtggtggacctgctggccccctatgccaagggcggcaagattggcctgtttggaggagctggggtgggcaagacagtgctgatcatggagctgatcaacaacgtggccaaggcccatggaggctacagcgtgtttgctggggtgggggagaggacccgggagggcaatgacctgtaccacgagatgattgaaagtggagtcatcaacctgaaggatgccaccagcaaggtggccctggtgtatggccagatgaatgaacctcctggggcccgggcccgggtggccctgaccggcctgactgtggccgagtacttccgggaccaggagggccaggatgtgctgctcttcatcgacaacatcttccgcttcacccaggccggcagcgaggtgtctgccctgctgggccgcatccccagcgctgtgggctaccagcccaccctggccacagacatgggcaccatgcaggagcgcatcaccaccaccaagaagggcagcatcacctctgtgcaggccatctacgtgcctgcagatgacctgacagatcctgccccagccaccacctttgcccacctggatgccaccaccgtgctgagccgggccatcgccgagctgggcatctacccagctgtggaccccctggacagcaccagccgcatcatggaccccaacatcgtgggcagcgagcactatgatgtggcccggggcgtgcagaagatcctgcaggactacaagagcctgcaggacatcatcgccatcctgggcatggatgagctgtctgaggaggacaagctgactgtgtcccgggccaggaagatccagcgcttcctgagccagcccttccaggtggccgaggtgttcaccggccacatgggcaagctggtgcccctgaaggagaccatcaagggcttccagcagatcctggccggggagtatgaccacctgcctgagcaggccttctacatggtgggccccatcgaggaggccgtggccaaggctgacaagctggccgaggagcacagcagctag

SEQ ID NO: 144298 - DNA, 156 bp, Artificial Sequence
  Description of Artificial Sequence: Synthetic coding sequence
atggtggcctactggaggcaggccggcctgagctacatccgctacagccagatctgtgccaaggctgtgagagatgccctgaagacagagttcaaggccaatgctgagaagaccagcggcagcaatgtgaagatcgtgaaggtgaagaaggagtag

SEQ ID NO: 144299 - DNA, 156 bp, Artificial Sequence; identical to SEQ ID NO: 144298
  Description of Artificial Sequence: Synthetic coding sequence

SEQ ID NO: 144300 - DNA, 156 bp, Artificial Sequence; identical to SEQ ID NO: 144298
  Description of Artificial Sequence: Synthetic coding sequence

SEQ ID NO: 144301 - DNA, 894 bp, Artificial Sequence
  Description of Artificial Sequence: Synthetic coding sequence
atgttcagcagagctggggtggccggcctgagcgcctggaccctgcagccccagtggatccaggtgaggaacatggccaccctgaaggacatcacccggcggctgaagagcatcaagaacatccagaagatcaccaagtccatgaagatggtggccgccgccaagtatgcccgggcagagcgggagctgaagccagcccgcatctacggcctgggcagcctggccctgtatgagaaggctgacatcaagggccctgaggacaagaagaagcacctgctgattggagtgtccagtgaccggggcctgtgtggggccatccacagcagcatcgccaagcagatgaagtctgaggtggccaccctgacagctgctgggaaggaggtgatgctggtgggcattggagacaagatccggggcatcctgtaccgcacccacagcgaccagttcctggtggccttcaaggaggtgggcaggaagccacccacctttggagatgcctctgtgattgccctggagctgctgaacagcggctatgaatttgatgagggcagcatcatcttcaacaagttccgcagcgtcatctcctacaagacagaggagaagcccatcttcagcctgaacacagtggccagcgctgacagcatgagcatctatgatgacattgatgctgatgtgctgcagaactaccaggagtacaacctggccaacatcatctactacagcctgaaggagagcaccaccagcgagcagagcgccaggatgacagccatggacaatgccagcaagaatgccagcgagatgattgacaagctgaccctgaccttcaacagaacccggcaggccgtcatcaccaaggagctgattgagatcatcagcggggctgctgccctgtag

SEQ ID NO: 144302 - DNA, 897 bp, Artificial Sequence
  Description of Artificial Sequence: Synthetic coding sequence
atgttcagcagagctggggtggccggcctgagcgcctggaccctgcagccccagtggatccaggtgaggaacatggccaccctgaaggacatcacccggcggctgaagagcatcaagaacatccagaagatcaccaagtccatgaagatggtggccgccgccaagtatgcccgggcagagcgggagctgaagccagcccgcatctacggcctgggcagcctggccctgtatgagaaggctgacatcaagggccctgaggacaagaagaagcacctgctgattggagtgtccagtgaccggggcctgtgtggggccatccacagcagcatcgccaagcagatgaagtctgaggtggccaccctgacagctgctgggaaggaggtgatgctggtgggcattggagacaagatccggggcatcctgtaccgcacccacagcgaccagttcctggtggccttcaaggaggtgggcaggaagccacccacctttggagatgcctctgtgattgccctggagctgctgaacagcggctatgaatttgatgagggcagcatcatcttcaacaagttccgcagcgtcatctcctacaagacagaggagaagcccatcttcagcctgaacacagtggccagcgctgacagcatgagcatctatgatgacattgatgctgatgtgctgcagaactaccaggagtacaacctggccaacatcatctactacagcctgaaggagagcaccaccagcgagcagagcgccaggatgacagccatggacaatgccagcaagaatgccagcgagatgattgacaagctgaccctgaccttcaacagaacccggcaggccgtcatcaccaaggagctgattgagatcatcagcggggctgctgccctggactag

SEQ ID NO: 144303 - DNA, 753 bp, Artificial Sequence
  Description of Artificial Sequence: Synthetic coding sequence
atgaagatggtggccgccgccaagtatgcccgggcagagcgggagctgaagccagcccgcatctacggcctgggcagcctggccctgtatgagaaggctgacatcaagggccctgaggacaagaagaagcacctgctgattggagtgtccagtgaccggggcctgtgtggggccatccacagcagcatcgccaagcagatgaagtctgaggtggccaccctgacagctgctgggaaggaggtgatgctggtgggcatcggggacaagatccggggcatcctgtaccgcacccacagcgaccagttcctggtggccttcaaggaggtgggcaggaagccacccacctttggagatgccagcgtcatcgccctggagctgctgaacagcggctatgaatttgatgagggcagcatcatcttcaacaagttccgcagcgtcatctcctacaagacagaggagaagcccatcttcagcctgaacacagtggccagcgctgacagcatgagcatctatgatgacattgatgctgatgtgctgcagaactaccaggagtacaacctggccaacatcatctactacagcctgaaggagagcaccaccagcgagcagagcgccaggatgacagccatggacaatgccagcaagaatgccagcgagatgattgacaagctgaccctgaccttcaacagaacccggcaggccgtcatcaccaaggagctgattgagatcatctctggagctgctgccctgtag

SEQ ID NO: 144304 - DNA, 642 bp, Artificial Sequence
  Description of Artificial Sequence: Synthetic coding sequence
atggccgccccagctgtgtctggcctgagccggcaggtgcgctgcttcagcacctctgtggtgcggccctttgccaagctggtgcggccccctgtgcaggtgtatggaattgagggccgctatgccacagccctgtacagcgctgccagcaagcagaacaagctggagcaggtggagaaggagctgctgcgggtggcccagatcctgaaggagcccaaggtggccgcctctgtgctgaacccctacgtgaagaggagcatcaaggtgaagagcctgaatgacatcacagccaaggagcgcttcagccccctgaccaccaacctgatcaacctgctggccgagaatggccgcctgagcaacacccagggcgtggtgtctgccttcagcaccatgatgtctgtgcacagaggagaggtgccctgcaccgtgaccagcgccagccccctggaggaggccaccctgtctgagctgaagacagtgctgaagagcttcctgagccagggccaggtgctgaagctggaggccaagacagaccccagcatcctgggcggcatgattgtgagaattggagagaagtatgtggacatgtctgtgaagaccaagatccagaagctgggccgggccatgagggagatcgtgtag

SEQ ID NO: 144305 - DNA, 411 bp, Artificial Sequence
  Description of Artificial Sequence: Synthetic coding sequence
atgcagacagctggggccctcttcatcagccctgccctgatccgctgctgcacccggggcctcatccggcctgtgtctgccagcttcctgaacagccctgtgaacagcagcaagcagcccagctacagcaacttccccctgcaggtggcccggcgggagttccagacctctgtggtgtcccgggacatcgacacagctgccaagttcatcggggccggggccgccaccgtgggcgtggccggcagcggggccggcatcggcaccgtgtttggcagcctcatcatcggctacgccaggaaccccagcctgaagcagcagctgttctcctatgccatcctgggctttgccctgtctgaggccatgggcctcttctgcctgatggtggccttcctgatcctgtttgccatgtag

SEQ ID NO: 144306 - DNA, 411 bp, Artificial Sequence; identical to SEQ ID NO: 144305
  Description of Artificial Sequence: Synthetic coding sequence

SEQ ID NO: 144307 - DNA, 474 bp, Artificial Sequence
  Description of Artificial Sequence: Synthetic coding sequence
atgcctgagctgatcctgagccctgccacagccccccaccccctgaagatgtttgcctgcagcaagtttgtgtccacccccagcctggtgaagagcaccagccagctgctgagccggcccctgtctgctgtggtgctgaagaggcctgagatcctgacagatgagagcctgagcagcctggccgtgtcctgccccctgaccagcctggtgagcagccgctccttccagaccagcgccatcagccgggacatcgacacagctgccaagttcatcggggccggggccgccaccgtgggcgtggccggcagcggggccggcattggaacagtgtttggcagcctcatcatcggctacgccaggaaccccagcctgaagcagcagctgttctcctatgccatcctgggctttgccctgtctgaggccatgggcctcttctgcctgatggtggccttcctgatcctgtttgccatgtag

SEQ ID NO: 144308 - DNA, 597 bp, Artificial Sequence
  Description of Artificial Sequence: Synthetic coding sequence
atgcctgagctgatcctgtatgtggccatcaccctgtctgtggccgagcggctggtgggccctggccacgcctgtgccgagcccagcttccgcagcagccgctgcagcgcccccctgtgcctgctgtgcagcggcagcagcagccctgccacagccccccaccccctgaagatgtttgcctgcagcaagtttgtgtccacccccagcctggtgaagagcaccagccagctgctgagccggcccctgtctgctgtggtgctgaagaggcctgagatcctgacagatgagagcctgagcagcctggccgtgtcctgccccctgaccagcctggtgagcagccgctccttccagaccagcgccatcagccgggacatcgacacagctgccaagttcatcggggccggggccgccaccgtgggcgtggccggcagcggggccggcatcggcaccgtgtttggcagcctcatcatcggctacgccaggaaccccagcctgaagcagcagctgttctcctatgccatcctgggctttgccctgtctgaggccatgggcctcttctgcctgatggtggccttcctgatcctgtttgccatgtag

SEQ ID NO: 144309 - DNA, 426 bp, Artificial Sequence
  Description of Artificial Sequence: Synthetic coding sequence
atgtttgcctgcagcaagtttgtgtccacccccagcctggtgaagagcaccagccagctgctgagccggcccctgtctgctgtggtgctgaagaggcctgagatcctgacagatgagagcctgagcagcctggccgtgtcctgccccctgaccagcctggtgagcagccgctccttccagaccagcgccatcagccgggacatcgacacagctgccaagttcatcggggccggggccgccaccgtgggcgtggccggcagcggggccggcattggaacagtgtttggcagcctcatcatcggctacgccaggaaccccagcctgaagcagcagctgttctcctatgccatcctgggctttgccctgtctgaggccatgggcctcttctgcctgatggtggccttcctgatcctgtttgccatgtag

SEQ ID NO: 144310 - DNA, 429 bp, Artificial Sequence
  Description of Artificial Sequence: Synthetic coding sequence
atgtttgcctgtgccaagctggcctgcacccccagcctcatccgggccggcagccgggtggcctaccggcccatcagcgcctctgtgctgagcaggcctgaggccagcaggactggagagggcagcacagtgttcaacggggcccagaatggagtgtcccagctgatccagcgggagttccagaccagcgccatcagccgggacatcgacacagctgccaagttcatcggggccggggccgccaccgtgggcgtggccggcagcggggccggcatcggcaccgtgtttggcagcctcatcatcggctacgccaggaaccccagcctgaagcagcagctgttctcctatgccatcctgggctttgccctgtctgaggccatgggcctcttctgcctgatggtggccttcctgatcctgtttgccatgtag

SEQ ID NO: 144311 - DNA, 429 bp, Artificial Sequence; identical to SEQ ID NO: 144310
  Description of Artificial Sequence: Synthetic coding sequence

SEQ ID NO: 144312 - DNA, 429 bp, Artificial Sequence; identical to SEQ ID NO: 144310
  Description of Artificial Sequence: Synthetic coding sequence

SEQ ID NO: 144313 - DNA, 210 bp, Artificial Sequence
  Description of Artificial Sequence: Synthetic coding sequence
atggtgccccctgtgcaggtgagccccctcatcaagctgggccgctacagcgccctcttcctgggcgtggcctatggagccacccgctacaactacctgaagcccagggctgaggaggagaggagaattgctgctgaggagaagaagaagcaggatgagctgaagagaattgcccgggagctggctgaagatgacagcatcctgaagtag

SEQ ID NO: 144314 - DNA, 327 bp, Artificial Sequence
  Description of Artificial Sequence: Synthetic coding sequence
atgatcctgcagaggctcttccgcttcagcagcgtcatccgctctgctgtgtctgtgcacctgcggagaaatattggagtgacagctgtggccttcaacaaggagctggaccccatccagaagctgtttgtggacaagatccgggagtacaagagcaagaggcagaccagcggcggccctgtggatgccagcagcgagtaccagcaggagctggagcgggagctgttcaagctgaagcagatgtttggaaatgctgacatgaacaccttccccaccttcaagtttgaggaccccaagtttgaggtgattgagaagccccaggcctag

SEQ ID NO: 144315 - DNA, 327 bp, Artificial Sequence; identical to SEQ ID NO: 144314
  Description of Artificial Sequence: Synthetic coding sequence

SEQ ID NO: 144316 - DNA, 327 bp, Artificial Sequence; identical to SEQ ID NO: 144314
  Description of Artificial Sequence: Synthetic coding sequence

SEQ ID NO: 144317 - DNA, 327 bp, Artificial Sequence; identical to SEQ ID NO: 144314
  Description of Artificial Sequence: Synthetic coding sequence

SEQ ID NO: 144318 - DNA, 327 bp, Artificial Sequence; identical to SEQ ID NO: 144314
  Description of Artificial Sequence: Synthetic coding sequence

SEQ ID NO: 144319 - DNA, 351 bp, Artificial Sequence
  Description of Artificial Sequence: Synthetic coding sequence
atgcactgtgatggcggcatctccatgatcctgcagaggctcttccgcttcagcagcgtcatccgctctgctgtgtctgtgcacctgcggagaaatattggagtgacagctgtggccttcaacaaggagctggaccccatccagaagctgtttgtggacaagatccgggagtacaagagcaagaggcagaccagcggcggccctgtggatgccagcagcgagtaccagcaggagctggagcgggagctgttcaagctgaagcagatgtttggaaatgctgacatgaacaccttccccaccttcaagtttgaggaccccaagtttgaggtgattgagaagccccaggcctag

SEQ ID NO: 144320 - DNA, 567 bp, Artificial Sequence
  Description of Artificial Sequence: Synthetic coding sequence
atgacagccaagggcagcacaggcatggagatcctgctgagcaccctggagaacaccaaggacctgcagaccaccctgaacatcctgagcatcctggtggagctggtgtctgctgggggcggccggcgggtgtccttcctggtgaccaagggcggcagccagatcctgctgcagctgctgatgaatgccagcaaggagagcccccctcatgaggacctgatggtgcagatccacagcatcctggccaagattggccccaaggacaagaagtttggagtgaaggcccgcatcaacggggccctgaacatcaccctgaacctggtgaagcagaacctgcagaaccaccggctggtgctgccctgcctgcagctgctgcgggtgtacagcgccaacagcgtgaacagcgtgtccctgggcaagaatggagtggtggagctgatgttcaagatcatcggccccttcagcaagaagaacagcagcctcatcaagaacaagtgccaggagagctgccggcagaggatctgccccagcgccttcaacaacctgtgccgcctggcccctccttag

SEQ ID NO: 144321 - DNA, 3681 bp, Artificial Sequence
  Description of Artificial Sequence: Synthetic coding sequence
atgagcaagctgaaggtgattcctgagaagagcctgaccaacaacagccgcatcgtgggcctgctggcccagctggagaagatcaatgctgagcccagcgagagtgacacagcccgctacgtgaccagcaagatcctgcacctggcccagagccaggagaagacccggcgggagatgacagccaagggcagcacaggcatggagatcctgctgagcaccctggagaacaccaaggacctgcagaccaccctgaacatcctgagcatcctggtggagctggtgtctgctgggggcggccggcgggtgtccttcctggtgaccaagggcggcagccagatcctgctgcagctgctgatgaatgccagcaaggagagcccccctcatgaggacctgatggtgcagatccacagcatcctggccaagattggccccaaggacaagaagtttggagtgaaggcccgcatcaacggggccctgaacatcaccctgaacctggtgaagcagaacctgcagaaccaccggctggtgctgccctgcctgcagctgctgcgggtgtacagcgccaacagcgtgaacagcgtgtccctgggcaagaatggagtggtggagctgatgttcaagatcatcggccccttcagcaagaagaacagcagcctcatcaaggtggccctggacaccctggccgccctgctgaagagcaagaccaatgcccggcgggctgtggaccggggctacgtgcaggtgctgctgaccatctacgtggactggcacagacatgacaacagacacaggaacatgctgatcaggaagggcatcctgcagagcctgaagtctgtgaccaacatcaagctgggcaggaaggccttcattgatgccaacggcatgaagatcctgtacaacaccagccaggagtgcctggccgtgaggaccctggaccccctggtgaacaccagcagcctcatcatgaggaagtgcttccccaagaaccggctgcccctgcccaccatcaagagcagcttccacttccagctgcctgtgattcctgtgacaggccctgtggcccagctgtacagcctgcccccagaggtggatgatgtggtggatgaaagtgatgacaatgatgacattgatgtggaggctgaaaatgaaacagaaaatgaagatgacctggaccagaacttcaagaatgatgacattgaaacagacatcaacaagctgaagccccagcaggagcccggccgcaccatcgaggacctgaagatgtatgagcacctgtttcctgagctggtggatgacttccaggactatgacctgatcagcaaggagcccaagccctttgtgtttgagggcaaggtgcggggccccatcgtggtgcccacagctggggaggagaccagcggcaacagcggcaacctgaggaaggtggtgatgaaggagaacatcagcagcaaaggagatgaaggagagaagaagagcaccttcatggacctggccaaggaggacatcaaggacaatgacaggaccctgcagcagcagcccggggaccagaacagaaccatcagctctgtgcacggcctgaacaatgacatcgtgaaggccctggaccgcatcaccctgcagaacatccccagccagacagcccctggcttcaccgctgagatgaagaaggactgcagcctgcccctgactgtgctgacctgtgccaaggcctgcccccacatggccacctgtggaaatgtgctgtttgagggccgcacagtgcagctgggcaagctgtgctgcacaggagtggagacagaagatgatgaggacacagagagcaacagctctgtggagcaggcctctgtggaggtgcctgatggccccaccctgcatgaccctgacctgtacattgaaattgtgaagaacaccaagtctgtgcctgagtacagcgaggtggcctacccagactacttcggccacatccccccacccttcaaggagcccatcctggagcggccctacggcgtgcagaggaccaagatcgcccaggacatcgagcggctcatccaccagagcgacatcatcgacagagtggtgtatgacctggacaaccccaactacaccatccctgaggagggggacatcctgaagttcaacagcaagtttgagagcggcaacctgaggaaggtgatccagatcaggaagaatgaatatgacctgatcctgaacagcgacatcaacagcaaccactaccaccagtggttctactttgaggtgtctggcatgaggcctggggtggcctaccgcttcaacatcatcaactgtgagaagagcaacagccagttcaactacggcatgcagcccctgatgtacagcgtgcaggaggccctgaatgcccggccctggtggatccgcatgggcacagacatctgctactacaagaaccacttcagccgcagctctgtggccgccggcggccagaagggcaagagctactacaccatcaccttcaccgtgaacttcccccacaaggatgatgtgtgctactttgcctaccactacccctacacctacagcaccctgcagatgcacctgcagaagctggagagcgcccacaacccccagcagatctacttcaggaaggatgtgctgtgtgagaccctgagcggcaacagctgccccctggtgaccatcacagccatgcctgagagcaactactatgagcacatctgccacttcaggaaccggccctacgtgttcctgagcgcccgggtgcaccctggagagaccaatgcctcctgggtgatgaagggcaccctggagtacctgatgagcaacaaccccacagcccagagcctgcgggagagctacatcttcaagatcgtgcccatgctgaacccagatggagtcatcaatggaaaccaccgctgcagcctgagcggggaggacctgaaccggcagtggcagagccccagcccagacctgcaccccaccatctaccacgccaagggcctgctgcagtacctggccgctgtgaagaggctgcccctggtgtactgtgactaccacggccacagcaggaagaagaatgtgttcatgtatggctgcagcatcaaggagaccgtgtggcacaccaatgacaatgccaccagctgtgatgtggtggaggacaccggctaccgcaccctgcccaagatcctgagccacatcgccccagccttctgcatgagcagctgcagctttgtggtggagaagagcaaggagagcacagcccgggtggtggtgtggagagaaattggagtgcagaggagctacaccatggagagcaccctgtgtggctgtgaccagggcaagtacaagggcctgcagatcggcacccgggagctggaggagatgggcgccaagttctgtgtgggcctgctgcggctgaagaggctgaccagccccctggagtacaacctgcccagcagcctgctggactttgaaaatgacctgattgagagcagctgcaaggtgaccagccccaccacctacgtgctggatgaagatgagccccgcttcctggaggaggtggactacagcgctgagagcaatgatgagctggacatcgagctggctgaaaatgtgggggactatgagcccagcgcccaggaggaggtgctgagtgacagcgagctgagcaggacctacctgccctag

SEQ ID NO: 144322 - DNA, 567 bp, Artificial Sequence; identical to SEQ ID NO: 144320
  Description of Artificial Sequence: Synthetic coding sequence

SEQ ID NO: 144323 - DNA, 714 bp, Artificial Sequence
  Description of Artificial Sequence: Synthetic coding sequence
atgagcaagctgaaggtgattcctgagaagagcctgaccaacaacagccgcatcgtgggcctgctggcccagctggagaagatcaatgctgagcccagcgagagtgacacagcccgctacgtgaccagcaagatcctgcacctggcccagagccaggagaagacccggcgggagatgacagccaagggcagcacaggcatggagatcctgctgagcaccctggagaacaccaaggacctgcagaccaccctgaacatcctgagcatcctggtggagctggtgtctgctgggggcggccggcgggtgtccttcctggtgaccaagggcggcagccagatcctgctgcagctgctgatgaatgccagcaaggagagcccccctcatgaggacctgatggtgcagatccacagcatcctggccaagattggccccaaggacaagaagtttggagtgaaggcccgcatcaacggggccctgaacatcaccctgaacctggtgaagcagaacctgcagaaccaccggctggtgctgccctgcctgcagctgctgcgggtgtacagcgccaacagcgtgaacagcgtgtccctgggcaagaatggagtggtggagctgatgttcaagatcatcggccccttcagcaagaagaacagcagcctcatcaagaatgtgtggcagagcggcctgtggatcctgctgagcatcccccctgtgtag

SEQ ID NO: 144324 - DNA, 3561 bp, Artificial Sequence
  Description of Artificial Sequence: Synthetic coding sequence
atgagcaagctgaaggtgattcctgagaagagcctgaccaacaacagccgcatcgtgggcctgctggcccagctggagaagatcaatgctgagcccagcgagagtgacacagcccgctacgtgaccagcaagatcctgcacctggcccagagccaggagaagacccggcgggagatgacagccaagggcagcacaggcatggagatcctgctgagcaccctggagaacaccaaggacctgcagaccaccctgaacatcctgagcatcctggtggagctggtgtctgctgggggcggccggcgggtgtccttcctggtgaccaagggcggcagccagatcctgctgcagctgctgatgaatgccagcaaggagagcccccctcatgaggacctgatggtgcagatccacagcatcctggccaagattggccccaaggacaagaagtttggagtgaaggcccgcatcaacggggccctgaacatcaccctgaacctggtgaagcagaacctgcagaaccaccggctggtgctgccctgcctgcagctgctgcgggtgtacagcgccaacagcgtgaacagcgtgtccctgggcaagaatggagtggtggagctgatgttcaagatcatcggccccttcagcaagaagaacagcagcctcatcaaggtggccctggacaccctggccgccctgctgaagagcaagaccaatgcccggcgggctgtggaccggggctacgtgcaggtgctgctgaccatctacgtggactggcacagacatgacaacagacacaggaacatgctgatcaggaagggcatcctgcagagcctgaagtctgtgaccaacatcaagctgggcaggaaggccttcattgatgccaacggcatgaagatcctgtacaacaccagccagctgcctgtgattcctgtgacaggccctgtggcccagctgtacagcctgcccccagaggtggatgatgtggtggatgaaagtgatgacaatgatgacattgatgtggaggctgaaaatgaaacagaaaatgaagatgacctggaccagaacttcaagaatgatgacattgaaacagacatcaacaagctgaagccccagcaggagcccggccgcaccatcgaggacctgaagatgtatgagcacctgtttcctgagctggtggatgacttccaggactatgacctgatcagcaaggagcccaagccctttgtgtttgagggcaaggtgcggggccccatcgtggtgcccacagctggggaggagaccagcggcaacagcggcaacctgaggaaggtggtgatgaaggagaacatcagcagcaaaggagatgaaggagagaagaagagcaccttcatggacctggccaaggaggacatcaaggacaatgacaggaccctgcagcagcagcccggggaccagaacagaaccatcagctctgtgcacggcctgaacaatgacatcgtgaaggccctggaccgcatcaccctgcagaacatccccagccagacagcccctggcttcaccgctgagatgaagaaggactgcagcctgcccctgactgtgctgacctgtgccaaggcctgcccccacatggccacctgtggaaatgtgctgtttgagggccgcacagtgcagctgggcaagctgtgctgcacaggagtggagacagaagatgatgaggacacagagagcaacagctctgtggagcaggcctctgtggaggtgcctgatggccccaccctgcatgaccctgacctgtacattgaaattgtgaagaacaccaagtctgtgcctgagtacagcgaggtggcctacccagactacttcggccacatccccccacccttcaaggagcccatcctggagcggccctacggcgtgcagaggaccaagatcgcccaggacatcgagcggctcatccaccagagcgacatcatcgacagagtggtgtatgacctggacaaccccaactacaccatccctgaggagggggacatcctgaagttcaacagcaagtttgagagcggcaacctgaggaaggtgatccagatcaggaagaatgaatatgacctgatcctgaacagcgacatcaacagcaaccactaccaccagtggttctactttgaggtgtctggcatgaggcctggggtggcctaccgcttcaacatcatcaactgtgagaagagcaacagccagttcaactacggcatgcagcccctgatgtacagcgtgcaggaggccctgaatgcccggccctggtggatccgcatgggcacagacatctgctactacaagaaccacttcagccgcagctctgtggccgccggcggccagaagggcaagagctactacaccatcaccttcaccgtgaacttcccccacaaggatgatgtgtgctactttgcctaccactacccctacacctacagcaccctgcagatgcacctgcagaagctggagagcgcccacaacccccagcagatctacttcaggaaggatgtgctgtgtgagaccctgagcggcaacagctgccccctggtgaccatcacagccatgcctgagagcaactactatgagcacatctgccacttcaggaaccggccctacgtgttcctgagcgcccgggtgcaccctggagagaccaatgcctcctgggtgatgaagggcaccctggagtacctgatgagcaacaaccccacagcccagagcctgcgggagagctacatcttcaagatcgtgcccatgctgaacccagatggagtcatcaatggaaaccaccgctgcagcctgagcggggaggacctgaaccggcagtggcagagccccagcccagacctgcaccccaccatctaccacgccaagggcctgctgcagtacctggccgctgtgaagaggctgcccctggtgtactgtgactaccacggccacagcaggaagaagaatgtgttcatgtatggctgcagcatcaaggagaccgtgtggcacaccaatgacaatgccaccagctgtgatgtggtggaggacaccggctaccgcaccctgcccaagatcctgagccacatcgccccagccttctgcatgagcagctgcagctttgtggtggagaagagcaaggagagcacagcccgggtggtggtgtggagagaaattggagtgcagaggagctacaccatggagagcaccctgtgtggctgtgaccagggcaagtacaagggcctgcagatcggcacccgggagctggaggagatgggcgccaagttctgtgtgggcctgctgcggctgaagaggctgaccagccccctggagtacaacctgcccagcagcctgctggactttgaaaatgacctgattgagagcagctgcaaggtgaccagccccaccacctacgtgctggatgaagatgagccccgcttcctggaggaggtggactacagcgctgagagcaatgatgagctggacatcgagctggctgaaaatgtgggggactatgagcccagcgcccaggaggaggtgctgagtgacagcgagctgagcaggacctacctgccctag

SEQ ID NO: 144325 - DNA, 3717 bp, Artificial Sequence
  Description of Artificial Sequence: Synthetic coding sequence
atgaggactggatctgctgccagcagcgctgctgctgctgctgctgctgctgctgccagcgccagccctgccactggagtgtgcatgaagacccctgggggcggccggcggggcatccggcgggaccctggagctgagcctggagctgctgccctgcggggcccccggcagaggcccatcctgagccggctgaccaacaacagccgcatcgtgggcctgctggcccagctggagaagatcaatgctgagcccagcgagagtgacacagcccgctacgtgaccagcaagatcctgcacctggcccagagccaggagaagacccggcgggagatgacagccaagggcagcacaggcatggagatcctgctgagcaccctggagaacaccaaggacctgcagaccaccctgaacatcctgagcatcctggtggagctggtgtctgctgggggcggccggcgggtgtccttcctggtgaccaagggcggcagccagatcctgctgcagctgctgatgaatgccagcaaggagagcccccctcatgaggacctgatggtgcagatccacagcatcctggccaagattggccccaaggacaagaagtttggagtgaaggcccgcatcaacggggccctgaacatcaccctgaacctggtgaagcagaacctgcagaaccaccggctggtgctgccctgcctgcagctgctgcgggtgtacagcgccaacagcgtgaacagcgtgtccctgggcaagaatggagtggtggagctgatgttcaagatcatcggccccttcagcaagaagaacagcagcctcatcaaggtggccctggacaccctggccgccctgctgaagagcaagaccaatgcccggcgggctgtggaccggggctacgtgcaggtgctgctgaccatctacgtggactggcacagacatgacaacagacacaggaacatgctgatcaggaagggcatcctgcagagcctgaagtctgtgaccaacatcaagctgggcaggaaggccttcattgatgccaacggcatgaagatcctgtacaacaccagccagctgcctgtgattcctgtgacaggccctgtggcccagctgtacagcctgcccccagaggtggatgatgtggtggatgaaagtgatgacaatgatgacattgatgtggaggctgaaaatgaaacagaaaatgaagatgacctggaccagaacttcaagaatgatgacattgaaacagacatcaacaagctgaagccccagcaggagcccggccgcaccatcgaggacctgaagatgtatgagcacctgtttcctgagctggtggatgacttccaggactatgacctgatcagcaaggagcccaagccctttgtgtttgagggcaaggtgcggggccccatcgtggtgcccacagctggggaggagaccagcggcaacagcggcaacctgaggaaggtggtgatgaaggagaacatcagcagcaaaggagatgaaggagagaagaagagcaccttcatggacctggccaaggaggacatcaaggacaatgacaggaccctgcagcagcagcccggggaccagaacagaaccatcagctctgtgcacggcctgaacaatgacatcgtgaaggccctggaccgcatcaccctgcagaacatccccagccagacagcccctggcttcaccgctgagatgaagaaggactgcagcctgcccctgactgtgctgacctgtgccaaggcctgcccccacatggccacctgtggaaatgtgctgtttgagggccgcacagtgcagctgggcaagctgtgctgcacaggagtggagacagaagatgatgaggacacagagagcaacagctctgtggagcaggcctctgtggaggtgcctgatggccccaccctgcatgaccctgacctgtacattgaaattgtgaagaacaccaagtctgtgcctgagtacagcgaggtggcctacccagactacttcggccacatccccccacccttcaaggagcccatcctggagcggccctacggcgtgcagaggaccaagatcgcccaggacatcgagcggctcatccaccagagcgacatcatcgacagagtggtgtatgacctggacaaccccaactacaccatccctgaggagggggacatcctgaagttcaacagcaagtttgagagcggcaacctgaggaaggtgatccagatcaggaagaatgaatatgacctgatcctgaacagcgacatcaacagcaaccactaccaccagtggttctactttgaggtgtctggcatgaggcctggggtggcctaccgcttcaacatcatcaactgtgagaagagcaacagccagttcaactacggcatgcagcccctgatgtacagcgtgcaggaggccctgaatgcccggccctggtggatccgcatgggcacagacatctgctactacaagaaccacttcagccgcagctctgtggccgccggcggccagaagggcaagagctactacaccatcaccttcaccgtgaacttcccccacaaggatgatgtgtgctactttgcctaccactacccctacacctacagcaccctgcagatgcacctgcagaagctggagagcgcccacaacccccagcagatctacttcaggaaggatgtgctgtgtgagaccctgagcggcaacagctgccccctggtgaccatcacagccatgcctgagagcaactactatgagcacatctgccacttcaggaaccggccctacgtgttcctgagcgcccgggtgcaccctggagagaccaatgcctcctgggtgatgaagggcaccctggagtacctgatgagcaacaaccccacagcccagagcctgcgggagagctacatcttcaagatcgtgcccatgctgaacccagatggagtcatcaatggaaaccaccgctgcagcctgagcggggaggacctgaaccggcagtggcagagccccagcccagacctgcaccccaccatctaccacgccaagggcctgctgcagtacctggccgctgtgaagaggctgcccctggtgtactgtgactaccacggccacagcaggaagaagaatgtgttcatgtatggctgcagcatcaaggagaccgtgtggcacaccaatgacaatgccaccagctgtgatgtggtggaggacaccggctaccgcaccctgcccaagatcctgagccacatcgccccagccttctgcatgagcagctgcagctttgtggtggagaagagcaaggagagcacagcccgggtggtggtgtggagagaaattggagtgcagaggagctacaccatggagagcaccctgtgtggctgtgaccagggcaagtacaagggcctgcagatcggcacccgggagctggaggagatgggcgccaagttctgtgtgggcctgctgcggctgaagaggctgaccagccccctggagtacaacctgcccagcagcctgctggactttgaaaatgacctgattgagagcagctgcaaggtgaccagccccaccacctacgtgctggatgaagatgagccccgcttcctggaggaggtggactacagcgctgagagcaatgatgagctggacatcgagctggctgaaaatgtgggggactatgagcccagcgcccaggaggaggtgctgagtgacagcgagctgagcaggacctacctgccctag

SEQ ID NO: 144326 - DNA, 1932 bp, Artificial Sequence
  Description of Artificial Sequence: Synthetic coding sequence
atgaatgccagcaaggagagcccccctcatgaggacctgatggtgcagatccacagcatcctggccaagattggccccaaggctgtgaacagcgtgtccctgggcaagaatggagtggtggagctgatgttcaagatcatcggccccttcagcaagaagaacagcagcctcatcaaggtggccctggacaccctggccgccctgctgaagagcaagaccaatgcccggcgggctgtggaccggggctacgtgcaggtgctgctgaccatctacgtggactggcacagacatgacaacagacacaggaacatgctgatcaggaagggcatcctgcagagcctgaagtctgtgaccaacatcaagctgggcaggaaggccttcattgatgccaacggcatgaagatcctgtacaacaccagccaggagtgcctggccgtgaggaccctggaccccctggtgaacaccagcagcctcatcatgaggaagtgcttccccaagaaccggctgcccctgcccaccatcaagagcagcttccacttccagctgcctgtgattcctgtgacaggccctgtggcccagctgtacagcctgcccccagaggtggatgatgtggtggatgaaagtgatgacaatgatgacattgatgtggaggctgaaaatgaaacagaaaatgaagatgacctggaccagaacttcaagaatgatgacattgaaacagacatcaacaagctgaagccccagcaggagcccggccgcaccatcgaggacctgaagatgtatgagcacctgtttcctgagctggtggatgacttccaggactatgacctgatcagcaaggagcccaagccctttgtgtttgagggcaaggtgcggggccccatcgtggtgcccacagctggggaggagaccagcggcaacagcggcaacctgaggaaggtggtgatgaaggagaacatcagcagcaaaggagatgaaggagagaagaagagcaccttcatggacctggccaaggaggacatcaaggacaatgacaggaccctgcagcagcagcccggggaccagaacagaaccatcagctctgtgcacggcctgaacaatgacatcgtgaaggccctggaccgcatcaccctgcagaacatccccagccagacagcccctggcttcaccgctgagatgaagaaggactgcagcctgcccctgactgtgctgacctgtgccaaggcctgcccccacatggccacctgtggaaatgtgctgtttgagggccgcacagtgcagctgggcaagctgtgctgcacaggagtggagacagaagatgatgaggacacagagagcaacagctctgtggagcaggcctctgtggaggtgcctgatggccccaccctgcatgaccctgacctgtacattgaaattgtgaagaacaccaagtctgtgcctgagtacagcgaggtggcctacccagactacttcggccacatccccccacccttcaaggagcccatcctggagcggccctacggcgtgcagaggaccaagatcgcccaggacatcgagcggctcatccaccagagcgacatcatcgacagagtggtgtatgacctggacaaccccaactacaccatccctgaggagggggacatcctgaagttcaacagcaagtttgagagcggcaacctgaggaaggtgatccagatcaggaagaatgaatatgacctgatcctgaacagcgacatcaacagcaaccactaccaccagtggttctactttgaggtgtctggcatgaggcctggggtggcctaccgcttcaacatcatcaactgtgagaagagcaacagccagttcaactatgccctgcccctgatgtcctggatgaagatgaacctggacagcctgaagaagctgatcaccgtgcagaaggtgatgatgtcctag

SEQ ID NO: 144327 - DNA, 1086 bp, Artificial Sequence
  Description of Artificial Sequence: Synthetic coding sequence
atggtgcacgccgaggccttcagccggcccctgagcagaaatgaggtggtgggcctcatcttccggctgaccatctttggagctgtgacctacttcaccatcaagtggatggtggatgccatcgaccccaccaggaagcagaaggtggaggcccagaagcaggccgagaagctgatgaagcagatcggcgtgaagaatgtgaagctgtctgaatatgagatgagcattgctgcccacctggtggaccccctgaacatgcacgtgacctggagcgacattgctggcctggatgatgtgatcacagacctgaaggacaccgtcatcctgcccatcaagaagaagcacctgtttgagaacagccggctgctgcagccccccaagggcgtgctgctgtatggccccccaggctgcggcaagaccctcatcgccaaggccacagccaaggaggccggctgccgcttcatcaacctgcagcccagcaccctgacagacaagtggtatggagagagccagaagctggccgctgctgtgttcagcctggccatcaagctgcagcccagcatcatcttcattgatgaaattgacagcttcctgaggaacagaagcagcagtgaccacgaggccacagccatgatgaaggcccagttcatgagcctgtgggatggcctggacacagaccacagctgccaggtgattgtgatgggcgccaccaaccggccccaggacctggacagcgccatcatgaggaggatgcccacccgcttccacatcaaccagcctgccctgaagcagcgggaggccatcctgaagctgatcctgaagaatgaaaatgtggacagacatgtggacctgctggaggtggcccaggagacagatggcttcagcggcagtgacctgaaggagatgtgcagagatgctgccctgctgtgtgtgcgggagtatgtgaacagcaccagcgaggagagccatgatgaagatgagatccggcctgtgcagcagcaggacctgcaccgggccatcgagaagatgaagaagagcaaggatgctgccttccagaatgtgctgacccacgtgtgcctggactag

SEQ ID NO: 144328 - DNA, 1086 bp, Artificial Sequence; identical to SEQ ID NO: 144327
  Description of Artificial Sequence: Synthetic coding sequence

SEQ ID NO: 144329 - DNA, 822 bp, Artificial Sequence
  Description of Artificial Sequence: Synthetic coding sequence
atgaagcagatcggcgtgaagaatgtgaagctgtctgaatatgagatgagcattgctgcccacctggtggaccccctgaacatgcacgtgacctggagcgacattgctggcctggatgatgtgatcacagacctgaaggacaccgtcatcctgcccatcaagaagaagcacctgtttgagaacagccggctgctgcagccccccaagggcgtgctgctgtatggccccccaggctgcggcaagaccctcatcgccaaggccacagccaaggaggccggctgccgcttcatcaacctgcagcccagcaccctgacagacaagtggtatggagagagccagaagctggccgctgctgtgttcagcctggccatcaagctgcagcccagcatcatcttcattgatgaaattgacagcttcctgaggaacagaagcagcagtgaccacgaggccacagccatgatgaaggcccagttcatgagcctgtgggatggcctggacacagaccacagctgccaggccctgaagcagcgggaggccatcctgaagctgatcctgaagaatgaaaatgtggacagacatgtggacctgctggaggtggcccaggagacagatggcttcagcggcagtgacctgaaggagatgtgcagagatgctgccctgctgtgtgtgcgggagtatgtgaacagcaccagcgaggagagccatgatgaagatgagatccggcctgtgcagcagcaggacctgcaccgggccatcgagaagatgaagaagagcaaggatgctgccttccagaatgtgctgacccacgtgtgcctggactag

SEQ ID NO: 144330 - DNA, 864 bp, Artificial Sequence
  Description of Artificial Sequence: Synthetic coding sequence
atggtgcacgccgaggccttcagccggcccctgagcagaaatgaggtggtgggcctcatcttccggctgaccatctttggagctgtgacctacttcaccatcaagtggatggtggatgccatcgaccccaccaggaagcagaaggtggaggcccagaagcaggccgagaagctgatgaagcagatcggcgtgaagaatgtgaagctgtctgaatatgagatgagcattgctgcccacctggtggaccccctgaacatgcacgtgacctggagcgacattgctggcctggatgatgtgatcacagacctgaaggacaccgtcatcctgcccatcaagaagaagcacctgtttgagaacagccggctgctgcagccccccaagggcgtgctgctgtatggccccccaggctgcggcaagaccctcatcgccaaggccacagccaaggaggccggctgccgcttcatcaacctgcagcccagcaccctgacagacaagtggtatggagagagccagaagctggccgctgctgtgttcagcctggccatcaagctgcagcccagcatcatcttcattgatgaaattgacagcttcctgaggaacagaagcagcagtgaccacgaggccacagccatgatgaaggcccagttcatgagcctgtgggatggcctggacacagaccacagctgccaggtgattgtgatgggcgccaccaaccggccccaggacctggacagcgccatcatgaggaggatgcccacccgcttccacatcaaccagcctgccctgaagcagcgggaggccatcctgaagctgatcctgaagaatgaaaacctgaggaagctgaagccccgggaggtgctgtag

SEQ ID NO: 144331 - DNA, 4173 bp, Artificial Sequence
  Description of Artificial Sequence: Synthetic coding sequence
atggtggtgctgcggagcagcctggagctgcacaaccacagcgctgccagcgccaccggcagcctggacctgagcagtgacttcctgagcctggagcacatcggcagaagaaggctgcggtctgctggggccgcccagaagaagccagctgccaccacagccaaggctggagatggcagctctgtgaaggaggtggagacctaccacaggacccgggccctgcggagcctgaggaaggatgcccagaacagcagtgacagcagctttgagaagaatgtggagatcacagagcagctggccaacggccgccacttcacccggcagctggcccggcagcaggccgacaagaagaaggaggagcaccgggaggacaaggtgattcctgtgaccaggagcctgcgggccaggaacatcgtgcagagcacagagcacctgcatgaagataatggagatgtggaggtgagaagaagctgccgcatccgcagccgctacagcggcgtgaaccagagcatgctgtttgacaagctgatcaccaacacagctgaggccgtgctgcagaagatggatgacatgaagaagatgaggcggcagaggatgagggagctggaggacctgggcgtcttcaatgaaacagaggagagcaacctgaacatgtacacccggggcaagcagaaggacatccagaggacagatgaggagaccacagacaaccaggagggctctgtggagagcagcgaggagggggaggaccaggagcatgaagatgatggagaagatgaagatgatgaagatgatgatgatgatgatgatgatgatgatgatgatgatgatgaagatgatgaagatgaggaggatggagaggaggagaaccagaagcgctactacctgcggcagaggaaggccaccgtgtactaccaggcccccctggagaagcccaggcaccagaggaagcccaacatcttctacagcggccctgccagccctgcccggccccgctaccgcctgagcagcgctggccccaggagcccctactgcaagaggatgaacagaagaagacatgccatccacagcagtgacagcaccagcagcagcagcagtgaagatgagcagcactttgagaggaggaggaagaggagcaggaacagagccatcaaccgctgcctgcccctgaacttcaggaaggatgagctgaagggcatctacaaggacaggatgaagattggagccagcctggctgatgtggaccccatgcagctggacagctctgtgcgctttgattctgtgggcggcctgagcaaccacatcgccgccctgaaggagatggtggtgttccccctgctgtacccagaggtgtttgagaagttcaagatccagcccccccggggctgcctcttctacggccccccaggcaccgggaagaccctggtggcccgggccctggccaatgaatgttcccagggcgacaagagggtggccttcttcatgaggaaaggagctgactgcctgagcaagtgggtgggggagagcgagcggcagctgcggctgctgtttgaccaggcctaccagatgaggcccagcatcatcttctttgatgaaattgatggcctggcccctgtgcgcagcagccggcaggaccagatccacagcagcatcgtgtccaccctgctggccctgatggatggcctggacagcagaggagagatcgtggtgattggagccaccaaccggctggacagcattgatcctgccctgcggcggcccggccgctttgaccgggagttcctgttcagcctgcctgacaaggaggccaggaaggagatcctgaagatccacacccgggactggaaccccaagcccctggacaccttcctggaggagctggccgagaactgtgtgggctactgtggggctgacatcaagagcatctgtgccgaggccgccctgtgtgccctgcggcggcgctacccccagatctacaccaccagcgagaagctgcagctggacctgagcagcatcaacatcagcgccaaggactttgaggtggccatgcagaagatgatcccagccagccagagagctgtgaccagccctggccaggccctgagcacagtggtgaagcccctgctgcagaacacagtggacaagatcctggaggccctgcagagggtcttcccccatgctgagttccgcaccaacaagaccctggacagcgacatcagctgccccctgctggagagtgacctggcctacagtgatgatgatgtgcccagcgtgtatgaaaatggcctgagccagaagagcagccacaaggccaaggacaacttcaacttcctgcacctgaacagaaatgcctgctaccagcccatgtccttccggccccgcatcctgattgtgggggagcccggcttcggccagggcagccacctggccccagctgtgattcatgccctggagaagttcaccgtgtacaccctggacatccctgtgctgtttggagtgtccaccaccagccctgaggagacctgtgcccaggtgatccgggaggccaagaggacagcccccagcatcgtgtatgtgccccacatccacgtgtggtgggagatcgtgggccccaccctgaaggccaccttcaccaccctgctgcagaacatccccagctttgcccctgtgctgctgctggccaccagtgacaagccccacagcgccctgcctgaggaggtgcaggagctgttcatccgggactatggagagatcttcaacgtgcagctgcctgacaaggaggagaggaccaagttctttgaggacctgatcctgaagcaggccgccaagccacccatcagcaagaagaaggctgtgctgcaggccctggaggtgctgcctgtggcccctcctcctgagcccaggagcctgacagctgaggaggtgaagaggctggaggagcaggaggaggacaccttccgggagctgcgcatcttcctgagaaatgtgacccaccggctggccatcgacaagcgcttccgggtcttcaccaagcctgtggaccctgatgaggtgcctgactatgtgaccgtcatcaagcagcccatggacctgagcagcgtcatcagcaagattgacctgcacaagtacctgactgtgaaggactacctgcgggacatcgacctgatctgcagcaatgccctggagtacaacccagaccgggaccccggggacaggctcatccgccaccgggcctgtgccctgcgggacacagcctatgccatcatcaaggaggagctggatgaagattttgagcagctgtgtgaggagatccaggagagcaggaagaagaggggctgcagcagcagcaaatatgcccccagctactaccacgtgatgcccaagcagaacagcaccctggtgggggacaagagaagtgaccctgagcagaatgagaagctgaagacccccagcacccctgtggcctgcagcaccccagcccagctgaagaggaagatcaggaagaagagcaactggtacctgggcaccatcaagaagaggaggaagatcagccaggccaaggatgacagccagaatgccatcgaccacaagattgaaagtgacacagaggagacccaggacacctctgtggaccacaatgaaacaggcaacacaggagagagctctgtggaggagaatgagaagcagcagaatgccagcgagagcaagctggagctgaggaacaacagcaacacctgcaacattgaaaatgagctggaggacagcaggaagaccacagcctgcacagagctgcgggacaagatcgcctgcaatggagatgccagcagcagccagatcatccacatcagtgatgaaaatgaaggcaaggagatgtgtgtgctgaggatgacccgggcccggcgcagccaggtggagcagcagcagctgatcaccgtggagaaggccctggccatcctgagccagcccacccccagcctggtggtggaccacgagcggctgaagaacctgctgaagacagtggtgaagaagagccagaactacaacatcttccagctggagaacctgtatgctgtgatcagccagtgcatctaccgccacaggaaggaccatgacaagaccagcctcatccagaagatggagcaggaggtggagaacttcagctgcagcaggtag

SEQ ID NO: 144332 - DNA, 1719 bp, Artificial Sequence
  Description of Artificial Sequence: Synthetic coding sequence
tgaggagccctggccctggccgccccccggcgctgccggcagcccctgcccggccgggactgtgcccctggggcccccccagctggagctgtgtcccgggccggcagaattggcctcttccccagccctgtgtgcaccagcgctgctgtgcgcagcggcagcggctacgccaaggatgccctgaacctggcccagatgcaggagcagaccctgcagctggagcagcagagcaagctgaaggagtatgaggccgctgtggagcagctgaagtctgagcagatccgggcccaggccgaggagaggaggaagaccctgtctgaggagacccggcagcaccaggcccgggcccagtaccaggacaagctggcccggcagagatatgaggaccagctgaagcagcagcagctgctgaatgaggagaacctgaggaagcaggaggagagcgtgcagaagcaggaggccatgaggcgggccaccgtggagcgggagatggagctgcggcacaagaatgagatgctgcgggtggaggccgaggcccgggcccgggccaaggccgagcgggagaatgctgacatcatccgggagcagatccggctgaaggctgctgagcaccggcagacagtgctggagagcatcagaacagctggcaccctgtttggagagggcttccgggcctttgtgacagactgggacaaggtgacagccaccgtggccggcctgaccctgctggccgtgggcgtgtacagcgccaagaatgccaccctggtggccggccgcttcatcgaggcccggctgggcaagcccagcctggtgcgggagaccagccgcatcaccgtgctggaggccctgcggcaccccatccaggtgtcccggcggctgctgagccggccccaggatgccctggagggcgtggtgctgagccccagcctggaggcccgggtgcgggacatcgccatcgccaccaggaacaccaagaagaacagaagcctgtacagaaacatcctgatgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagcagaagaggcctgctgctgtttgtggatgaagcagatgccttcctgaggaagagggccacagagaagatcagcgaggacctgcgggccaccctgaatgccttcctgtacagaacaggccagcacagcaacaagttcatgctggtgctggccagcaaccagcctgagcagtttgactgggccatcaatgaccgcatcaatgagatggtgcactttgacctgcccggccaggaggagcgggagcggctggtgaggatgtactttgacaagtatgtgctgaagccagccacagagggcaagcagaggctgaagctggcccagtttgattatggcaggaagtgcagcgaggtggcccggctgacagagggcatgagcggccgggagatcgcccagctggccgtgtcctggcaggccacagcctatgcctctgaagatggagtgctgacagaggccatgatggacaccagggtgcaggatgctgtgcagcagcaccagcagaagatgtgctggctgaaggccgagggccctggaagaggagatgagcccagccccagctag

SEQ ID NO: 144333 - DNA, 1905 bp, Artificial Sequence
  Description of Artificial Sequence: Synthetic coding sequence
atgtcctggctgtttggcatcaacaagggccccaagggggagggcgccggccccccaccacccctgcccccagcccagcctggagctgagggcggcggggaccggggcctgggggacaggcctgcccccaaggacaagtggagcaactttgaccccaccggcctggagcgggccgccaaggccgcccgggagctggagcacagccgctatgccaaggatgccctgaacctggcccagatgcaggagcagaccctgcagctggagcagcagagcaagctgaagatgaggctggaggccctgagcctgctgcacaccctggtgtgggcctggagcctgtgcagagctggagctgtgcagacccaggagcggctgagcggcagcgccagccctgagcaggtgcctgctggggagtgctgtgccctgcaggagtatgaggccgctgtggagcagctgaagtctgagcagatccgggcccaggccgaggagaggaggaagaccctgtctgaggagacccggcagcaccaggcccgggcccagtaccaggacaagctggcccggcagagatatgaggaccagctgaagcagcagcagctgctgaatgaggagaacctgaggaagcaggaggagagcgtgcagaagcaggaggccatgaggcgggccaccgtggagcgggagatggagctgcggcacaagaatgagatgctgcgggtggaggccgaggcccgggcccgggccaaggccgagcgggagaatgctgacatcatccgggagcagatccggctgaaggctgctgagcaccggcagacagtgctggagagcatcagaacagctggcaccctgtttggagagggcttccgggcctttgtgacagactgggacaaggtgacagccaccgtggccggcctgaccctgctggccgtgggcgtgtacagcgccaagaatgccaccctggtggccggccgcttcatcgaggcccggctgggcaagcccagcctggtgcgggagaccagccgcatcaccgtgctggaggccctgcggcaccccatccaggtgtcccggcggctgctgagccggccccaggatgccctggagggcgtggtgctgagccccagcctggaggcccgggtgcgggacatcgccatcgccaccaggaacaccaagaagaacagaagcctgtacagaaacatcctgatgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagcagaagaggcctgctgctgtttgtggatgaagcagatgccttcctgaggaagagggccacagagaagatcagcgaggacctgcgggccaccctgaatgccttcctgtacagaacaggccagcacagcaacaagttcatgctggtgctggccagcaaccagcctgagcagtttgactgggccatcaatgaccgcatcaatgagatggtgcactttgacctgcccggccaggaggagcgggagcggctggtgaggatgtactttgacaagtatgtgctgaagccagccacagagggcaagcagaggctgaagctggcccagtttgattatggcaggaagtgcagcgaggtggcccggctgacagagggcatgagcggccgggagatcgcccagctggccgtgtcctggcaggccacagcctatgcctctgaagatggagtgctgacagaggccatgatggacaccagggtgcaggatgctgtgcagcagcaccagcagaagatgtgctggctgaaggccgagggccctggaagaggagatgagcccagccccagctag

SEQ ID NO: 144334 - DNA, 1761 bp, Artificial Sequence
  Description of Artificial Sequence: Synthetic coding sequence
atgtcctggctgtttggcatcaacaagggccccaagggggagggcgccggccccccaccacccctgcccccagcccagcctggagctgagggcggcggggaccggggcctgggggacaggcctgcccccaaggacaagtggagcaactttgaccccaccggcctggagcgggccgccaaggccgcccgggagctggagcacagccgctatgccaaggatgccctgaacctggcccagatgcaggagcagaccctgcagctggagcagcagagcaagctgaaggagtatgaggccgctgtggagcagctgaagtctgagcagatccgggcccaggccgaggagaggaggaagaccctgtctgaggagacccggcagcaccaggcccgggcccagtaccaggacaagctggcccggcagagatatgaggaccagctgaagcagcagcagctgctgaatgaggagaacctgaggaagcaggaggagagcgtgcagaagcaggaggccatgaggcgggccaccgtggagcgggagatggagctgcggcacaagaatgagatgctgcgggtggaggccgaggcccgggcccgggccaaggccgagcgggagaatgctgacatcatccgggagcagatccggctgaaggctgctgagcaccggcagacagtgctggagagcatcagaacagctggcaccctgtttggagagggcttccgggcctttgtgacagactgggacaaggtgacagccaccgtggccggcctgaccctgctggccgtgggcgtgtacagcgccaagaatgccaccctggtggccggccgcttcatcgaggcccggctgggcaagcccagcctggtgcgggagaccagccgcatcaccgtgctggaggccctgcggcaccccatccaggtgtcccggcggctgctgagccggccccaggatgccctggagggcgtggtgctgagccccagcctggaggcccgggtgcgggacatcgccatcgccaccaggaacaccaagaagaacagaagcctgtacagaaacatcctgatgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagcagaagaggcctgctgctgtttgtggatgaagcagatgccttcctgaggaagagggccacagagaagatcagcgaggacctgcgggccaccctgaatgccttcctgtacagaacaggccagcacagcaacaagttcatgctggtgctggccagcaaccagcctgagcagtttgactgggccatcaatgaccgcatcaatgagatggtgcactttgacctgcccggccaggaggagcgggagcggctggtgaggatgtactttgacaagtatgtgctgaagccagccacagagggcaagcagaggctgaagctggcccagtttgattatggcaggaagtgcagcgaggtggcccggctgacagagggcatgagcggccgggagatcgcccagctggccgtgtcctggcaggccacagcctatgcctctgaagatggagtgctgacagaggccatgatggacaccagggtgcaggatgctgtgcagcagcaccagcagaagatgtgctggctgaaggccgagggccctggaagaggagatgagcccagccccagctag

SEQ ID NO: 144335 - DNA, 792 bp, Artificial Sequence
  Description of Artificial Sequence: Synthetic coding sequence
atgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagccggcggggcctgctgctgtttgtggatgaagcagatgccttcctgaggaagagggccacagagaagatcagcgaggacctgcgggccaccctgaatgccttcctgtacagaacaggccagcacagcaacaaccccagccacgtgtcccatggaggcagcagccctgctggccggccctggctgaccccccaggcccgctgggccccccgcttcatgctggtgctggccagcaaccagcctgagcagtttgactgggccatcaatgaccgcatcaatgagatggtgcactttgacctgcccggccaggaggagcgggagcggctggtgaggatgtactttgacaagtatgtgctgaagccagccacagagggcaagcagaggctgaagctggcccagtttgattatggcaggaaatgttctgaggtggcccggctgacagagggcatgagcggccgggagatcgcccagctggccgtgtcctggcaggccacagcctatgcctctgaagatggagtgctgacagaggccatgatggacaccagggtgcaggatgctgtgcagcagcaccagcagaagatgtgctggctgaaggccgagggccctggaagaggagatgagcccagccccagctag

SEQ ID NO: 144336 - DNA, 606 bp, Artificial Sequence
  Description of Artificial Sequence: Synthetic coding sequence
aagctggccctgcacagcggcatggactatgccatcatgactggaggagatgtggcccccatgggccgggagggcgtgacagccatgcacaagctgtttgactgggccaacaccagccggcggggcctgctgctgtttgtggatgaagcagatgccttcctgaggaagagggccacagagaagatcagcgaggacctgcgggccaccctgaatgccttcctgtacagaacaggccagcacagcaacaaccccagccacgtgtcccatggaggcagcagccctgctggccggccctggctgaccccccaggcccgctgggccccccgcttcatgctggtgctggccagcaaccagcctgagcagtttgactgggccatcaatgaccgcatcaatgagatggtgcactttgacctgcccggccaggaggagcgggagcggctggtgaggatgtactttgacaagtatgtgctgaagccagccacagagggcaagcagaggctgaagctggcccagtttgattatggcaggaaatgttctgaggtggcccggctgacagagggcatgagcggccgggagatcgcccagctggccgtgtcctggcagtag

SEQ ID NO: 144337 - DNA, 435 bp, Artificial Sequence
  Description of Artificial Sequence: Synthetic coding sequence
atgtgcctgtgccggcccctgctgccccagagggcccagtaccaggacaagctggcccggcagagatatgaggaccagctgaagcagcagcagctgctgaatgaggagaacctgaggaagcaggaggagagcgtgcagaagcaggaggccatgaggcgggccaccgtggagcgggagatggagctgcggcacaagaatgagatgctgcgggtggaggccgaggcccgggcccgggccaaggccgagcgggagaatgctgacatcatccgggagcagatccggctgaaggctgctgagcaccggcagacagtgctggagagcatcagaacagctggcaccctgtttggagagggcttccgggcctttgtgacagactgggacaaggtgacagccaccgtggccggcctgaccctgctggccgtgggcgtgtactag

SEQ ID NO: 144338 - DNA, 309 bp, Artificial Sequence
  Description of Artificial Sequence: Synthetic coding sequence
atgaggctggaggccctgagcctgctgcacaccctggtgtgggcctggagcctgtgcagagctggagctgtgcagacccaggagcggctgagcggcagcgccagccctgagcaggtgcctgctggggagtgctgtgccctgcaggagtatgaggccgctgtggagcagctgaagtctgagcagatccgggcccaggccgaggagaggaggaagaccctgtctgaggagacccggcagcaccaggcccgggcccagtaccaggacaagctggcccggcagagatatgaggaccagctgaagcagcagtag

SEQ ID NO: 144339 - DNA, 1524 bp, Artificial Sequence
  Description of Artificial Sequence: Synthetic coding sequence
atgcaggagcagaccctgcagctggagcagcagagcaagctgaaggagtatgaagctgctgtggagcagctgaagtctgagcagatccgggcccaggccgaggagaggaggaagaccctgtctgaggagacccggcagcaccaggcccgggcccagtaccaggacaagctggcccggcagagatatgaggaccagctgaagcagcagcagctgctgaatgaggagaacctgaggaagcaggaggagagcgtgcagaagcaggaggccatgagaagagccaccgtggagcgggagatggagctgcggcacaagaatgagatgctgcgggtggaggccgaggcccgggcccgggccaaggccgagagagaaaatgctgacatcatccgggagcagatccggctgaaggctgctgagcaccggcagacagtgctggagagcatcagaacagctggcaccctgtttggagagggcttccgggcctttgtgacagactgggacaaggtgacagccaccgtggccggcctgaccctgctggccgtgggcgtgtacagcgccaagaatgccaccctggtggccggccgcttcatcgaggcccggctgggcaagcccagcctggtgcgggagaccagccgcatcaccgtgctggaggccctgcggcaccccatccaggtgtcccggcggctgctgagccggccccaggatgccctggagggcgtggtgctgagccccagcctggaggcccgggtgcgggacatcgccatcgccaccaggaacaccaagaagaacagaagcctgtacagaaacatcctgatgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagccggcggggcctgctgctgtttgtggatgaagcagatgccttcctgaggaagagggccacagagaagatcagcgaggacctgcgggccaccctgaatgccttcctgtacagaacaggccagcacagcaacaagttcatgctggtgctggccagcaaccagcctgagcagtttgactgggccatcaatgaccgcatcaatgagatggtgcactttgacctgcccggccaggaggagcgggagcggctggtgaggatgtactttgacaagtatgtgctgaagccagccacagagggcaagcagaggctgaagctggcccagtttgattatggcaggaaatgttctgaggtggcccggctgacagagggcatgagcggccgggagatcgcccagctggccgtgtcctggcaggccacagcctatgcctctgaagatggagtgctgacagaggccatgatggacaccagggtgcaggatgctgtgcagcagcaccagcagaagatgtgctggctgaaggccgagggccctggaagaggagatgagcccagccccagctag

SEQ ID NO: 144340 - DNA, 1947 bp, Artificial Sequence
  Description of Artificial Sequence: Synthetic coding sequence
atgtcctggctgtttggagtgaacaagggccccaagggggagggcgccggccccccaccacccctgcccccagcccagcctggagctgagggcggcggggaccggggcctgggggacaggcctgcccccaaggacaagtggagcaactttgaccccaccggcctggagcgggccgccaaggccgcccgggagctggagcacagccgctatgccaaggaggccctgaacctggcccagatgcaggagcagaccctgcagctggagcagcagagcaagctgaaggagtatgaggccgctgtggagcagctgaagtctgagcagatccgggcccaggccgaggagaggaggaagaccctgtctgaggagacccggcagcaccaggcccgggcccagtaccaggacaagctggcccggcagagatatgaggaccagctgaagcagcagcagctgctgaatgaggagaacctgaggaagcaggaggagagcgtgcagaagcaggaggccatgaggcgggccaccgtggagcgggagatggagctgcggcacaagaatgagatgctgcgggtggagacagaggcccgggcccgggccaaggccgagcgggagaatgctgacatcatccgggagcagatccggctgaaggccagcgagcaccggcagacagtgctggagagcatcagaacagctggcaccctgtttggagagggcttccgggcctttgtgacagaccgggacaaggtgacagccaccgtggccggcctgaccctgctggccgtgggcgtgtacagcgccaagaatgccacagctgtgacaggccgcttcatcgaggcccggctgggcaagcccagcctggtgcgggagaccagccgcatcaccgtgctggaggccctgcggcaccccatccaggtgtcccggcggctgctgagccggccccaggatgtgctggagggcgtggtgctgagccccagcctggaggcccgggtgcgggacatcgccatcgccaccaggaacaccaagaagaacagaggcctgtaccgccacatcctgctgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagcagaagaggcctgctgctcttcatggatgaagcagatgccttcctgaggaagagggccacagaggagatcagcaaggacctgcgggccaccctgaatgccttcctgtaccacatgggccagcacagcaacaagttcatgctggtgctggccagcaacctgcctgagcagtttgactgtgccatcaacagcagaattgatgtgatggtgcactttgacctgccccagcaggaggagcgggagcggctggtgcggctgcactttgacaactgtgtgctgaagccagccacagagggcaagaggcggctgaagctggcccagtttgattatggcaggaagtgcagcgaggtggcccggctgacagagggcatgagcggccgggagatcgcccagctggccgtgtcctggcaggccacagcctatgccagcaaggatggagtgctgacagaggccatgatggatgcctgtgtgcaggatgctgtgcagcagtaccggcagaagatgcgctggctgaaggccgagggccctggccggggcgtggagcaccccctgagcggcgtgcagggcgagaccctgacctcctggagcctggccacagaccccagctacccctgcctggccggcccctgcaccttccgcatctgctcctggatgggcaccggcctgtgccccggccccctgagccccaggatgagctgtggcggcggccggcccttctgccccccaggccaccccctgctgtag

SEQ ID NO: 144341 - DNA, 900 bp, Artificial Sequence
  Description of Artificial Sequence: Synthetic coding sequence
atgtcctggctgtttggagtgaacaagggccccaagggggagggcgccggccccccaccacccctgcccccagcccagcctggagctgagggcggcggggaccggggcctgggggacaggcctgcccccaaggacaagtggagcaactttgaccccaccggcctggagcgggccgccaaggccgcccgggagctggagcacagccgctatgccaaggaggccctgaacctggcccagatgcaggagcagaccctgcagctggagcagcagagcaagctgaagcagctgctgaatgaggagaacctgaggaagcaggaggagagcgtgcagaagcaccggcagacagtgctggagagcatcagaacagctggcaccctgtttggagagggcttccgggcctttgtgacagaccgggacaaggtgacagccaccgtggccggcctgaccctgctggccgtgggcgtgtacagcgccaagaatgccacagctgtgacaggccgcttcatcgaggcccggctgggcaagcccagcctggtgcgggagaccagccgcatcaccgtgctggaggccctgcggcaccccatccagcaggtgtcccggcggctgctgagccggccccaggatgtgctggagggcgtggtgctgagccccagcctggaggcccgggtgcgggacatcgccatcgccaccaggaacaccaagaagaacagaggcctgtaccgccacatcctgctgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagcagaagatag

SEQ ID NO: 144342 - DNA, 351 bp, Artificial Sequence
  Description of Artificial Sequence: Synthetic coding sequence
atgaggcgggccaccgtggagcgggagatggagctgcggcacaagaatgagatgctgcgggtggagacagaggcccgggcccgggccaaggccgagcgggagaatgctgacatcatccgggagcagatccggctgaaggccagcgagcaccggcagacagtgctggagagcatcagaacagctggcaccctgtttggagagggcttccgggcctttgtgacagaccgggacaaggtgacagccaccgtgaacatcttcatcaagcagggctggcaggtggccgagcggcagcacttcagaagaagacgctgggccgaccacgaggtgcggcgcagccgcagctcctggtag

SEQ ID NO: 144343 - DNA, 1449 bp, Artificial Sequence
  Description of Artificial Sequence: Synthetic coding sequence
atgctgcgggtggagacagaggcccgggcccgggccaaggccgagagagaaaatgctgacatcatccgggagcagatccggctgaaggccagcgagcaccggcagacagtgctggagagcatcagaacagctggcaccctgtttggagagggcttccgggcctttgtgacagaccgggacaaggtgacagccaccgtggccggcctgaccctgctggccgtgggcgtgtacagcgccaagaatgccacagctgtgacaggccgcttcatcgaggcccggctgggcaagcccagcctggtgcgggagaccagccgcatcaccgtgctggaggccctgcggcaccccatccaggtgtcccggcggctgctgagccggccccaggatgtgctggagggcgtggtgctgtctgtgagccccagcctggaggcccgggtgcgggacatcgccatcgccaccaggaacaccaagaagaacagaggcctgtaccgccacatcctgctgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagccggcggggcctgcaggaggagatcagcaaggacctgcgggccaccctgaatgccttcctgtaccacatgggccagcacagcaacaaccgcttcatgctggtgctggccagcaacctgcctgagcagtttgactgtgccatcaacagcagaattgatgtgatggtgcactttgacctgccccagcaggaggagcgggagcggctggtgcggctgcactttgacaactgtgtgctgaagccagccacagagggcaagaggatgggcgtgggccagctgcccgtcttccggcccccacctcatggagtgggcagcgctgccctggccgccagcctgggcaacagcttcccccggcggctgaagctggcccagtttgattatggcaggaagtgcagcgaggtggcccggctgacagagggcatgagcggccgggagatcgcccagctggccgtgtcctggcaggccacagcctatgccagcaaggatggagtgctgacagaggccatgatggatgcctgtgtgcaggatgctgtgcagcagtaccggcagaagatgcgctggctgaaggccgagggccctggccggggcgtggagcaccccctgagcggcgtgcagggcgagaccctgacctcctggagcctggccacagaccccagctacccctgcctggccggcccctgcaccttccgcatctgctcctggatgggcaccggcctgtgccccggccccctgagccccaggatgagctgtggcggcggccggcccttctgccccccaggccaccccctgctgtag

SEQ ID NO: 144344 - DNA, 354 bp, Artificial Sequence
  Description of Artificial Sequence: Synthetic coding sequence
atgaggcgggccaccgtggagcgggagatggagctgcggcacaagaatgagatgctgcgggtggagacagaggcccgggcccgggccaaggccgagcgggagaatgctgacatcatccgggagcagatccggctgaaggccagcgagcaccggcagacagtgctggagagcatcagaacagctggcaccctgtttggagagggcttccgggcctttgtgacagaccgggacaaggtgacagccaccgtgaacatcttcatcaagcagggctggcaggtggccgagcggcagcaccacttcagaagaagacgctgggccgaccacgaggtgagaagaagccgcagctcctggtag

SEQ ID NO: 144345 - DNA, 5535 bp, Artificial Sequence
  Description of Artificial Sequence: Synthetic coding sequence
atggtgggcgtgctggccatggctgctgctgctgcccctcctcctgtgaaggactgtgaaattgagccctgcaagaagaggaagaaggatgatgacaccagcacctgcaagaccatcaccaagtacctgagccccctgggcaagacccgggacagagtgtttgccccacccaagcccagcaacatcctggactacttcaggaagaccagccccaccaatgagaagacccagctgggcaaggagtgcaagatcaagagccctgagagcgtgcctgtggacagcaacaaggactgcaccacccccctggagatgttcagcaatgtggagttcaagaagaagaggaagagggtgaacctgagccaccagctgaacaacatcaagacagaaaatgaggcccccatcgagatcagcagtgatgacagcaaagaagactacagcctgaacaatgactttgtggagagcagcacctctgtgctgcgctacaagaagcaggtggaggtgctggccgagaacatccaggacaccaagagccagcccaacaccatgaccagcctgcagaacagcaagaaggtgaaccccaagcagggcaccaccaagaatgacttcaagaagctgaggaagaggaaatgtagagatgtggtggacctgtctgagagcctgcccctggccgaggagctgaacctgctgaagaaggatggcaaggacaccaagcagatggagaacaccaccagccacgccaacagccgggacaacgtgacagaagctgcccagctgaatgacagcatcatcaccgtgtcctatgaggagttcctgaagagccacaaggagaacaaggtggaggagatcccagacagcaccatgagcatctgtgtgcccagcgagaccgtggatgaaattgtgaagagcggctacatcagcgagagtgaaaattctgagatcagccagcaggtgcgcttcaagacagtgacagtgctggcccaggtgcaccccatcccccccaagaagacaggcaagatcccccgcatcttcctgaagcagaagcagtttgagatggagaacagcctgagtgaccctgaaaatgagcagacagtgcagaagaggaagagcaatgtggtgatccaggaggaggagctggagctggccgtgctggaggccggcagcagcgaggccgtgaagcccaagtgcaccctggaggagcggcagcagttcatgaaggccttccggcagcctgccagtgatgccctgaagaatggagtgaagaagagcagtgacaagcagaaggacctgaatgagaagtgcctgtatgaggtgggcagagatgacaacagcaagaagatcatggagaacagcggcatccagatggtgtccaagaatggaaacctgcagctgcacacagacaagggcagcttcctgaaggagaagaacaagaagctgaagaagaagaacaagaagaccctggacaccggggccatccctgggaagaaccgggagggcaacacccagaagaaggagaccaccttcttcctgaaggagaagcagtaccagaacaggatgagcctgcggcagaggaagacagagttcttcaagagcagcaccctcttcaacaatgaaagcctggtgtatgaggacatcgccaatgatgacctgctgaaggtgagcagcctgtgcaacaacaacaagctgagcaggaagaccagcatccctgtgaaggacatcaagctgacccagagcaaggccgagagcgaggccagcctgctgaatgtgtccacccccaagagcaccaggagaagtggccgcatcagcagcacccccaccacagagaccatccggggcatcgacagtgatgatgtgcaggacaacagccagctgaaggccagcacccagaaggccgccaacctgtctgagaagcacagcctgtacacagctgagctgatcaccgtgccctttgattctgagagccccatccgcatgaagttcacccgcatcagcacccccaagaagagcaagaagaagagcaacaagaggtctgagaagtctgaggccacagatggcggcttcaccagccagatcaggaaggccagcaacaccagcaagaacatcagcaaggccaagcagctgattgagaaggccaaggccctgcacatcagccgcagcaaggtgacagaggagatcgccatccccctgcggcgcagcagccgccaccagaccctgcctgagaggaagaagctgtctgaaacagaagattctgtcatcatcatcgacagcagccccacagccctgaagcaccctgagaagaaccagaagaagctgcagtgcctgaatgatgtgctgggcaagaagctgaacaccagcaccaagaatgtgcctgggaagatgaaggtggcccccctcttcctggtgaggaaggcccagaaggctgctgaccctgtgcccagctttgatgagagcagccaggacaccagcgagaagagccaggactgtgatgtgcagtgcaaggccaagagggacttcctgatgagcggcctgcctgacctgctgaagaggcagatcgccaagaaggctgctgccctggatgtgtacaatgctgtgtccaccagcttccagagggtggtgcacgtgcagcagaaggatgatggctgctgcctgtggcacctgaagccacccagctgccccctgctgaccaagttcaaggagctgaacaccaaggtgattgacctgagcaaatgtggcatcgccctgggggagttcagcaccctgaacagcaagctgaagagcggcaacagcgctgctgtgttcatgaggaccaggaaggagttcacagaggaggtgaggaacctgctgctggaggagatccgctggagcaaccctgagttcagcctgaagaagtacttccccctgctgctgaagaagcagatcgagcaccaggtgctgagcagcgagtgccacagcaagcaggagctggaggctgatgtgagccacaaggagaccaagaggaagctggtggaggccgagaacagcaagagcaagaggaagaagcccaatgagtacagcaagaacctggagaagaccaacaggaagtctgaggagctgagcaagaggaacaacagcagcggcatcaagctggacagcagcaaggacagcggcacagaggacatgctgtggacagagaagtaccagccccagacagccagcgagctgattggaaatgagctggccatcaagaagctgcacagctggctgaaggactggaagagaagagctgagctggaggagcggcagaacctgaagggcaagagagatgagaagcatgaggacttcagcggcggcatcgacttcaagggcagcagtgatgatgaggaggagagccggctgtgcaacacagtgctgatcaccggccccaccggggtgggcaagacagctgctgtgtatgcctgtgcccaggagctgggcttcaagatctttgaggtgaatgccagcagccagaggagcggccggcagatcctgagccagctgaaggaggccacccagagccaccaggtggacaagcagggcgtgaacagccagaagccctgcttcttcaacagctactacatcggcaagagccccaagaagatcagcagccccaagaaggtggtgaccagccccaggaaggtgcccccacccagccccaagagcagcggccccaagagggccctgccccccaagaccctggccaactacttcaaggtgagccccaagcccaagaacaatgaggagatcggcatgctgctggagaacaacaagggcatcaagaacagctttgagcagaagcagatcacccagaccaagagcaccaatgccaccaacagcaatgtgaaggatgtgggcgctgaggagcccagcaggaagaatgccaccagcctcatcctgtttgaggaggtggatgtgatctttgatgaagatgctggcttcctgaatgccatcaagaccttcatggccaccaccaagaggcctgtgatcctgaccaccagtgaccccaccttcagcctgatgtttgatggctgctttgaggagatcaagttcagcacccccagcctgctgaatgtggccagctacctgcagatgatctgcctgacagagaacttcagaacagatgtgaaggactttgtgaccctgctgacagccaacacctgtgacatcaggaagagcatcctgtacctgcagttctggatccgcagcggcggcggcgtgctggaggagcggcccctgaccctgtaccggggcaacagcagaaatgtgcagctggtgtgcagcgagcacggcctggacaacaagatctaccccaagaacaccaagaagaagagggtggacctgcccaagtgtgacagcggctgtgccgagaccctgtttggcctgaagaacatcttcagccccagtgaagatctcttctccttcctgaagcacaagatcaccatgaaggaggagtggcacaagttcatccagctgctgacagagttccagatgagaaatgtggacttcctgtacagcaacctggagttcatcctgcccctgcctgtggacaccatccctgagaccaagaacttctgtggccccagcgtgacagtggatgccagcgctgccaccaagtccatgaactgcctggccaggaagcacagcgagcgggagcagcccctgaagaagagccagaagaagaagcagaagaagaccctggtgatcctggatgacagcgacctgtttgacacagacctggacttcccagaccagagcatcagcctgagctctgtgagcagcagcagcaatgctgaggagagcaagacaggagatgaggagagcaaggcccgggacaagggcaacaaccctgagaccaagaagagcatcccctgcccccccaagaccacagctgggaagaagtgcagcgccctggtgagccactgcctgaacagcctgtctgagttcatggacaacatgtccttcctggatgccctgctgacagatgtgcgggagcagaacaagtatggaagaaatgacttctcctggaccaacgggaaggtgaccagcggcctgtgtgatgagttcagcctggagagcaatgatggctggaccagccagagcagtggagagctgaaggctgctgctgaggccctgtccttcaccaagtgcagcagcgccatcagcaaggccctggagaccctgaacagctgcaagaagctgggccgggaccccaccaatgacctgaccttctacgtgtcccagaagagaaataatgtgtacttcagccagagcgctgccaacctggacaatgcctggaagaggatcagcgtcatcaagtctgtgttcagcagccgcagcctgctgtatgtgggcaaccggcaggccagcatcatcgagtacctgcccaccctgaggaacatctgcaagacagagaagctgaaggagcagggcaagagcaagaggcgcttcctgcactactttgagggcatccacctggacatccccaaggagaccgtgaacaccctggccgctgacttcccctag

SEQ ID NO: 144346 - DNA, 3543 bp, Artificial Sequence
  Description of Artificial Sequence: Synthetic coding sequence
atgtctgctgacagcagccccctggtgggcagcacccccaccggctacggcaccctgaccatcggcaccagcattgaccccctgagcagctctgtgtcctctgtgcggctgagcggctactgcggcagcccctggagggtcatcggctaccacgtggtggtgtggatgatggccggcatccccctgctgctcttccgctggaagcccctgtggggcgtgcggctgcggctgcggccctgcaacctggcccatgctgagaccctggtgattgagatccgggacaaggaggacagctcctggcagctgttcaccgtgcaggtgcagacagaggccatcggggagggcagcctggagcccagcccccagagccaggccgaggatggccgcagccaggccgctgtgggcgctgtgcctgagggcgcctggaaggacacagcccagctgcacaagtctgaggaggccgtgtctgtgggccagaagagggtgctgcgctactacctgttccagggccagcgctacatctggattgagacccagcaggccttctaccaggtgtccctgctggaccacggccgcagctgtgatgatgtgcacaggagccgccacggcctgagcctgcaggaccagatggtgaggaaggccatctacggccccaacgtcatcagcatccctgtgaagagctacccccagctgctggtggatgaggccctgaacccctactacggcttccaggccttcagcatcgccctgtggctggccgaccactactactggtacgccctgtgcatcttcctgatcagcagcatcagcatctgcctgagcctgtacaagaccaggaagcagagccagaccctgcgggacatggtgaagctgtccatgagggtgtgtgtgtgcaggcctggaggagaggaggagtgggtggacagcagcgagctggtgcctggggactgcctggtgctgccccaggagggcggcctgatgccctgtgatgctgccctggtggccggggagtgcatggtgaatgaaagcagcctgaccggggagagcatccctgtgctgaagacagccctgcctgagggcctgggcccctactgtgccgagacccaccggcggcacaccctcttctgtggcaccctcatcctgcaggcccgggcctacgtgggcccccacgtgctggccgtggtgaccaggacaggcttctgcacagccaagggcggcctggtgagcagcatcctgcacccccggcccatcaacttcaagttctacaagcacagcatgaagtttgtggccgccctgtctgtgctggccctgctgggcaccatctacagcatcttcatcctgtacagaaacagagtgcccctgaatgaaattgtcatccgggccctggacctggtgacagtggtggtgcccccagccctgcctgctgccatgacagtgtgcaccctgtatgcccagagccggctgcggcggcagggcatcttctgcatccaccccctgcgcatcaacctgggcggcaagctgcagctggtgtgctttgacaagacaggcaccctgacagaagatggcctggatgtgatgggcgtggtgcccctgaagggccaggccttcctgcccctggtgcctgagccccggcggctgcctgtgggccccctgctgcgggccctggccacctgccacgccctgagccggctgcaggacacccctgtgggggaccccatggacctgaagatggtggagagcacaggctgggtgctggaggaggagcctgctgctgacagcgccttcggcacccaggtgctggccgtgatgaggcctcccctgtgggagccccagctgcaggccatggaggagccccctgtgcctgtgtctgtgctgcaccgcttccccttcagcagcgccctgcagaggatgtctgtggtggtggcctggccaggggccacccagcctgaggcctacgtgaagggcagccctgagctggtggccggcctgtgcaaccctgagaccgtgcccacagactttgcccagatgctgcagagctacacagctgctggctacagagtggtggccctggccagcaagcccctgcccaccgtgcccagcctggaggccgcccagcagctgacccgggacacagtggagggggacctgagcctgctgggcctgctggtgatgaggaacctgctgaagccccagaccacccctgtgatccaggccctgcggaggacccgcatccgggctgtgatggtgactggagacaacctgcagacagctgtgacagtggcccggggctgcggcatggtggccccccaggagcacctgatcatcgtgcacgccacccaccctgagcggggccagcctgccagcctggagttcctgcccatggagagccccacagctgtgaatggagtgaaggaccctgaccaggccgccagctacacagtggagccagaccccaggagccgccacctggccctgagcggccccaccttcggcatcatcgtgaagcacttccccaagctgctgcccaaggtgctggtgcagggcaccgtgtttgccaggatggcccctgagcagaagacagagctggtgtgtgagctgcagaagctgcagtactgtgtgggcatgtgtggagatggagccaatgactgtggggccctgaaggctgctgatgtgggcatcagcctgagccaggccgaggcctctgtggtgagccccttcaccagctccatggccagcattgaatgtgtgcccatggtgatccgggagggccgctgcagcctggacaccagcttcagcgtcttcaagtacatggccctgtacagcctgacccagttcatctctgtgctgatcctgtacaccatcaacaccaacctgggggacctgcagttcctggccatcgacctggtgatcaccaccaccgtggccgtgctgatgagcaggactggacctgccctggtgctgggccgggtgcggcccccaggggccctgctgtctgtgcctgtgctgagcagcctgctgctgcagatggtgctggtgactggagtgcagctgggcggctacttcctgaccctggcccagccctggtttgtgcccctgaacagaacagtggccgccccagacaacctgcccaactatgagaacacagtggtgttcagcctgagcagcttccagtacctgatcctggccgctgctgtgtccaaaggagcccccttccggcggcccctgtacaccaacgtgcccttcctggtggccctggccctgctgagctctgtgctggtgggcctggtgctggtgcccggcctgctgcagggccccctggccctgaggaacatcacagacaccggcttcaagctgctgctgctgggcctggtgaccctgaactttgtgggcgccttcatgctggagagcgtgctggaccagtgcctgcctgcctgcctgcggcggctgcggcccaagagggccagcaagaagcgcttcaagcagctggagcgggagctggccgagcagccctggccacccctgcctgctggccccctgaggtag

SEQ ID NO: 144347 - DNA, 3477 bp, Artificial Sequence
  Description of Artificial Sequence: Synthetic coding sequence
atgtctgctgacagcagccccctggtgggcagcacccccaccggctacggcaccctgaccatcggcaccagcattgaccccctgagcagctctgtgtcctctgtgcggctgagcggctactgcggcagcccctggagggtcatcggctaccacgtggtggtgtggatgatggccggcatccccctgctgctcttccgctggaagcccctgtggggcgtgcggctgcggctgcggccctgcaacctggcccatgctgagaccctggtgattgagatccgggacaaggaggacagctcctggcagctgttcaccgtgcaggtgcagacagaggccatcggggagggcagcctggagcccagcccccagagccaggccgaggatggccgcagccaggccgctgtgggcgctgtgcctgagggcgcctggaaggacacagcccagctgcacaagtctgaggaggccaagagggtgctgcgctactacctgttccagggccagcgctacatctggattgagacccagcaggccttctaccaggtgtccctgctggaccacggccgcagctgtgatgatgtgcacaggagcagacatggcctgagcctgcaggaccagatggtgaggaaggccatctacggccccaacgtcatcagcatccctgtgaagagctacccccagctgctggtggatgaggccctgaacccctactacggcttccaggccttcagcatcgccctgtggctggccgaccactactactggtacgccctgtgcatcttcctgatcagcagcatcagcatctgcctgagcctgtacaagaccaggaagcagagccagaccctgcgggacatggtgaagctgtccatgagggtgtgtgtgtgcaggcctggaggagaggaggagtgggtggacagcagcgagctggtgcctggggactgcctggtgctgccccaggagggcggcctgatgccctgtgatgctgccctggtggccggggagtgcatggtgaatgaaagcagcctgactggagagagcatccctgtgctgaagacagccctgcctgagggcctgggcccctactgtgccgagacccacagaagacacaccctcttctgtggcaccctcatcctgcaggcccgggcctacgtgggcccccacgtgctggccgtggtgaccaggacaggcttctgcacagccaagggcggcctggtgagcagcatcctgcacccccggcccatcaacttcaagttctacaagcacagcatgaagtttgtggccgccctgtctgtgctggccctgctgggcaccatctacagcatcttcatcctgtacagaaacagagtgcccctgaatgagatcgtcatccgggccctggacctggtgacagtggtggtgcccccagccctgcctgctgccatgacagtgtgcaccctgtatgcccagagccggctgcggcggcagggcatcttctgcatccaccccctgcgcatcaacctgggcggcaagctgcagctggtgtgctttgacaagacaggcaccctgacagaagatggcctggatgtgatgggcgtggtgcccctgaagggccaggccttcctgcccctggtgcctgagccccggcggctgcctgtgggccccctgctgcgggccctggccacctgccacgccctgagccggctgcaggacacccctgtgggggaccccatggacctgaagatggtggagagcacaggctgggtgctggaggaggagcctgctgctgacagcgccttcggcacccaggtgctggccgtgatgaggcctcccctgtgggagccccagctgcaggccatggaggagccccctgtgcctgtgtctgtgctgcaccgcttccccttcagcagcgccctgcagaggatgtctgtggtggtggcctggccaggggccacccagcctgaggcctacgtgaagggcagccctgagctggtggccggcctgtgcaaccctgagaccgtgcccacagactttgcccagatgctgcagagctacacagctgctggctacagagtggtggccctggccagcaagcccctgcccaccgtgcccagcctggaggccgcccagcagctgacccgggacacagtggagggggacctgagcctgctgggcctgctggtgatgaggaacctgctgaagccccagaccacccctgtgatccaggccctgcggaggacccgcatccgggctgtgatggtgactggagacaacctgcagacagctgtgacagtggcccggggctgcggcatggtggccccccaggagcacctgatcatcgtgcacgccacccaccctgagcggggccagcctgccagcctggagttcctgcccatggagagccccacagctgtgaatggagtgaaggtgctggtgcagggcaccgtgtttgccaggatggcccctgagcagaagacagagctggtgtgtgagctgcagaagctgcagtactgtgtgggcatgtgtggagatggagccaatgactgtggggccctgaaggctgctgatgtgggcatcagcctgagccaggccgaggcctctgtggtgagccccttcaccagctccatggccagcattgaatgtgtgcccatggtgatccgggagggccgctgcagcctggacaccagcttcagcgtcttcaagtacatggccctgtacagcctgacccagttcatctctgtgctgatcctgtacaccatcaacaccaacctgggggacctgcagttcctggccatcgacctggtgatcaccaccaccgtggccgtgctgatgagcaggactggacctgccctggtgctgggccgggtgcggcccccaggggccctgctgtctgtgcctgtgctgagcagcctgctgctgcagatggtgctggtgactggagtgcagctgggcggctacttcctgaccctggcccagccctggtttgtgcccctgaacagaacagtggccgccccagacaacctgcccaactatgagaacacagtggtgttcagcctgagcagcttccagtacctgatcctggccgctgctgtgtccaaaggagcccccttccggcggcccctgtacaccaatgaaagagcccggcctgtgcccccccggctgcctgcccctcctccagcccaggccggcctgcaggaggccctgcaggccgccggcaccagggctggccgggccgccctggccgctgctgcccggcggcccccagaggtggtgcaggcccacggccaccccaggcactggaacagcctgcccctgagccaccagctggaccccagccctgccaccccacctcctcctccacccaccagcctgcggctggccaccgtgtacaccccaccaccccggcccccaccaccctggggctctgtggactactgccccctgccctggaccatcccccggcggggcggcagcccccagctgcccagcgtgctgctgtctgtgtag

SEQ ID NO: 144348 - DNA, 3528 bp, Artificial Sequence
  Description of Artificial Sequence: Synthetic coding sequence
atgtctgctgacagcagccccctggtgggcagcacccccaccggctacggcaccctgaccatcggcaccagcattgaccccctgagcagctctgtgtcctctgtgcggctgagcggctactgcggcagcccctggagggtcatcggctaccacgtggtggtgtggatgatggccggcatccccctgctgctcttccgctggaagcccctgtggggcgtgcggctgcggctgcggccctgcaacctggcccatgctgagaccctggtgattgagatccgggacaaggaggacagctcctggcagctgttcaccgtgcaggtgcagacagaggccatcggggagggcagcctggagcccagcccccagagccaggccgaggatggccgcagccaggccgctgtgggcgctgtgcctgagggcgcctggaaggacacagcccagctgcacaagtctgaggaggccaagagggtgctgcgctactacctgttccagggccagcgctacatctggattgagacccagcaggccttctaccaggtgtccctgctggaccacggccgcagctgtgatgatgtgcacaggagcagacatggcctgagcctgcaggaccagatggtgaggaaggccatctacggccccaacgtcatcagcatccctgtgaagagctacccccagctgctggtggatgaggccctgaacccctactacggcttccaggccttcagcatcgccctgtggctggccgaccactactactggtacgccctgtgcatcttcctgatcagcagcatcagcatctgcctgagcctgtacaagaccaggaagcagagccagaccctgcgggacatggtgaagctgtccatgagggtgtgtgtgtgcaggcctggaggagaggaggagtgggtggacagcagcgagctggtgcctggggactgcctggtgctgccccaggagggcggcctgatgccctgtgatgctgccctggtggccggggagtgcatggtgaatgaaagcagcctgactggagagagcatccctgtgctgaagacagccctgcctgagggcctgggcccctactgtgccgagacccacagaagacacaccctcttctgtggcaccctcatcctgcaggcccgggcctacgtgggcccccacgtgctggccgtggtgaccaggacaggcttctgcacagccaagggcggcctggtgagcagcatcctgcacccccggcccatcaacttcaagttctacaagcacagcatgaagtttgtggccgccctgtctgtgctggccctgctgggcaccatctacagcatcttcatcctgtacagaaacagagtgcccctgaatgagatcgtcatccgggccctggacctggtgacagtggtggtgcccccagccctgcctgctgccatgacagtgtgcaccctgtatgcccagagccggctgcggcggcagggcatcttctgcatccaccccctgcgcatcaacctgggcggcaagctgcagctggtgtgctttgacaagacaggcaccctgacagaagatggcctggatgtgatgggcgtggtgcccctgaagggccaggccttcctgcccctggtgcctgagccccggcggctgcctgtgggccccctgctgcgggccctggccacctgccacgccctgagccggctgcaggacacccctgtgggggaccccatggacctgaagatggtggagagcacaggctgggtgctggaggaggagcctgctgctgacagcgccttcggcacccaggtgctggccgtgatgaggcctcccctgtgggagccccagctgcaggccatggaggagccccctgtgcctgtgtctgtgctgcaccgcttccccttcagcagcgccctgcagaggatgtctgtggtggtggcctggccaggggccacccagcctgaggcctacgtgaagggcagccctgagctggtggccggcctgtgcaaccctgagaccgtgcccacagactttgcccagatgctgcagagctacacagctgctggctacagagtggtggccctggccagcaagcccctgcccaccgtgcccagcctggaggccgcccagcagctgacccgggacacagtggagggggacctgagcctgctgggcctgctggtgatgaggaacctgctgaagccccagaccacccctgtgatccaggccctgcggaggacccgcatccgggctgtgatggtgactggagacaacctgcagacagctgtgacagtggcccggggctgcggcatggtggccccccaggagcacctgatcatcgtgcacgccacccaccctgagcggggccagcctgccagcctggagttcctgcccatggagagccccacagctgtgaatggagtgaaggaccctgaccaggccgccagctacacagtggagccagaccccaggagccgccacctggccctgagcggccccaccttcggcatcatcgtgaagcacttccccaagctgctgcccaaggtgctggtgcagggcaccgtgtttgccaggatggcccctgagcagaagacagagctggtgtgtgagctgcagaagctgcagtactgtgtgggcatgtgtggagatggagccaatgactgtggggccctgaaggccgcagatgtgggcatcagcctgagccaggccgaggcctctgtggtgagccccttcaccagctccatggccagcattgaatgtgtgcccatggtgatccgggagggccgctgcagcctggacaccagcttctctgtgttcaagtacatggccctgtacagcctgacccagttcatctctgtgctgatcctgtacaccatcaacaccaacctgggggacctgcagttcctggccatcgacctggtgatcaccaccaccgtggccgtgctgatgagcaggacaggccctgccctggtgctgggccgggtgcggcccccaggggccctgctgtctgtgcctgtgctgagcagcctgctgctgcagatggtgctggtgactggagtgcagctgggcggctacttcctgaccctggcccagccctggtttgtgcccctgaacagaacagtggccgccccagacaacctgcccaactatgaaaatacagtggtgttcagcctgagcagcttccagtacctgatcctggccgctgctgtgtccaagggggcccccttcagaagacccctgtacaccaacgtgcccttcctggtggccctggccctgctgagctctgtgctggtgggcctggtgctggtgcccggcctgctgcagggccccctggccctgaggaacatcacagacaccggcttcaagctgctgctgctgggcctggtgaccctgaactttgtgggcgccttcatgctggagagcgtgctggaccagtgcctgcctgcctgcctgcggcggctgcggcccaagagggccagcaagaagcgcttcaagcagctggagcgggagctggccgagcagccctggccacccctgcctgctggccccctgaggtag

SEQ ID NO: 144349 - DNA, 3372 bp, Artificial Sequence
  Description of Artificial Sequence: Synthetic coding sequence
atgagccgggccacctctgtgggggaccagctggaggccccagcccggaccatctacctgaaccagccccacctgaacaagttccgggacaaccagatcagcacagccaagtacagcgtgctgaccttcctgccccgcttcctgtatgagcagatcagaagagctgccaatgccttcttcctgttcatcgccctgctgcagcagatcccagatgtgagccccaccggccgctacaccaccctggtgcccctcatcatcatcctgaccatcgccggcatcaaggagatcgtggaggacttcaagaggcacaaggctgacaatgctgtgaacaagaagaagaccatcgtgctgagaaatggcatgtggcacaccatcatgtggaaggaggtggccgtgggggacatcgtgaaggtggtgaatggccagtacctgcctgcagatgtggtgctgctgagcagcagcgagccccaggccatgtgctacgtggagacagccaacctggatggagagaccaacctgaagatccggcagggcctgagccacacagctgacatgcagacccgggaggtgctgatgaagctgagcggcaccattgaatgtgagggccccaacagacacctgtatgacttcaccggcaacctgaacctggatggcaagagcctggtggccctgggccctgaccagatcctgctgcggggcacccagctgaggaacacccagtgggtgtttggaattgtggtgtacacaggccatgacaccaagctgatgcagaacagcaccaaggcccccctgaagaggagcaatgtggagaaggtgaccaacgtgcagatcctggtgctgtttggcatcctgctggtgatggccctggtgagcagcgctggggccctgtactggaacagaagccacggggagaagaactggtacatcaagaagatggacaccaccagtgacaactttggctacaacctgctgaccttcatcatcctgtacaacaacctgatccccatcagcctgctggtgaccctggaggtggtgaagtacacccaggccctcttcatcaactgggacacagacatgtactacatcggaaatgacaccccagccatggcccggaccagcaacctgaatgaggagctgggccaggtgaagtacctgttcagtgacaagacaggcaccctgacctgcaacatcatgaacttcaagaagtgcagcattgctggggtgacctacggccacttccctgagctggcccgggagcccagcagtgatgacttctgcaggatgcccccaccctgcagcgacagctgtgactttgatgacccccggctgctgaagaacatcgaggacagacaccccacagccccctgcatccaggagttcctgaccctgctggccgtgtgccacacagtggtgcctgagaaggatggagacaacatcatctaccaggccagcagcccagatgaagctgccctggtgaagggggccaagaagctgggctttgtgttcaccgcccggacccccttcagcgtcatcatcgaggccatgggccaggagcagaccttcggcatcctgaatgtgctggagttcagcagtgacaggaagaggatgtctgtgattgtgaggacccccagcggccgcctgcggctgtactgcaagggagctgacaacgtcatctttgagcggctgagcaaggacagcaagtacatggaggagaccctgtgccacctggagtactttgccacagagggcctgcggaccctgtgtgtggcctatgctgacctgtctgaaaatgaatatgaggagtggctgaaggtgtaccaggaggccagcaccatcctgaaggaccgggcccagaggctggaggagtgctatgagatcatcgagaagaacctgctgctgctgggcgccacagccatcgaggaccggctgcaggccggcgtgcctgagaccatcgccaccctgctgaaggccgagatcaagatctgggtgctgactggagacaagcaggagacagccatcaacatcggctacagctgccgcctggtgtcccagaacatggccctgatcctgctgaaggaggacagcctggatgccaccagggctgccatcacccagcactgcacagacctgggcaacctgctgggcaaggaaaatgatgtggccctgatcattgatggccacaccctgaagtatgccctgagctttgaggtgcggcgctccttcctggacctggccctgagctgcaaggccgtcatctgctgccgggtgagccccctgcagaagtctgagatcgtggatgtggtgaagaagagggtgaaggccatcaccctggccatcggagatggagccaatgatgtgggcatgatccagacagcccacgtgggcgtgggcatctctggaaatgaaggcatgcaggccaccaacaacagcgactatgccatcgcccagttctcctacctggagaagctgctgctggtgcatggagcctggagctacaacagagtgaccaagtgcatcctgtactgcttctacaagaatgtggtgctgtacatcatcgagatcttcaccgccctgccccccttcaccctgggcatctttgagaggagctgcacccaggagagcatgctgcgcttcccccagctgtacaagatcacccagaatggagagggcttcaacaccaaggtgttctggggccactgcatcaatgccctggtgcacagcctcatcctcttctggttccccatgaaggccctggagcatgacacagtgctgaccagcggccacgccacagactacctgtttgtgggcaacatcgtgtacacctacgtggtggtgacagtgtgcctgaaggccggcctggagaccacagcctggaccaagttcagccacctggccgtgtggggctccatgctgacctggctggtgttcttcggcatctacagcaccatctggcccaccatccccatcgccccagacatgaggggccaggccaccatggtgctgagcagcgcccacttctggctgggcctcttcctggtgcccacagcctgcctgattgaagatgtggcctggagggctgccaagcacacctgcaagaagaccctgctggaggaggtgcaggagctggagaccaagagccgggtgctgggcaaggctgtgctgcgggacagcaatggcaagaggctgaatgaaagagacaggctcatcaagaggctgggcaggaagaccccacccaccctcttccggggcagcagcctgcagcagggcgtgccccacggctacgccttcagccaggaggagcacggggctgtgtcccaggaggaggtgatccgggcctatgacaccaccaagaagaagagcaggaagaagtag

SEQ ID NO: 144350 - DNA, 426 bp, Artificial Sequence
  Description of Artificial Sequence: Synthetic coding sequence
atgagccgggccacctctgtgggggaccagctggaggccccagcccggaccatctacctgaaccagccccacctgaacaagttccgggacaaccagatcagcacagccaagtacagcgtgctgaccttcctgccccgcttcctgtatgagcagatcagaagagctgccaatgccttcttcctgttcatcgccctgctgcagcagatcccagatgtgagccccaccggccgctacaccaccctggtgcccctcatcatcatcctgaccatcgccggcatcaaggagatcgtggaggacttcaagaggcacaaggctgacaatgctgtgaacaagaagaagaccatcgtgctgagaaatggcatgtggcacaccatcatgtggaaggaggagaacagcccccccttcaaggagatcagccccctgtag

SEQ ID NO: 144351 - DNA, 3567 bp, Artificial Sequence
  Description of Artificial Sequence: Synthetic coding sequence
atgctgaatggagctggcctggacaaggccctgaagatgagcctgcccaggaggagccgcatccgcagctctgtgggccctgtgcgcagcagcctgggctacaagaaggccgaggatgagatgagccgggccacctctgtgggggaccagctggaggccccagcccggaccatctacctgaaccagccccacctgaacaagttccgggacaaccagatcagcacagccaagtacagcgtgctgaccttcctgccccgcttcctgtatgagcagatcagaagagctgccaatgccttcttcctgttcatcgccctgctgcagcagatcccagatgtgagccccaccggccgctacaccaccctggtgcccctcatcatcatcctgaccatcgccggcatcaaggagatcgtggaggacttcaagaggcacaaggctgacaatgctgtgaacaagaagaagaccatcgtgctgagaaatggcatgtggcacaccatcatgtggaaggaggtggccgtgggggacatcgtgaaggtggtgaatggccagtacctgcctgcagatgtggtgctgctgagcagcagcgagccccaggccatgtgctacgtggagacagccaacctggatggagagaccaacctgaagatccggcagggcctgagccacacagctgacatgcagacccgggaggtgctgatgaagctgagcggcaccattgaatgtgagggccccaacagacacctgtatgacttcaccggcaacctgaacctggatggcaagagcctggtggccctgggccctgaccagatcctgctgcggggcacccagctgaggaacacccagtgggtgtttggaattgtggtgtacacaggccatgacaccaagctgatgcagaacagcaccaaggcccccctgaagaggagcaatgtggagaaggtgaccaacgtgcagatcctggtgctgtttggcatcctgctggtgatggccctggtgagcagcgctggggccctgtactggaacagaagccacggggagaagaactggtacatcaagaagatggacaccaccagtgacaactttggctacaacctgctgaccttcatcatcctgtacaacaacctgatccccatcagcctgctggtgaccctggaggtggtgaagtacacccaggccctcttcatcaactgggacacagacatgtactacatcggaaatgacaccccagccatggcccggaccagcaacctgaatgaggagctgggccaggtgaagtacctgttcagtgacaagacaggcaccctgacctgcaacatcatgaacttcaagaagtgcagcattgctggggtgacctacggccacttccctgagctggcccgggagcccagcagtgatgacttctgcaggatgcccccaccctgcagcgacagctgtgactttgatgacccccggctgctgaagaacatcgaggacagacaccccacagccccctgcatccaggagttcctgaccctgctggccgtgtgccacacagtggtgcctgagaaggatggagacaacatcatctaccaggccagcagcccagatgaagctgccctggtgaagggggccaagaagctgggctttgtgttcaccgcccggacccccttcagcgtcatcatcgaggccatgggccaggagcagaccttcggcatcctgaatgtgctggagttcagcagtgacaggaagaggatgtctgtgattgtgaggacccccagcggccgcctgcggctgtactgcaagggagctgacaacgtcatctttgagcggctgagcaaggacagcaagtacatggaggagaccctgtgccacctggagtactttgccacagagggcctgcggaccctgtgtgtggcctatgctgacctgtctgaaaatgaatatgaggagtggctgaaggtgtaccaggaggccagcaccatcctgaaggaccgggcccagaggctggaggagtgctatgagatcatcgagaagaacctgctgctgctgggcgccacagccatcgaggaccggctgcaggccggcgtgcctgagaccatcgccaccctgctgaaggccgagatcaagatctgggtgctgactggagacaagcaggagacagccatcaacatcggctacagctgccgcctggtgtcccagaacatggccctgatcctgctgaaggaggacagcctggatgccaccagggctgccatcacccagcactgcacagacctgggcaacctgctgggcaaggaaaatgatgtggccctgatcattgatggccacaccctgaagtatgccctgagctttgaggtgcggcgctccttcctggacctggccctgagctgcaaggccgtcatctgctgccgggtgagccccctgcagaagtctgagatcgtggatgtggtgaagaagagggtgaaggccatcaccctggccatcggagatggagccaatgatgtgggcatgatccagacagcccacgtgggcgtgggcatctctggaaatgaaggcatgcaggccaccaacaacagcgactatgccatcgcccagttctcctacctggagaagctgctgctggtgcatggagcctggagctacaacagagtgaccaagtgcatcctgtactgcttctacaagaatgtggtgctgtacatcatcgagctgtggtttgcctttgtgaatggcttcagcggccagatcctgtttgagcgctggtgcatcggcctgtacaacgtcatcttcaccgccctgccccccttcaccctgggcatctttgagaggagctgcacccaggagagcatgctgcgcttcccccagctgtacaagatcacccagaatggagagggcttcaacaccaaggtgttctggggccactgcatcaatgccctggtgcacagcctcatcctcttctggttccccatgaaggccctggagcatgacacagtgctgaccagcggccacgccacagactacctgtttgtgggcaacatcgtgtacacctacgtggtggtgacagtgtgcctgaaggccggcctggagaccacagcctggaccaagttcagccacctggccgtgtggggctccatgctgacctggctggtgttcttcggcatctacagcaccatctggcccaccatccccatcgccccagacatgaggggccaggccaccatggtgctgagcagcgcccacttctggctgggcctcttcctggtgcccacagcctgcctgattgaagatgtggcctggagggctgccaagcacacctgcaagaagaccctgctggaggaggtgcaggagctggagaccaagagccgggtgctgggcaaggctgtgctgcgggacagcaatggcaagaggctgaatgaaagagacaggctcatcaagaggctgggcaggaagaccccacccaccctcttccggggcagcagcctgcagcagggcgtgccccacggctacgccttcagccaggaggagcacggggctgtgtcccaggaggaggtgatccgggcctatgacaccaccaagaagaagagcaggaagaagtag

SEQ ID NO: 144352 - DNA, 2907 bp, Artificial Sequence
  Description of Artificial Sequence: Synthetic coding sequence
atgcgctgccccggcccccggctgctggagacctcctggaggcaccccccagcccccttcaccagcaccaacagacacctgtatgacttcaccggcaacctgaacctggatggcaagagcctggtggccctgggccctgaccagatcctgctgcggggcacccagctgaggaacacccagtgggtgtttggaattgtggtgtacacaggccatgacaccaagctgatgcagaacagcaccaaggcccccctgaagaggagcaatgtggagaaggtgaccaacgtgcagatcctggtgctgtttggcatcctgctggtgatggccctggtgagcagcgctggggccctgtactggaacagaagccacggggagaagaactggtacatcaagaagatggacaccaccagtgacaactttggctacaacctgctgaccttcatcatcctgtacaacaacctgatccccatcagcctgctggtgaccctggaggtggtgaagtacacccaggccctcttcatcaactgggacacagacatgtactacatcggaaatgacaccccagccatggcccggaccagcaacctgaatgaggagctgggccaggtgaagtacctgttcagtgacaagacaggcaccctgacctgcaacatcatgaacttcaagaagtgcagcattgctggggtgacctacggccacttccctgagctggcccgggagcccagcagtgatgacttctgcaggatgcccccaccctgcagcgacagctgtgactttgatgacccccggctgctgaagaacatcgaggacagacaccccacagccccctgcatccaggagttcctgaccctgctggccgtgtgccacacagtggtgcctgagaaggatggagacaacatcatctaccaggccagcagcccagatgaagctgccctggtgaagggggccaagaagctgggctttgtgttcaccgcccggacccccttcagcgtcatcatcgaggccatgggccaggagcagaccttcggcatcctgaatgtgctggagttcagcagtgacaggaagaggatgtctgtgattgtgaggacccccagcggccgcctgcggctgtactgcaagggagctgacaacgtcatctttgagcggctgagcaaggacagcaagtacatggaggagaccctgtgccacctggagtactttgccacagagggcctgcggaccctgtgtgtggcctatgctgacctgtctgaaaatgaatatgaggagtggctgaaggtgtaccaggaggccagcaccatcctgaaggaccgggcccagaggctggaggagtgctatgagatcatcgagaagaacctgctgctgctgggcgccacagccatcgaggaccggctgcaggccggcgtgcctgagaccatcgccaccctgctgaaggccgagatcaagatctgggtgctgactggagacaagcaggagacagccatcaacatcggctacagctgccgcctggtgtcccagaacatggccctgatcctgctgaaggaggacagcctggatgccaccagggctgccatcacccagcactgcacagacctgggcaacctgctgggcaaggaaaatgatgtggccctgatcattgatggccacaccctgaagtatgccctgagctttgaggtgcggcgctccttcctggacctggccctgagctgcaaggccgtcatctgctgccgggtgagccccctgcagaagtctgagatcgtggatgtggtgaagaagagggtgaaggccatcaccctggccatcggagatggagccaatgatgtgggcatgatccagacagcccacgtgggcgtgggcatctctggaaatgaaggcatgcaggccaccaacaacagcgactatgccatcgcccagttctcctacctggagaagctgctgctggtgcatggagcctggagctacaacagagtgaccaagtgcatcctgtactgcttctacaagaatgtggtgctgtacatcatcgagctgtggtttgcctttgtgaatggcttcagcggccagatcctgtttgagcgctggtgcatcggcctgtacaacgtcatcttcaccgccctgccccccttcaccctgggcatctttgagaggagctgcacccaggagagcatgctgcgcttcccccagctgtacaagatcacccagaatggagagggcttcaacaccaaggtgttctggggccactgcatcaatgccctggtgcacagcctcatcctcttctggttccccatgaaggccctggagcatgacacagtgctgaccagcggccacgccacagactacctgtttgtgggcaacatcgtgtacacctacgtggtggtgacagtgtgcctgaaggccggcctggagaccacagcctggaccaagttcagccacctggccgtgtggggctccatgctgacctggctggtgttcttcggcatctacagcaccatctggcccaccatccccatcgccccagacatgaggggccaggccaccatggtgctgagcagcgcccacttctggctgggcctcttcctggtgcccacagcctgcctgattgaagatgtggcctggagggctgccaagcacacctgcaagaagaccctgctggaggaggtgcaggagctggagaccaagagccgggtgctgggcaaggctgtgctgcgggacagcaatggcaagaggctgaatgaaagagacaggctcatcaagaggctgggcaggaagaccccacccaccctcttccggggcagcagcctgcagcagggcgtgccccacggctacgccttcagccaggaggagcacggggctgtgtcccaggaggaggtgatccgggcctatgacaccaccaagaagaagagcaggaagaagtag

SEQ ID NO: 144353 - DNA, 3903 bp, Artificial Sequence
  Description of Artificial Sequence: Synthetic coding sequence
atgggcactggacctgcccagacccccaggagcacccgggccggccctgagcccagccctgcccctcctggccctggggacaccggggacagtgatgtgacccaggagggcagcggccctgctggcatccggggcggggagaccgtcatccgggccggcatgggagacagccctggccgcggggcccctgagaggaggcacaaggcccagcccggccgggccaggaaatatgagtggaggcctgagggccccacctccatgggcagcctgggccagcgggaggacctgcaggatgaagatagaaattctgccttcacctggaaggtgcaggccaacaacagagcctacaacggccagttcaaggagaaggtgatcctgtgctggcagaggaagaagtacaagaccaacgtcatcagaacagccaagtacaacttctacagcttcctgcccctgaacctgtatgagcagttccaccgggtgagcaacctcttcttcctgatcatcatcatcctgcagagcatcccagacatcagcaccctgccctggttcagcctgagcacccccatggtgtgcctgctcttcatccgggccacccgggacctggtggatgacatgggccgccacaagagtgaccgggccatcaacaaccggccctgccagatcctgatgggcaagagcttcaagcagaagaagtggcaggacctgtgtgtgggagatgtggtgtgcctgaggaaggacaacatcgtgcctgctgacatgctgctgctggccagcacagagcccagcagcctgtgctacgtggagaccgtggacattgatggagagaccaacctgaagttccggcaggccctgatggtgacccacaaggagctggccaccatcaagaagatggccagcttccagggcaccgtgacctgtgaggcccccaacagcaggatgcaccactttgtgggctgcctggagtggaatgacaagaagtacagcctggacatcggcaacctgctgctgcggggctgccgcatccggaacacagacacctgctacggcctggtgatctatgccggctttgacaccaagatcatgaagaactgtgggaagatccacctgaagaggaccaagctggacctgctgatgaacaagctggtggtggtgatcttcatctctgtggtgctggtgtgcctggtgctggccttcggcttcggcttctctgtgaaggagttcaaggaccaccactactacctgtctggagtgcacggcagctctgtggccgctgagagcttctttgtgttctggagcttcctgatcctgctgtctgtgaccatccccatgtccatgttcatcctgtctgagttcatctacctgggcaacagcgtcttcatcgactgggatgtgcagatgtactacaagccccaggatgtgcctgccaaggcccggagcaccagcctgaatgaccacctgggccaggtggagtacatcttcagtgacaagacaggcaccctgacccagaacatcctgaccttcaacaagtgctgcatcagcggccgggtgtatggcccagattctgaggccaccacccggcccaaggagaacccctacctgtggaacaagtttgctgatggcaagctgctcttccacaatgctgccctgctgcacctggtgaggaccaatggagatgaggccgtgcgggagttctggaggctgctggccatctgccacacagtgatggtgcgggagagcccccgggagaggccagaccagctgctgtaccaggccgccagcccagatgaaggagccctggtgacagctgccaggaactttggctacgtgttcctgagcaggacccaggacacagtgaccatcatggagctgggggaggagcgggtgtaccaggtgctggccatcatggacttcaacagcaccaggaagaggatgtctgtgctggtgaggaagccagagggcgccatctgcctgtacaccaagggagctgacaccgtcatctttgagcggctgcaccggcggggggccatggagtttgccacagaggaggccctggccgcctttgcccaggagaccctgcggaccctgtgcctggcctaccgggaggtggccgaggacatctatgaggactggcagcagaggcaccaggaggccagcctgctgctgcagaacagagcccaggccctgcagcagctgctgggcgccacagccatcgaggaccggctgcaggatggagtgcctgagaccatcaagtgcctgaagaagagcaacatcaagatctgggtgctgactggagacaagcaggagacagctgtgaacattggatttgcctgtgagctgctgtctgagaacatgctgatcctggaggagaaggagatcagccgcatcctggagacctactgggagaacagcaacaacctgctgacccgggagagcctgagccaggtgaagctggccctggtgatcaacggggacttcctggacaagctgctggtgtccctgaggaaggagccccgggccctggcccagaatgtgaacatggatgaggcctggcaggagctgggccagagcagaagagacttcctgtatgcccggcggctgagcctgctgtgcagaagatttggcctgcccctggccgcccccccagcccaggacagccgggcccggcgcagcagcgaggtgctgcaggagcgggcctttgtggacctggccagcaagtgccaggccgtcatctgctgccgggtgacccccaagcagaaggccctgattgtggccctggtgaagaagtaccaccaggtggtgaccctggccatcggagatggagccaatgacatcaacatgatcaagacagcagatgtgggcgtgggcctggccggccaggagggcatgcaggccgtgcagaacagcgactttgtgctgggccagttctgcttcctgcagaggctgctgctggtgcacggccgctggagctatgtgcgcatctgcaagttcctgcgctacttcttctacaagtccatggcctccatgatggtgcaggtgtggtttgcctgctacaacggcttcaccggccagcccctgtatgagggctggttcctggccctcttcaacctgctgtacagcaccctgcctgtgctgtacatcggcctgtttgagcaggatgtgtctgctgagcagagcctggagaagccagagctgtatgtggtgggccagaaggatgagctgttcaactactgggtgtttgtgcaggccatcgcccatggagtgaccaccagcctggtgaacttcttcatgaccctgtggatcagccgggacacagctggccctgccagcttcagtgaccaccagagctttgctgtggtggtggccctgagctgcctgctgagcatcaccatggaggtgatcctgatcatcaagtactggacagccctgtgtgtggccaccatcctgctgagcctgggcttctacgccatcatgaccaccaccacccagagcttctggctgttccgggtgagccccaccaccttccccttcctgtatgctgacctgtctgtgatgagcagccccagcatcctgctggtggtgctgctgtctgtgtccatcaacaccttccctgtgctggccctgcgggtcatcttccctgccctgaaggagctgcgggccaaggaggagaaggtggaggagggccccagcgaggagatcttcaccatggagcccctgccccacgtgcaccgggagagccgggcccggcgcagcagctatgccttcagccaccgggagggctacgccaacctgatcacccagggcaccatcctgcggcggggccctggggtgtccagtgacatcgccagcgagagcctggaccccagtgatgaggaggccgccagcagccccaaggagagccagtag

SEQ ID NO: 144354 - DNA, 1737 bp, Artificial Sequence
  Description of Artificial Sequence: Synthetic coding sequence
atgggagacagccctggccgcggggcccctgagcggcggcacaaggcccagcccggccgggccaggaaatatgagtggaggcctgagggccccacctccatgggcagcctgggccagcgggaggacctgcaggatgaggacaggaacagcgccttcacctggaaggtgcaggccaacaacagagcctacaacggccagttcaaggagaaggtgatcctgtgctggcagaggaagaagtacaagaccaacgtcatcagaacagccaagtacaacttctacagcttcctgcccctgaacctgtatgagcagttccaccgggtgagcaacctcttcttcctgatcatcatcatcctgcagagcatcccagacatcagcaccctgccctggttcagcctgagcacccccatggtgtgcctgctcttcatccgggccacccgggacctggtggatgacatgggccgccacaagagtgaccgggccatcaacaaccggccctgccagatcctgatgggcaagagcttcaagcagaagaagtggcaggacctgtgtgtgggagatgtggtgtgcctgaggaaggacaacatcgtgcctgctgacatgctgctgctggccagcacagagcccagcagcctgtgctacgtggagaccgtggacattgatggagagaccaacctgaagttccggcaggccctgatggtgacccacaaggagctggccaccatcaagaagatggccagcttccagggcaccgtgacctgtgaggcccccaacagcaggatgcaccactttgtgggctgcctggagtggaatgacaagaagtacagcctggacatcggcaacctgctgctgcggggctgccgcatccggaacacagacacctgctacggcctggtgatctatgccggctttgacaccaagatcatgaagaactgtgggaagatccacctgaagaggaccaagctggacctgctgatgaacaagctggtggtggtgatcttcatctctgtggtgctggtgtgcctggtgctggcctttggatttggcttctctgtgaaggagttcaaggaccaccactactacctgagcggcgtgcacggcagctctgtggccgctgagagcttctttgtgttctggagcttcctgatcctgctgtctgtgaccatccccatgtccatgttcatcctgtctgagttcatctacctgggcaacagcgtcttcatcgactgggatgtgcagatgtactacaagccccaggatgtgcctgccaaggcccggagcaccagcctgaatgaccacctgggccaggtggagtacatcttcagtgacaagacaggcaccctgacccagaacatcctgaccttcaacaagtgctgcatcagcggccgggtgtatggagctgcccccaccccagagctgcctgctggcagcagcatcttcaagggcctgcgggtgcctgagaaccagagccacgtgtggccccacgcccagcacctgcggcccaacctgaaccagggcaccgtggcccgctggccaggcttcctgtggaggggccctgggaagttcttcttcttcctgcggcagagcctgaccctgagcacccaggccggcatgcagtggtgcaacctgggcagcctgcagagccccccaccccgcttcaagcgcttctcctggctgagcctgcccagctcctgggactaccgccacctgcccccccacctgatcttcctgtacttctag

SEQ ID NO: 144355 - DNA, 3792 bp, Artificial Sequence
  Description of Artificial Sequence: Synthetic coding sequence
atgggagacagccctggccgcggggcccctgagcggcggcacaaggcccagcccggccgggccaggaaatatgagtggaggcctgagggccccacctccatgggcagcctgggccagcgggaggacctgcaggatgaggacaggaacagcgccttcacctggaaggtgcaggccaacaacagagcctacaacggccagttcaaggagaaggtgatcctgtgctggcagaggaagaagtacaagaccaacgtcatcagaacagccaagtacaacttctacagcttcctgcccctgaacctgtatgagcagttccaccgggtgagcaacctcttcttcctgatcatcatcatcctgcagagcatcccagacatcagcaccctgccctggttcagcctgagcacccccatggtgtgcctgctcttcatccgggccacccgggacctggtggatgacatgggccgccacaagagtgaccgggccatcaacaaccggccctgccagatcctgatgggcaagagcttcaagcagaagaagtggcaggacctgtgtgtgggagatgtggtgtgcctgaggaaggacaacatcgtgcctgctgacatgctgctgctggccagcacagagcccagcagcctgtgctacgtggagaccgtggacattgatggagagaccaacctgaagttccggcaggccctgatggtgacccacaaggagctggccaccatcaagaagatggccagcttccagggcaccgtgacctgtgaggcccccaacagcaggatgcaccactttgtgggctgcctggagtggaatgacaagaagtacagcctggacatcggcaacctgctgctgcggggctgccgcatccggaacacagacacctgctacggcctggtgatctatgcagatggctacatgtttgtgggctttgacaccaagatcatgaagaactgtgggaagatccacctgaagaggaccaagctggacctgctgatgaacaagctggtggtggtgatcttcatctctgtggtgctggtgtgcctggtgctggcctttggatttggcttctctgtgaaggagttcaaggaccaccactactacctgagcggcgtgcacggcagctctgtggccgctgagagcttctttgtgttctggagcttcctgatcctgctgtctgtgaccatccccatgtccatgttcatcctgtctgagttcatctacctgggcaacagcgtcttcatcgactgggatgtgcagatgtactacaagccccaggatgtgcctgccaaggcccggagcaccagcctgaatgaccacctgggccaggtggagtacatcttcagtgacaagacaggcaccctgacccagaacatcctgaccttcaacaagtgctgcatcagcggccgggtgtatggccctgacagcgaggccaccacccggcccaaggagaacccctacctgtggaacaagtttgctgatggcaagctgctcttccacaatgctgccctgctgcacctggtgaggaccaatggagatgaagctgtgcgggagttctggaggctgctggccatctgccacacagtgatggtgcgggagagcccccgggagaggccagaccagctgctgtaccaggccgccagcccagatgagggcgccctggtgacagctgccaggaactttggctacgtgttcctgagcaggacccaggacacagtgaccatcatggagctgggggaggagcgggtgtaccaggtgctggccatcatggacttcaacagcaccaggaagaggatgtctgtgctggtgaggaagccagagggcgccatctgcctgtacaccaagggagctgacaccgtcatctttgagcggctgcacagaagaggagccatggagtttgccacagaggaggccctggccgcctttgcccaggagaccctgcggaccctgtgcctggcctaccgggaggtggccgaggacatctatgaggactggcagcagaggcaccaggaggccagcctgctgctgcagaacagagcccaggccctgcagcaggtgtacaatgagatggagcaggacctgcggctgctgggcgccacagccattgaagatcggctgcaggatggagtgcctgagaccatcaagtgcctgaagaagagcaacatcaagatctgggtgctgaccggggacaagcaggagacagctgtgaacatcggctttgcctgtgagctgctgtctgagaacatgctgatcctggaggagaaggagatcagccgcatcctggagacctactgggagaacagcaacaacctgctgacccgggagagcctgagccaggtgaagctggccctggtgatcaatggagacttcctggacaagctgctggtgtccctgaggaaggagccccgggccctggcccagaatgtgaacatggatgaggcctggcaggagctgggccagagccggcgggacttcctgtatgcccggcggctgagcctgctgtgccgccgcttcggcctgcccctggccgcccccccagcccaggacagccgggcccggcgcagcagcgaggtgctgcaggagcgggcctttgtggacctggccagcaagtgccaggccgtcatctgctgccgggtgacccccaagcagaaggccctgattgtggccctggtgaagaagtaccaccaggtggtgaccctggccatcggagatggagccaatgacatcaacatgatcaagacagcagatgtgggcgtgggcctggccggccaggagggcatgcaggccgtgcagaacagcgactttgtgctgggccagttctgcttcctgcagaggctgctgctggtgcacggccgctggagctatgtgcgcatctgcaagttcctgcgctacttcttctacaagtccatggcctccatgatggtgcaggtgtggtttgcctgctacaacggcttcaccggccagcccctgtatgagggctggttcctggccctcttcaacctgctgtacagcaccctgcctgtgctgtacatcggcctgtttgagcaggatgtgtctgctgagcagagcctggagaagccagagctgtatgtggtgggccagaaggatgagctgttcaactactgggtgtttgtgcaggccatcgcccacggcgtgaccaccagcctggtgaacttcttcatgaccctgtggatcagccgggacacagctggccctgccagcttcagtgaccaccagagctttgctgtggtggtggccctgagctgcctgctgagcatcaccatggaggtgatcctgatcatcaagtactggacagccctgtgtgtggccaccatcctgctgagcctgggcttctacgccatcatgaccaccaccacccagagcttctggctgttccgggtgagccccaccaccttccccttcctgtatgctgacctgtctgtgatgagcagccccagcatcctgctggtggtgctgctgtctgtgtccatcaacaccttccctgtgctggccctgcgggtcatcttccctgccctgaaggagctgcgggccaaggaggagaaggtggaggagggccccagcgaggagatcttcaccatggagcccctgccccacgtgcaccgggagagccgggcccggcgcagcagctatgccttcagccaccgggagggctacgccaacctgatcacccagggcaccatcctgcggcggggccctggggtgtccagtgacatcgccagcgagagcctggaccccagtgatgaggaggccgccagcagccccaaggagagccagtag

SEQ ID NO: 144356 - DNA, 3933 bp, Artificial Sequence
  Description of Artificial Sequence: Synthetic coding sequence
atgggcactggacctgcccagacccccaggagcacccgggccggccctgagcccagccctgcccctcctggccctggggacaccggggacagtgatgtgacccaggagggcagcggccctgctggcatccggggcggggagaccgtcatccgggccggcatgggagacagccctggccgcggggcccctgagaggaggcacaaggcccagcccggccgggccaggaaatatgagtggaggcctgagggccccacctccatgggcagcctgggccagcgggaggacctgcaggatgaagatagaaattctgccttcacctggaaggtgcaggccaacaacagagcctacaacggccagttcaaggagaaggtgatcctgtgctggcagaggaagaagtacaagaccaacgtcatcagaacagccaagtacaacttctacagcttcctgcccctgaacctgtatgagcagttccaccgggtgagcaacctcttcttcctgatcatcatcatcctgcagagcatcccagacatcagcaccctgccctggttcagcctgagcacccccatggtgtgcctgctcttcatccgggccacccgggacctggtggatgacatgggccgccacaagagtgaccgggccatcaacaaccggccctgccagatcctgatgggcaagagcttcaagcagaagaagtggcaggacctgtgtgtgggagatgtggtgtgcctgaggaaggacaacatcgtgcctgctgacatgctgctgctggccagcacagagcccagcagcctgtgctacgtggagaccgtggacattgatggagagaccaacctgaagttccggcaggccctgatggtgacccacaaggagctggccaccatcaagaagatggccagcttccagggcaccgtgacctgtgaggcccccaacagcaggatgcaccactttgtgggctgcctggagtggaatgacaagaagtacagcctggacatcggcaacctgctgctgcggggctgccgcatccggaacacagacacctgctacggcctggtgatctatgccggctttgacaccaagatcatgaagaactgtgggaagatccacctgaagaggaccaagctggacctgctgatgaacaagctggtggtggtgatcttcatctctgtggtgctggtgtgcctggtgctggccttcggcttcggcttctctgtgaaggagttcaaggaccaccactactacctgtctggagtgcacggcagctctgtggccgctgagagcttctttgtgttctggagcttcctgatcctgctgtctgtgaccatccccatgtccatgttcatcctgtctgagttcatctacctgggcaacagcgtcttcatcgactgggatgtgcagatgtactacaagccccaggatgtgcctgccaaggcccggagcaccagcctgaatgaccacctgggccaggtggagtacatcttcagtgacaagacaggcaccctgacccagaacatcctgaccttcaacaagtgctgcatcagcggccgggtgtatggcccagattctgaggccaccacccggcccaaggagaacccctacctgtggaacaagtttgctgatggcaagctgctcttccacaatgctgccctgctgcacctggtgaggaccaatggagatgaggccgtgcgggagttctggaggctgctggccatctgccacacagtgatggtgcgggagagcccccgggagaggccagaccagctgctgtaccaggccgccagcccagatgaaggagccctggtgacagctgccaggaactttggctacgtgttcctgagcaggacccaggacacagtgaccatcatggagctgggggaggagcgggtgtaccaggtgctggccatcatggacttcaacagcaccaggaagaggatgtctgtgctggtgaggaagccagagggcgccatctgcctgtacaccaagggagctgacaccgtcatctttgagcggctgcaccggcggggggccatggagtttgccacagaggaggccctggccgcctttgcccaggagaccctgcggaccctgtgcctggcctaccgggaggtggccgaggacatctatgaggactggcagcagaggcaccaggaggccagcctgctgctgcagaacagagcccaggccctgcagcaggtgtacaatgagatggagcaggacctgcggctgctgggcgccacagccatcgaggaccggctgcaggatggagtgcctgagaccatcaagtgcctgaagaagagcaacatcaagatctgggtgctgactggagacaagcaggagacagctgtgaacattggatttgcctgtgagctgctgtctgagaacatgctgatcctggaggagaaggagatcagccgcatcctggagacctactgggagaacagcaacaacctgctgacccgggagagcctgagccaggtgaagctggccctggtgatcaacggggacttcctggacaagctgctggtgtccctgaggaaggagccccgggccctggcccagaatgtgaacatggatgaggcctggcaggagctgggccagagcagaagagacttcctgtatgcccggcggctgagcctgctgtgcagaagatttggcctgcccctggccgcccccccagcccaggacagccgggcccggcgcagcagcgaggtgctgcaggagcgggcctttgtggacctggccagcaagtgccaggccgtcatctgctgccgggtgacccccaagcagaaggccctgattgtggccctggtgaagaagtaccaccaggtggtgaccctggccatcggagatggagccaatgacatcaacatgatcaagacagcagatgtgggcgtgggcctggccggccaggagggcatgcaggccgtgcagaacagcgactttgtgctgggccagttctgcttcctgcagaggctgctgctggtgcacggccgctggagctatgtgcgcatctgcaagttcctgcgctacttcttctacaagtccatggcctccatgatggtgcaggtgtggtttgcctgctacaacggcttcaccggccagcccctgtatgagggctggttcctggccctcttcaacctgctgtacagcaccctgcctgtgctgtacatcggcctgtttgagcaggatgtgtctgctgagcagagcctggagaagccagagctgtatgtggtgggccagaaggatgagctgttcaactactgggtgtttgtgcaggccatcgcccatggagtgaccaccagcctggtgaacttcttcatgaccctgtggatcagccgggacacagctggccctgccagcttcagtgaccaccagagctttgctgtggtggtggccctgagctgcctgctgagcatcaccatggaggtgatcctgatcatcaagtactggacagccctgtgtgtggccaccatcctgctgagcctgggcttctacgccatcatgaccaccaccacccagagcttctggctgttccgggtgagccccaccaccttccccttcctgtatgctgacctgtctgtgatgagcagccccagcatcctgctggtggtgctgctgtctgtgtccatcaacaccttccctgtgctggccctgcgggtcatcttccctgccctgaaggagctgcgggccaaggaggagaaggtggaggagggccccagcgaggagatcttcaccatggagcccctgccccacgtgcaccgggagagccgggcccggcgcagcagctatgccttcagccaccgggagggctacgccaacctgatcacccagggcaccatcctgcggcggggccctggggtgtccagtgacatcgccagcgagagcctggaccccagtgatgaggaggccgccagcagccccaaggagagccagtag

SEQ ID NO: 144357 - DNA, 3006 bp, Artificial Sequence
  Description of Artificial Sequence: Synthetic coding sequence
atggaggccgcccacgccaagaccacagaagaatgtctggcctactttggagtgtctgagaccaccggcctgaccccagaccaggtgaagaggaacctggagaagtatggcctgaatgagctgcctgctgaggagggcaagaccctgtgggagctggtgattgagcagtttgaggacctgctggtgcgcatcctgctgctggccgcctgcatcagctttgtgctggcctggtttgaggagggggaggagaccatcacagcctttgtggagcccttcgtcatcctgctgatcctgattgccaatgccatcgtgggcgtgtggcaggagagaaatgcagaaaatgccatcgaggccctgaaggagtatgagcctgagatgggcaaggtgtacagagctgacaggaagtctgtgcagaggatcaaggcccgggacatcgtgcctggggacatcgtggaggtggccgtgggggacaaggtgcctgctgacatccgcatcctggccatcaagagcaccaccctgcgggtggaccagagcatcctgactggagagagcgtgtctgtcatcaagcacacagagcctgtgcctgaccccagggctgtgaaccaggacaagaagaacatgctgttcagcggcaccaacattgctgctgggaaggccctgggcatcgtggccaccaccggggtgggcacagagatcggcaagatccgggaccagatggccgccacagagcaggacaagacccccctgcagcagaagctggatgaatttggagagcagctgagcaaggtgatcagcctcatctgtgtggccgtgtggctgatcaacatcggccacttcaatgaccctgtgcacggcggctcctggttccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaagatgttcatcatcgacaaggtggatggagacatctgcctgctgaatgagttcagcatcaccggcagcacctacgcccctgagggggaggtgctgaagaatgacaagcctgtgcggcccggccagtatgatggcctggtggagctggccaccatctgtgccctgtgcaatgacagcagcctggacttcaatgaggccaagggcgtgtatgagaaggtgggggaggccacagaaacagccctgaccaccctggtggagaagatgaatgtgttcaacacagatgtgcgcagcctgagcaaggtggagcgggccaatgcctgcaacagcgtcatccggcagctgatgaagaaggagttcaccctggagttcagccgggacaggaagtccatgtctgtgtactgcagccctgccaagagcagcagagctgctgtgggcaacaagatgtttgtgaagggggcccctgagggcgtcatcgaccgctgcaactacgtgcgggtgggcaccaccagggtgcccctgaccggccctgtgaaggagaagatcatggctgtgatcaaggagtggggcaccggccgggacaccctgcgctgcctggccctggccacccgggacaccccacccaagcgggaggagatggtgctggatgattctgcccgcttcctggagtatgaaacagacctgacctttgtgggcgtggtgggcatgctggacccccccaggaaggaggtgacaggcagcatccagctgtgcagagatgctggcatccgggtcatcatgatcactggagacaacaagggcacagccatcgccatctgcagaagaattggcatctttggagaaaatgaggaggtggccgaccgggcctacacaggccgggagtttgatgacctgcccctggccgagcagcgggaggcctgcagaagagcctgctgctttgcccgggtggagcccagccacaagagcaagatcgtggagtacctgcagagctatgatgagatcacagccatgactggagatggagtgaatgatgccccagccctgaagaaggccgagatcggcatcgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcctgcctgaggccctgatccctgtgcagctgctgtgggtgaacctggtgacagatggcctgcctgccacagccctgggcttcaaccccccagacctggacatcatggaccggccccccaggagccccaaggagcccctcatcagcggctggctgttcttccgctacatggccatcggcggctacgtgggcgccgccaccgtgggcgccgccgcctggtggttcctgtatgcagaagatggcccccacgtgaactacagccagctgacccacttcatgcagtgcacagaggacaacacccactttgagggcatcgactgtgaggtgtttgaggcccctgagcccatgaccatggccctgtctgtgctggtgaccatcgagatgtgcaatgccctgaacagcctgtctgagaaccagagcctgctgaggatgccaccctgggtgaacatctggctgctgggcagcatctgcctgtccatgagcctgcacttcctgatcctgtatgtggaccccctgcccatgatcttcaagctgcgggccctggacctgacccagtggctgatggtgctgaagatcagcctgcccgtcatcggcctggatgagatcctgaagtttgtggccaggaactacctggaggaccctgaagatgaaagaaggaagtag

SEQ ID NO: 144358 - DNA, 2535 bp, Artificial Sequence
  Description of Artificial Sequence: Synthetic coding sequence
aagagaagaaatcctggccggcaggccgtgggccacacagaagaagatcctccccgggtgggcaccccctggaaggagcacacaggccctggcccccaggagggcagcaccatggaggccgcccacgccaagaccacagaggagtgcctggcctactttggagtgtctgagaccaccggcctgaccccagaccaggtgaagaggaacctggagaagtatggcctgaatgagctgcctgctgaggagggcaagaccctgtgggagctggtgattgagcagtttgaggacctgctggtgcgcatcctgctgctggccgcctgcatcagctttgtgctggcctggtttgaggagggggaggagaccatcacagcctttgtggagccctttgtgatcctgctgatcctgattgccaatgccatcgtgggcgtgtggcaggagagaaatgcagaaaatgccatcgaggccctgaaggagtatgagcctgagatgggcaaggtgtacagagctgacaggaagtctgtgcagaggatcaaggcccgggacatcgtgcctggggacatcgtggaggtggccgtgggggacaaggtgcctgctgacatccgcatcctggccatcaagagcaccaccctgcgggtggaccagagcatcctgaccggggagagcgtgtctgtcatcaagcacacagagcctgtgcctgaccccagggctgtgaaccaggacaagaagaacatgctgttcagcggcaccaacattgctgctgggaaggccctgggcatcgtggccaccactggagtgggcacagaaattggcaagatccgggaccagatggccgccacagagcaggacaagacccccctgcagcagaagctggatgaatttggagagcagctgagcaaggtgatcagcctcatctgtgtggccgtgtggctgatcaacatcggccacttcaatgaccctgtgcatggaggctcctggttccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaagatgttcatcatcgacaaggtggatggagacatctgcctgctgaatgagttcagcatcaccggcagcacctacgcccctgagggggaggtgctgaagaatgacaagcctgtgcggcccggccagtatgatggcctggtggagctggccaccatctgtgccctgtgcaatgacagcagcctggacttcaatgaggccaagggcgtgtatgagaaggtgggggaggccacagaaacagccctgaccaccctggtggagaagatgaatgtgttcaacacagatgtgcgcagcctgagcaaggtggagcgggccaatgcctgcaacagcgtcatccggcagctgatgaagaaggagttcaccctggagttcagccgggacaggaagtccatgtctgtgtactgcagccctgccaagagcagcagagctgctgtgggcaacaagatgtttgtgaagggggcccctgagggcgtgattgaccgctgcaactacgtgcgggtgggcaccaccagggtgcccctgactggacctgtgaaggagaagatcatggccgtcatcaaggagtggggcaccggccgggacaccctgcgctgcctggccctggccacccgggacaccccacccaagcgggaggagatggtgctggatgacagcgcccgcttcctggagtatgaaacagacctgacctttgtgggcgtggtgggcatgctggacccccccaggaaggaggtgacaggcagcatccagctgtgcagagatgctggcatccgggtcatcatgatcaccggggacaacaagggcacagccatcgccatctgccgccgcatcggcatctttggagaaaatgaggaggtggccgaccgggcctacacaggccgggagtttgatgacctgcccctggccgagcagcgggaggcctgccggcgggcctgctgctttgcccgggtggagcccagccacaagagcaagatcgtggagtacctgcagagctatgatgagatcacagccatgactggagatggagtgaatgatgccccagccctgaagaaggccgagattggaattgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcctgcctgaggccctgatccctgtgcagctgctgtgggtgaacctggtgacagactgtgccgagctgctgatctactag

SEQ ID NO: 144359 - DNA, 2985 bp, Artificial Sequence
  Description of Artificial Sequence: Synthetic coding sequence
atggaggccgcccacgccaagaccacagaagaatgtctggcctactttggagtgtctgagaccaccggcctgaccccagaccaggtgaagaggaacctggagaagtatggcctgaatgagctgcctgctgaggagggcaagaccctgtgggagctggtgattgagcagtttgaggacctgctggtgcgcatcctgctgctggccgcctgcatcagctttgtgctggcctggtttgaggagggggaggagaccatcacagcctttgtggagcccttcgtcatcctgctgatcctgattgccaatgccatcgtgggcgtgtggcaggagagaaatgcagaaaatgccatcgaggccctgaaggagtatgagcctgagatgggcaaggtgtacagagctgacaggaagtctgtgcagaggatcaaggcccgggacatcgtgcctggggacatcgtggaggtggccgtgggggacaaggtgcctgctgacatccgcatcctggccatcaagagcaccaccctgcgggtggaccagagcatcctgactggagagagcgtgtctgtcatcaagcacacagagcctgtgcctgaccccagggctgtgaaccaggacaagaagaacatgctgttcagcggcaccaacattgctgctgggaaggccctgggcatcgtggccaccaccggggtgggcacagagatcggcaagatccgggaccagatggccgccacagagcaggacaagacccccctgcagcagaagctggatgaatttggagagcagctgagcaaggtgatcagcctcatctgtgtggccgtgtggctgatcaacatcggccacttcaatgaccctgtgcacggcggctcctggttccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaagatgttcatcatcgacaaggtggatggagacatctgcctgctgaatgagttcagcatcaccggcagcacctacgcccctgagggggaggtgctgaagaatgacaagcctgtgcggcccggccagtatgatggcctggtggagctggccaccatctgtgccctgtgcaatgacagcagcctggacttcaatgaggccaagggcgtgtatgagaaggtgggggaggccacagaaacagccctgaccaccctggtggagaagatgaatgtgttcaacacagatgtgcgcagcctgagcaaggtggagcgggccaatgcctgcaacagcgtcatccggcagctgatgaagaaggagttcaccctggagttcagccgggacaggaagtccatgtctgtgtactgcagccctgccaagagcagcagagctgctgtgggcaacaagatgtttgtgaagggggcccctgagggcgtcatcgaccgctgcaactacgtgcgggtgggcaccaccagggtgcccctgaccggccctgtgaaggagaagatcatggctgtgatcaaggagtggggcaccggccgggacaccctgcgctgcctggccctggccacccgggacaccccacccaagcgggaggagatggtgctggatgattctgcccgcttcctggagtatgaaacagacctgacctttgtgggcgtggtgggcatgctggacccccccaggaaggaggtgacaggcagcatccagctgtgcagagatgctggcatccgggtcatcatgatcactggagacaacaagggcacagccatcgccatctgcagaagaattggcatctttggagaaaatgaggaggtggccgaccgggcctacacaggccgggagtttgatgacctgcccctggccgagcagcgggaggcctgcagaagagcctgctgctttgcccgggtggagcccagccacaagagcaagatcgtggagtacctgcagagctatgatgagatcacagccatgactggagatggagtgaatgatgccccagccctgaagaaggccgagatcggcatcgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcctgcctgaggccctgatccctgtgcagctgctgtgggtgaacctggtgacagatggcctgcctgccacagccctgggcttcaaccccccagacctggacatcatggaccggccccccaggagccccaaggagcccctcatcagcggctggctgttcttccgctacatggccatcggcggctacgtgggcgccgccaccgtgggcgccgccgcctggtggttcctgtatgcagaagatggcccccacgtgaactacagccagctgacccacttcatgcagtgcacagaggacaacacccactttgagggcatcgactgtgaggtgtttgaggcccctgagcccatgaccatggccctgtctgtgctggtgaccatcgagatgtgcaatgccctgaacagcctgtctgagaaccagagcctgctgaggatgccaccctgggtgaacatctggctgctgggcagcatctgcctgtccatgagcctgcacttcctgatcctgtatgtggaccccctgcccatgatcttcaagctgcgggccctggacctgacccagtggctgatggtgctgaagatcagcctgcccgtcatcggcctggatgagatcctgaagtttgtggccaggaactacctggagggctag

SEQ ID NO: 144360 - DNA, 2610 bp, Artificial Sequence
  Description of Artificial Sequence: Synthetic coding sequence
atgggcaaggtgtacagagctgacaggaagtctgtgcagaggatcaaggcccgggacatcgtgcctggggacatcgtggaggtggccgtgggggacaaggtgcctgctgacatccgcatcctggccatcaagagcaccaccctgcgggtggaccagagcatcctgaccggggagagcgtgtctgtcatcaagcacacagagcctgtgcctgaccccagggctgtgaaccaggacaagaagaacatgctgttcagcggcaccaacattgctgctgggaaggccctgggcatcgtggccaccactggagtgggcacagaaattggcaagatccgggaccagatggccgccacagagcaggacaagacccccctgcagcagaagctggatgaatttggagagcagctgagcaaggtgatcagcctcatctgtgtggccgtgtggctgatcaacatcggccacttcaatgaccctgtgcatggaggctcctggttccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaagatgttcatcatcgacaaggtggatggagacatctgcctgctgaatgagttcagcatcaccggcagcacctacgcccctgagggggaggtgctgaagaatgacaagcctgtgcggcccggccagtatgatggcctggtggagctggccaccatctgtgccctgtgcaatgacagcagcctggacttcaatgaggccaagggcgtgtatgagaaggtgggggaggccacagaaacagccctgaccaccctggtggagaagatgaatgtgttcaacacagatgtgcgcagcctgagcaaggtggagcgggccaatgcctgcaacagcgtcatccggcagctgatgaagaaggagttcaccctggagttcagccgggacaggaagtccatgtctgtgtactgcagccctgccaagagcagcagagctgctgtgggcaacaagatgtttgtgaagggggcccctgagggcgtgattgaccgctgcaactacgtgcgggtgggcaccaccagggtgcccctgactggacctgtgaaggagaagatcatggccgtcatcaaggagtggggcaccggccgggacaccctgcgctgcctggccctggccacccgggacaccccacccaagcgggaggagatggtgctggatgacagcgcccgcttcctggagtatgaaacagacctgacctttgtgggcgtggtgggcatgctggacccccccaggaaggaggtgacaggcagcatccagctgtgcagagatgctggcatccgggtcatcatgatcaccggggacaacaagggcacagccatcgccatctgccgccgcatcggcatctttggagaaaatgaggaggtggccgaccgggcctacacaggccgggagtttgatgacctgcccctggccgagcagcgggaggcctgccggcgggcctgctgctttgcccgggtggagcccagccacaagagcaagatcgtggagtacctgcagagctatgatgagatcacagccatgactggagatggagtgaatgatgccccagccctgaagaaggccgagattggaattgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcctgcctgaggccctgatccctgtgcagctgctgtgggtgaacctggtgacagatggcctgcctgccacagccctgggcttcaaccccccagacctggacatcatggacaggcctcccaggagccccaaggagcccctcatcagcggctggctgttcttccgctacatggccatcggcggctacgtgggcgccgccaccgtgggcgctgctgcctggtggttcctgtatgcagaagatggcccccacgtgaactacagccagctgacccacttcatgcagtgcacagaggacaacacccactttgagggcatcgactgtgaggtgtttgaggcccctgagcccatgaccatggccctgtctgtgctggtgaccatcgagatgtgcaatgccctgaacagcctgtctgagaaccagagcctgctgaggatgccaccctgggtgaacatctggctgctgggcagcatctgcctgtccatgagcctgcacttcctgatcctgtatgtggaccccctgcccatgatcttcaagctgcgggccctggacctgacccagtggctgatggtgctgaagatcagcctgcctgtgattggcctggatgagatcctgaagtttgtggccaggaactacctggagggctag

SEQ ID NO: 144361 - DNA, 2994 bp, Artificial Sequence
  Description of Artificial Sequence: Synthetic coding sequence
atggagaatgcccacaccaagacagtggaggaggtgctgggccactttggagtgaatgaaagcacaggcctgagcctggagcaggtgaagaagctgaaggagcgctggggcagcaatgagctgcctgctgaggagggcaagaccctgctggagctggtgattgagcagtttgaggacctgctggtgcgcatcctgctgctggccgcctgcatcagctttgtgctggcctggtttgaggagggggaggagaccatcacagcctttgtggagcccttcgtcatcctgctgatcctggtggccaatgccatcgtgggcgtgtggcaggagagaaatgcagaaaatgccatcgaggccctgaaggagtatgagcctgagatgggcaaggtgtaccggcaggacaggaagtctgtgcagaggatcaaggccaaggacatcgtgcctggggacatcgtggagattgctgtgggggacaaggtgcctgctgacatccggctgaccagcatcaagagcaccaccctgcgggtggaccagagcatcctgactggagagagcgtgtctgtcatcaagcacacagatcctgtgcctgaccccagggctgtgaaccaggacaagaagaacatgctgttcagcggcaccaacattgctgctgggaaggccatgggcgtggtggtggccaccggggtgaacacagagatcggcaagatcagagatgagatggtggccacagagcaggagaggacccccctgcagcagaagctggatgaatttggagagcagctgagcaaggtgatcagcctcatctgcatcgctgtgtggatcatcaacatcggccacttcaatgaccctgtgcacggcggctcctggatccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaggatgttcatcctggacagagtggagggggacacctgcagcctgaatgagttcaccatcaccggcagcacctacgcccccatcggggaggtgcacaaggatgacaagcctgtgaactgccaccagtatgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagagctgaagggcctgagcaagattgagcgggccaatgcctgcaacagcgtcatcaagcagctgatgaagaaggagttcaccctggagttcagccgggacaggaagtccatgtctgtgtactgcacccccaacaagcccagcaggacctccatgagcaagatgtttgtgaagggggcccctgagggcgtgattgaccgctgcacccacatccgggtgggcagcaccaaggtgcccatgaccagcggcgtgaagcagaagatcatgtctgtcatccgggagtggggcagcggcagtgacaccctgcgctgcctggccctggccacccatgacaaccccctgcggcgggaggagatgcacctggaggacagcgccaacttcatcaagtatgagaccaacctgacctttgtgggctgtgtgggcatgctggaccccccacgcatcgaggtggccagctctgtgaagctgtgccggcaggccggcatccgggtcatcatgatcaccggggacaacaagggcacagctgtggccatctgccgccgcatcggcatcttcggccaggatgaagatgtgaccagcaaggccttcaccggccgggagtttgatgagctgaaccccagcgcccagagagatgcctgcctgaatgcccgctgctttgcccgggtggagcccagccacaagagcaagatcgtggagttcctgcagagctttgatgagatcacagccatgactggagatggagtgaatgatgccccagccctgaagaaggccgagattggaattgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcttccctgaggccctgatccctgtgcagctgctgtgggtgaacctggtgacagatggcctgcctgccacagccctgggcttcaaccccccagacctggacatcatgaacaagcccccaagaaaccccaaggagcccctcatcagcggctggctgttcttccgctacctggccatcggctgctacgtgggcgccgccaccgtgggcgctgctgcctggtggttcatcgccgcagatggcggcccccgggtgtccttctaccagctgagccacttcctgcagtgcaaggaggacaacccagactttgagggcgtggactgtgccatctttgagagcccctaccccatgaccatggccctgtctgtgctggtgaccatcgagatgtgcaatgccctgaacagcctgtctgagaaccagagcctgctgaggatgccaccctgggagaacatctggctggtgggcagcatctgcctgtccatgagcctgcacttcctgatcctgtatgtggagcccctgcccctcatcttccagatcacccccctgaatgtgacccagtggctgatggtgctgaagatcagcctgcctgtgatcctgatggatgagaccctgaagtttgtggccaggaactacctggagcccgccatcctggagtag

SEQ ID NO: 144362 - DNA, 3048 bp, Artificial Sequence
  Description of Artificial Sequence: Synthetic coding sequence
atggagaatgcccacaccaagacagtggaggaggtgctgggccactttggagtgaatgaaagcacaggcctgagcctggagcaggtgaagaagctgaaggagcgctggggcagcaatgagctgcctgctgaggagggcaagaccctgctggagctggtgattgagcagtttgaggacctgctggtgcgcatcctgctgctggccgcctgcatcagctttgtgctggcctggtttgaggagggggaggagaccatcacagcctttgtggagcccttcgtcatcctgctgatcctggtggccaatgccatcgtgggcgtgtggcaggagagaaatgcagaaaatgccatcgaggccctgaaggagtatgagcctgagatgggcaaggtgtaccggcaggacaggaagtctgtgcagaggatcaaggccaaggacatcgtgcctggggacatcgtggagattgctggggagagcgtgtctgtcatcaagcacacagatcctgtgcctgaccccagggctgtgaaccaggacaagaagaacatgctgttcagcggcaccaacattgctgctgggaaggccatgggcgtggtggtggccactggagtgaacacagaaattggcaagatcagagatgagatggtggccacagagcaggagaggacccccctgcagcagaagctggatgaatttggagagcagctgagcaaggtgatcagcctcatctgcatcgctgtgtggatcatcaacatcggccacttcaatgaccctgtgcatggaggctcctggatccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaggatgttcatcctggacagagtggagggggacacctgcagcctgaatgagttcaccatcaccggcagcacctacgcccccatcggggaggtgcacaaggatgacaagcctgtgaactgccaccagtatgatggcctggtggagctggccaccatctgtgccctgtgcaatgacagcgccctggactacaatgaggccaagggcgtgtatgagaaggtgggggaggccacagaaacagccctgacctgcctggtggagaagatgaatgtgtttgacacagagctgaagggcctgagcaagattgaaagagccaatgcctgcaacagcgtcatcaagcagctgatgaagaaggagttcaccctggagttcagccgggacaggaagtccatgtctgtgtactgcacccccaacaagcccagcaggacctccatgagcaagatgtttgtgaagggggcccctgagggcgtcatcgaccgctgcacccacatccgggtgggcagcaccaaggtgcccatgaccagcggcgtgaagcagaagatcatgtctgtcatccgggagtggggcagcggcagtgacaccctgcgctgcctggccctggccacccatgacaaccccctgcggcgggaggagatgcacctggaggacagcgccaacttcatcaagtatgagaccaacctgacctttgtgggctgtgtgggcatgctggaccccccaagaattgaggtggccagctctgtgaagctgtgccggcaggccggcatccgggtcatcatgatcactggagacaacaagggcacagctgtggccatctgcagaagaattggcatcttcggccaggatgaagatgtgaccagcaaggccttcaccggccgggagtttgatgagctgaaccccagcgcccagagagatgcctgcctgaatgcccgctgctttgcccgggtggagcccagccacaagagcaagatcgtggagttcctgcagagctttgatgagatcacagccatgactggagatggagtgaatgatgccccagccctgaagaaggccgagatcggcatcgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcttccctgaggccctgatccctgtgcagctgctgtgggtgaacctggtgacagatggcctgcctgccacagccctgggcttcaaccccccagacctggacatcatgaacaagccacccaggaaccccaaggagcccctcatcagcggctggctgttcttccgctacctggccatcggctgctacgtgggcgccgccaccgtgggcgccgccgcctggtggttcatcgctgctgatggcggcccccgggtgtccttctaccagctgagccacttcctgcagtgcaaggaggacaacccagactttgaaggagtggactgtgccatctttgagagcccctaccccatgaccatggccctgtctgtgctggtgaccatcgagatgtgcaatgccctgaacagcctgtctgagaaccagagcctgctgaggatgccaccctgggagaacatctggctggtgggcagcatctgcctgtccatgagcctgcacttcctgatcctgtatgtggagcccctgcccctcatcttccagatcacccccctgaatgtgacccagtggctgatggtgctgaagatcagcctgcccgtcatcctgatggatgagaccctgaagtttgtggccaggaactacctggagcccgggaaggaatgtgtgcagcctgccaccaagagctgcagcttcagcgcctgcacagatggcatctcctggccctttgtgctgctgatcatgcccctggtgatctgggtgtacagcacagacaccaacttcagtgacatgttctggagctag

SEQ ID NO: 144363 - DNA, 3129 bp, Artificial Sequence
  Description of Artificial Sequence: Synthetic coding sequence
atggagaatgcccacaccaagacagtggaggaggtgctgggccactttggagtgaatgaaagcacaggcctgagcctggagcaggtgaagaagctgaaggagcgctggggcagcaatgagctgcctgctgaggagggcaagaccctgctggagctggtgattgagcagtttgaggacctgctggtgcgcatcctgctgctggccgcctgcatcagctttgtgctggcctggtttgaggagggggaggagaccatcacagcctttgtggagcccttcgtcatcctgctgatcctggtggccaatgccatcgtgggcgtgtggcaggagagaaatgcagaaaatgccatcgaggccctgaaggagtatgagcctgagatgggcaaggtgtaccggcaggacaggaagtctgtgcagaggatcaaggccaaggacatcgtgcctggggacatcgtggagattgctgtgggggacaaggtgcctgctgacatccggctgaccagcatcaagagcaccaccctgcgggtggaccagagcatcctgactggagagagcgtgtctgtcatcaagcacacagatcctgtgcctgaccccagggctgtgaaccaggacaagaagaacatgctgttcagcggcaccaacattgctgctgggaaggccatgggcgtggtggtggccaccggggtgaacacagagatcggcaagatcagagatgagatggtggccacagagcaggagaggacccccctgcagcagaagctggatgaatttggagagcagctgagcaaggtgatcagcctcatctgcatcgctgtgtggatcatcaacatcggccacttcaatgaccctgtgcacggcggctcctggatccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaggatgttcatcctggacagagtggagggggacacctgcagcctgaatgagttcaccatcaccggcagcacctacgcccccatcggggaggtgcacaaggatgacaagcctgtgaactgccaccagtatgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagagctgaagggcctgagcaagattgagcgggccaatgcctgcaacagcgtcatcaagcagctgatgaagaaggagttcaccctggagttcagccgggacaggaagtccatgtctgtgtactgcacccccaacaagcccagcaggacctccatgagcaagatgtttgtgaagggggcccctgagggcgtgattgaccgctgcacccacatccgggtgggcagcaccaaggtgcccatgaccagcggcgtgaagcagaagatcatgtctgtcatccgggagtggggcagcggcagtgacaccctgcgctgcctggccctggccacccatgacaaccccctgcggcgggaggagatgcacctggaggacagcgccaacttcatcaagtatgagaccaacctgacctttgtgggctgtgtgggcatgctggaccccccacgcatcgaggtggccagctctgtgaagctgtgccggcaggccggcatccgggtcatcatgatcaccggggacaacaagggcacagctgtggccatctgccgccgcatcggcatcttcggccaggatgaagatgtgaccagcaaggccttcaccggccgggagtttgatgagctgaaccccagcgcccagagagatgcctgcctgaatgcccgctgctttgcccgggtggagcccagccacaagagcaagatcgtggagttcctgcagagctttgatgagatcacagccatgactggagatggagtgaatgatgccccagccctgaagaaggccgagattggaattgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcttccctgaggccctgatccctgtgcagctgctgtgggtgaacctggtgacagatggcctgcctgccacagccctgggcttcaaccccccagacctggacatcatgaacaagcccccaagaaaccccaaggagcccctcatcagcggctggctgttcttccgctacctggccatcggctgctacgtgggcgccgccaccgtgggcgctgctgcctggtggttcatcgccgcagatggcggcccccgggtgtccttctaccagctgagccacttcctgcagtgcaaggaggacaacccagactttgagggcgtggactgtgccatctttgagagcccctaccccatgaccatggccctgtctgtgctggtgaccatcgagatgtgcaatgccctgaacagcctgtctgagaaccagagcctgctgaggatgccaccctgggagaacatctggctggtgggcagcatctgcctgtccatgagcctgcacttcctgatcctgtatgtggagcccctgcccctcatcttccagatcacccccctgaatgtgacccagtggctgatggtgctgaagatcagcctgcctgtgatcctgatggatgagaccctgaagtttgtggccaggaactacctggagcccgggaaggaatgtgtgcagcctgccaccaagagctgcagcttcagcgcctgcacagatggcatctcctggccctttgtgctgctgatcatgcccctggtgatctgggtgtacagcacagacaccaacttcagtgacatgttctggagctag

SEQ ID NO: 144364 - DNA, 2802 bp, Artificial Sequence
  Description of Artificial Sequence: Synthetic coding sequence
tgaaccatcacagcctttgtggagcccttcgtcatcctgctgatcctggtggccaatgccatcgtgggcgtgtggcaggagagaaatgcagaaaatgccatcgaggccctgaaggagtatgagcctgagatgggcaaggtgtaccggcaggacaggaagtctgtgcagaggatcaaggccaaggacatcgtgcctggggacatcgtggagattgctggggagagcgtgtctgtcatcaagcacacagatcctgtgcctgaccccagggctgtgaaccaggacaagaagaacatgctgttcagcggcaccaacattgctgctgggaaggccatgggcgtggtggtggccactggagtgaacacagaaattggcaagatcagagatgagatggtggccacagagcaggagaggacccccctgcagcagaagctggatgaatttggagagcagctgagcaaggtgatcagcctcatctgcatcgctgtgtggatcatcaacatcggccacttcaatgaccctgtgcatggaggctcctggatccggggggccatctactacttcaagattgctgtggccctggccgtggccgccatccctgagggcctgcctgctgtgatcaccacctgcctggccctgggcaccaggaggatggccaagaagaatgccatcgtgcgcagcctgcccagcgtggagaccctgggctgcaccagcgtcatctgcagcgacaagacaggcaccctgaccaccaaccagatgtctgtgtgcaggatgttcatcctggacagagtggagggggacacctgcagcctgaatgagttcaccatcaccggcagcacctacgcccccatcggggaggtgcacaaggatgacaagcctgtgaactgccaccagtatgatggcctggtggagctggccaccatctgtgccctgtgcaatgacagcgccctggactacaatgaggccaagggcgtgtatgagaaggtgggggaggccacagaaacagccctgacctgcctggtggagaagatgaatgtgtttgacacagagctgaagggcctgagcaagattgaaagagccaatgcctgcaacagcgtcatcaagcagctgatgaagaaggagttcaccctggagttcagccgggacaggaagtccatgtctgtgtactgcacccccaacaagcccagcaggacctccatgagcaagatgtttgtgaagggggcccctgagggcgtcatcgaccgctgcacccacatccgggtgggcagcaccaaggtgcccatgaccagcggcgtgaagcagaagatcatgtctgtcatccgggagtggggcagcggcagtgacaccctgcgctgcctggccctggccacccatgacaaccccctgcggcgggaggagatgcacctggaggacagcgccaacttcatcaagtatgagaccaacctgacctttgtgggctgtgtgggcatgctggaccccccaagaattgaggtggccagctctgtgaagctgtgccggcaggccggcatccgggtcatcatgatcactggagacaacaagggcacagctgtggccatctgcagaagaattggcatcttcggccaggatgaagatgtgaccagcaaggccttcaccggccgggagtttgatgagctgaaccccagcgcccagagagatgcctgcctgaatgcccgctgctttgcccgggtggagcccagccacaagagcaagatcgtggagttcctgcagagctttgatgagatcacagccatgactggagatggagtgaatgatgccccagccctgaagaaggccgagatcggcatcgccatgggcagcggcacagctgtggccaagacagccagcgagatggtgctggctgatgacaacttcagcaccatcgtggccgctgtggaggagggccgggccatctacaacaacatgaagcagttcatccgctacctgatcagcagcaatgtgggggaggtggtgtgcatcttcctgacagctgccctgggcttccctgaggccctgatccctgtgcagctgctgtgggtgaacctggtgacagatggcctgcctgccacagccctgggcttcaaccccccagacctggacatcatgaacaagccacccaggaaccccaaggagcccctcatcagcggctggctgttcttccgctacctggccatcggctgctacgtgggcgccgccaccgtgggcgccgccgcctggtggttcatcgctgctgatggcggcccccgggtgtccttctaccagctgagccacttcctgcagtgcaaggaggacaacccagactttgaaggagtggactgtgccatctttgagagcccctaccccatgaccatggccctgtctgtgctggtgaccatcgagatgtgcaatgccctgaacagcctgtctgagaaccagagcctgctgaggatgccaccctgggagaacatctggctggtgggcagcatctgcctgtccatgagcctgcacttcctgatcctgtatgtggagcccctgcccctcatcttccagatcacccccctgaatgtgacccagtggctgatggtgctgaagatcagcctgcccgtcatcctgatggatgagaccctgaagtttgtggccaggaactacctggagcccgggaaggaatgtgtgcagcctgccaccaagagctgcagcttcagcgcctgcacagatggcatctcctggccctttgtgctgctgatcatgcccctggtgatctgggtgtacagcacagacaccaacttcagtgacatgttctggagctag

SEQ ID NO: 144365 - DNA, 3663 bp, Artificial Sequence
  Description of Artificial Sequence: Synthetic coding sequence
atgggagacatggccaacaacagcgtggcctacagcggcgtgaagaacagcctgaaggaggccaaccatgatggagactttggcatcaccctggccgagctgcgggccctgatggagctgcggagcacagatgccctgaggaagatccaggagagctatggagatgtgtatggcatctgcaccaagctgaagaccagccccaatgaaggcctgagcggcaacccagctgacctggagcggcgggaggccgtgtttgggaagaacttcatcccccccaagaagcccaagaccttcctgcagctggtgtgggaggccctgcaggatgtgaccctcatcatcctggagattgctgccatcgtgtccctgggcctgtccttctaccagcccccagagggggacaatgccctgtgtggggaggtgtctgtgggggaggaggagggggagggggagaccggctggattgagggcgccgccatcctgctgtctgtggtgtgtgtggtgctggtgacagccttcaatgactggagcaaggagaagcagttccggggcctgcagagccgcatcgagcaggagcagaagttcaccgtcatccggggcggccaggtgatccagatccctgtggccgacatcaccgtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccctgctgctgagcggcacccacgtgatggagggcagcggccgcatggtggtgacagctgtgggcgtgaacagccagacaggcatcatcttcaccctgctgggcgccggcggggaggaggaggagaagaaggatgagaagaagaaggagaagaagaacaagaagcaggatggagccatcgagaacagaaacaaggccaaggcccaggatggagctgccatggagatgcagcccctgaagtctgaggagggcggagatggagatgagaaggacaagaagaaggccaacctgcccaagaaggagaagtctgtgctgcagggcaagctgaccaagctggccgtgcagatcggcaaggccggcctgctgatgtctgccatcaccgtcatcatcctggtgctgtacttcgtcatcgacaccttctgggtgcagaagaggccctggctggctgaatgtacccccatctacatccagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcaatgagaagcactacaagaaggtgcctgagcctgaggccatcccccccaacatcctgagctacctggtgacaggcatctctgtgaactgtgcctacaccagcaagatcctgcccccagagaaggagggcggcctgcccaggcatgtgggcaacaagacagaatgtgccctgctgggcctgctgctggacctgaagagggactaccaggatgtgagaaatgagatccctgaggaggccctgtacaaggtgtacaccttcaacagcgtgaggaagtccatgagcacagtgctgaagaacagtgatggcagctaccgcatcttcagcaaaggagccagcgagatcatcctgaagaagtgcttcaagatcctgagcgccaacggggaggccaaggtgttccggccccgggacagagatgacatcgtgaagacagtgattgagcccatggccagcgagggcctgcggaccatctgcctggccttccgggacttccctgctggggagcctgagcctgagtgggacaatgaaaatgacatcgtgacaggcctgacctgcatcgctgtggtgggcattgaagatcctgtgcggcctgaggtgcctgatgccatcaagaagtgccagagagctggcatcaccgtgaggatggtgactggagacaacatcaacacagcccgggccatcgccaccaagtgtggcatcctgcaccctggagaggacttcctgtgcctggagggcaaggacttcaacagacgcatcagaaatgaaaaaggagaaattgagcaggagagaattgacaagatctggcccaagctgcgggtgctggcccggagcagccccacagacaagcacaccctggtgaagggcatcatcgacagcacagtgtctgaccagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacaccctggccagcctggccctggccacagagcccccaacagagagcctgctgctgaggaagccctatggaagaaacaagcccctcatcagcaggaccatgatgaagaacatcctgggccacgccttctaccagctggtggtggtgttcaccctgctgtttgctggggagaagttctttgacatcgacagcggcagaaatgcccccctgcacgcccctccttctgagcactacaccatcgtgttcaacacctttgtgctgatgcagctgttcaatgagatcaatgccaggaagatccacggggagagaaatgtgtttgagggcatcttcaacaatgccatcttctgcaccatcgtgctgggcacctttgtggtgcagatcatcatcgtgcagtttggaggcaagcccttcagctgcagcgagctgagcattgagcagtggctgtggagcatcttcctgggcatgggcaccctgctgtggggccagctgatcagcaccatccccaccagccggctgaagttcctgaaggaggccggccacggcacccagaaggaggagatccctgaggaggagctggccgaggatgtggaggagattgaccacgccgagcgggagctgcggcggggccagatcctgtggttccggggcctgaaccgcatccagacccagatccgggtggtgaatgccttccgcagcagcctgtatgagggcctggagaagccagagagccgcagcagcatccacaacttcatgacccaccctgagttcagaattgaagattctgagccccacatccccctgattgatgacacagatgctgaagatgatgcccccaccaagaggaacagcagccccccacccagccccaacaagaacaacaatgctgtggacagcggcatccacctgaccatcgagatgaacaagagcgccaccagcagcagccctggcagccccctgcacagcctggagaccagcctgtag

SEQ ID NO: 144366 - DNA, 3555 bp, Artificial Sequence
  Description of Artificial Sequence: Synthetic coding sequence
atgggagacatggccaacaacagcgtggcctacagcggcgtgaagaacagcctgaaggaggccaaccatgatggagactttggcatcaccctggccgagctgcgggccctgatggagctgcggagcacagatgccctgaggaagatccaggagagctatggagatgtgtatggcatctgcaccaagctgaagaccagccccaatgaaggcctgagcggcaacccagctgacctggagcggcgggaggccgtgtttgggaagaacttcatcccccccaagaagcccaagaccttcctgcagctggtgtgggaggccctgcaggatgtgaccctcatcatcctggagattgctgccatcgtgtccctgggcctgtccttctaccagcccccagagggggacaatgccctgtgtggggaggtgtctgtgggggaggaggagggggagggggagaccggctggattgagggcgccgccatcctgctgtctgtggtgtgtgtggtgctggtgacagccttcaatgactggagcaaggagaagcagttccggggcctgcagagccgcatcgagcaggagcagaagttcaccgtcatccggggcggccaggtgatccagatccctgtggccgacatcaccgtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccctgctgctgagcggcacccacgtgatggagggcagcggccgcatggtggtgacagctgtgggcgtgaacagccagacaggcatcatcttcaccctgctgggcgccggcggggaggaggaggagaagaaggatgagaagaagaaggagaagaagaacaagaagcaggatggagccatcgagaacagaaacaaggccaaggcccaggatggagctgccatggagatgcagcccctgaagtctgaggagggcggagatggagatgagaaggacaagaagaaggccaacctgcccaagaaggagaagtctgtgctgcagggcaagctgaccaagctggccgtgcagatcggcaaggccggcctgctgatgtctgccatcaccgtcatcatcctggtgctgtacttcgtcatcgacaccttctgggtgcagaagaggccctggctggctgaatgtacccccatctacatccagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcaatgagaagcactacaagaaggtgcctgagcctgaggccatcccccccaacatcctgagctacctggtgacaggcatctctgtgaactgtgcctacaccagcaagatcctgcccccagagaaggagggcggcctgcccaggcatgtgggcaacaagacagaatgtgccctgctgggcctgctgctggacctgaagagggactaccaggatgtgagaaatgagatccctgaggaggccctgtacaaggtgtacaccttcaacagcgtgaggaagtccatgagcacagtgctgaagaacagtgatggcagctaccgcatcttcagcaaaggagccagcgagatcatcctgaagaagtgcttcaagatcctgagcgccaacggggaggccaaggtgttccggccccgggacagagatgacatcgtgaagacagtgattgagcccatggccagcgagggcctgcggaccatctgcctggccttccgggacttccctgctggggagcctgagcctgagtgggacaatgaaaatgacatcgtgacaggcctgacctgcatcgctgtggtgggcattgaagatcctgtgcggcctgaggtgcctgatgccatcaagaagtgccagagagctggcatcaccgtgaggatggtgactggagacaacatcaacacagcccgggccatcgccaccaagtgtggcatcctgcaccctggagaggacttcctgtgcctggagggcaaggacttcaacagacgcatcagaaatgaaaaaggagaaattgagcaggagagaattgacaagatctggcccaagctgcgggtgctggcccggagcagccccacagacaagcacaccctggtgaagggcatcatcgacagcacagtgtctgaccagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacaccctggccagcctggccctggccacagagcccccaacagagagcctgctgctgaggaagccctatggaagaaacaagcccctcatcagcaggaccatgatgaagaacatcctgggccacgccttctaccagctggtggtggtgttcaccctgctgtttgctggggagaagttctttgacatcgacagcggcagaaatgcccccctgcacgcccctccttctgagcactacaccatcgtgttcaacacctttgtgctgatgcagctgttcaatgagatcaatgccaggaagatccacggggagagaaatgtgtttgagggcatcttcaacaatgccatcttctgcaccatcgtgctgggcacctttgtggtgcagctgatcagcaccatccccaccagccggctgaagttcctgaaggaggccggccacggcacccagaaggaggagatccctgaggaggagctggccgaggatgtggaggagattgaccacgccgagcgggagctgcggcggggccagatcctgtggttccggggcctgaaccgcatccagacccagatccgggtggtgaatgccttccgcagcagcctgtatgagggcctggagaagccagagagccgcagcagcatccacaacttcatgacccaccctgagttcagaattgaagattctgagccccacatccccctgattgatgacacagatgctgaagatgatgcccccaccaagaggaacagcagccccccacccagccccaacaagaacaacaatgctgtggacagcggcatccacctgaccatcgagatgaacaagagcgccaccagcagcagccctggcagccccctgcacagcctggagaccagcctgtag

SEQ ID NO: 144367 - DNA, 3531 bp, Artificial Sequence
  Description of Artificial Sequence: Synthetic coding sequence
atgggagacatggccaacaacagcgtggcctacagcggcgtgaagaacagcctgaaggaggccaaccatgatggagactttggcatcaccctggccgagctgcgggccctgatggagctgcggagcacagatgccctgaggaagatccaggagagctatggagatgtgtatggcatctgcaccaagctgaagaccagccccaatgaaggcctgagcggcaacccagctgacctggagcggcgggaggccgtgtttgggaagaacttcatcccccccaagaagcccaagaccttcctgcagctggtgtgggaggccctgcaggatgtgaccctcatcatcctggagattgctgccatcgtgtccctgggcctgtccttctaccagcccccagagggggacaatgccctgtgtggggaggtgtctgtgggggaggaggagggggagggggagaccggctggattgagggcgccgccatcctgctgtctgtggtgtgtgtggtgctggtgacagccttcaatgactggagcaaggagaagcagttccggggcctgcagagccgcatcgagcaggagcagaagttcaccgtcatccggggcggccaggtgatccagatccctgtggccgacatcaccgtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccctgctgctgagcggcacccacgtgatggagggcagcggccgcatggtggtgacagctgtgggcgtgaacagccagacaggcatcatcttcaccctgctgggcgccggcggggaggaggaggagaagaaggatgagaagaagaaggagaagaagaacaagaagcaggatggagccatcgagaacagaaacaaggccaaggcccaggatggagctgccatggagatgcagcccctgaagtctgaggagggcggagatggagatgagaaggacaagaagaaggccaacctgcccaagaaggagaagtctgtgctgcagggcaagctgaccaagctggccgtgcagatcggcaaggccggcctgctgatgtctgccatcaccgtcatcatcctggtgctgtacttcgtcatcgacaccttctgggtgcagaagaggccctggctggctgaatgtacccccatctacatccagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcaatgagaagcactacaagaaggtgcctgagcctgaggccatcccccccaacatcctgagctacctggtgacaggcatctctgtgaactgtgcctacaccagcaagatcctgcccccagagaaggagggcggcctgcccaggcatgtgggcaacaagacagaatgtgccctgctgggcctgctgctggacctgaagagggactaccaggatgtgagaaatgagatccctgaggaggccctgtacaaggtgtacaccttcaacagcgtgaggaagtccatgagcacagtgctgaagaacagtgatggcagctaccgcatcttcagcaaaggagccagcgagatcatcctgaagaagtgcttcaagatcctgagcgccaacggggaggccaaggtgttccggccccgggacagagatgacatcgtgaagacagtgattgagcccatggccagcgagggcctgcggaccatctgcctggccttccgggacttccctgctggggagcctgagcctgagtgggacaatgaaaatgacatcgtgacaggcctgacctgcatcgctgtggtgggcattgaagatcctgtgcggcctgaggtgcctgatgccatcaagaagtgccagagagctggcatcaccgtgaggatggtgactggagacaacatcaacacagcccgggccatcgccaccaagtgtggcatcctgcaccctggagaggacttcctgtgcctggagggcaaggacttcaacagacgcatcagaaatgaaaaaggagaaattgagcaggagagaattgacaagatctggcccaagctgcgggtgctggcccggagcagccccacagacaagcacaccctggtgaagggcatcatcgacagcacagtgtctgaccagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacaccctggccagcctggccctggccacagagcccccaacagagagcctgctgctgaggaagccctatggaagaaacaagcccctcatcagcaggaccatgatgaagaacatcctgggccacgccttctaccagctggtggtggtgttcaccctgctgtttgctggggagaagttctttgacatcgacagcggcagaaatgcccccctgcacgcccctccttctgagcactacaccatcgtgttcaacacctttgtgctgatgcagctgttcaatgagatcaatgccaggaagatccacggggagagaaatgtgtttgagggcatcttcaacaatgccatcttctgcaccatcgtgctgggcacctttgtggtgcagatcatcatcgtgcagtttggaggcaagcccttcagctgcagcgagctgagcattgagcagtggctgtggagcatcttcctgggcatgggcaccctgctgtggggccagctgatcagcaccatccccaccagccggctgaagttcctgaaggaggccggccacggcacccagaaggaggagatccctgaggaggagctggccgaggatgtggaggagattgaccacgccgagcgggagctgcggcggggccagatcctgtggttccggggcctgaaccgcatccagacccagatggatgtggtgaatgccttccagagcggcagcagcatccagggcgccctgcggcggcagcccagcatcgccagccagcaccatgatgtgaccaacatcagcacccccacccacgtggtgttcagcagcagcacagccagcaccaccgtgggctacagcagtggagagtgcatctcctag

SEQ ID NO: 144368 - DNA, 2892 bp, Artificial Sequence
  Description of Artificial Sequence: Synthetic coding sequence
atgttcctggtgattggcacccacgtgatggagggcagcggccgcatggtggtgacagctgtgggcgtgaacagccagacaggcatcatcttcaccctgctgggcgctggaggagaggaggaggagaagaaggatgagaagaagaaggagaagaagaacaagaagcaggatggagccattgaaaatagaaacaaggccaaggcccaggatggagctgccatggagatgcagcccctgaagtctgaggagggcggagatggagatgagaaggacaagaagaaggccaacctgcccaagaaggagaagtctgtgctgcagggcaagctgaccaagctggccgtgcagatcggcaaggccggcctgctgatgtctgccatcaccgtcatcatcctggtgctgtactttgtgattgacaccttctgggtgcagaagaggccctggctggccgagtgcacccccatctacatccagtactttgtgaagttcttcatcattggagtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcaatgagaagcactacaagaaggtgcctgagcctgaggccatcccccccaacatcctgagctacctggtgacaggcatctctgtgaactgtgcctacaccagcaagatcctgcccccagagaaggagggcggcctgcccaggcatgtgggcaacaagacagaatgtgccctgctgggcctgctgctggacctgaagagggactaccaggatgtgagaaatgagatccctgaggaggccctgtacaaggtgtacaccttcaacagcgtgaggaagtccatgagcacagtgctgaagaacagtgatggcagctaccgcatcttcagcaagggggccagcgagatcatcctgaagaagtgcttcaagatcctgagcgccaatggagaggccaaggtgttccggccccgggacagagatgacatcgtgaagacagtcatcgagcccatggccagcgagggcctgcggaccatctgcctggccttccgggacttccctgctggggagcctgagcctgagtgggacaatgaaaatgacatcgtgacaggcctgacctgcatcgctgtggtgggcatcgaggaccctgtgcggcctgaggtgcctgatgccatcaagaagtgccagagagctggcatcaccgtgaggatggtgactggagacaacatcaacacagcccgggccatcgccaccaagtgtggcatcctgcaccctggagaggacttcctgtgcctggagggcaaggacttcaacagacgcatcagaaatgagaagggggagattgagcaggagagaattgacaagatctggcccaagctgcgggtgctggcccggagcagccccacagacaagcacaccctggtgaagggcatcatcgacagcacagtgtctgaccagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacaccctggccagcctggccctggccacagagcccccaacagagagcctgctgctgaggaagccctacggcaggaacaagcccctcatcagcaggaccatgatgaagaacatcctgggccacgccttctaccagctggtggtggtgttcaccctgctgtttgctggggagaagttctttgatattgattctggaagaaatgcccccctgcacgccccacccagcgagcactacaccatcgtgttcaacacctttgtgctgatgcagctgttcaatgagatcaatgccaggaagatccatggagagagaaatgtgtttgagggcatcttcaacaatgccatcttctgcaccatcgtgctgggcacctttgtggtgcagatcatcatcgtgcagtttggaggcaagcccttcagctgcagcgagctgagcattgagcagtggctgtggagcatcttcctgggcatgggcaccctgctgtggggccagctgatcagcaccatccccaccagccggctgaagttcctgaaggaggccggccacggcacccagaaggaggagatccctgaggaggagctggctgaagatgtggaggagattgaccatgctgagcgggagctgcggcggggccagatcctgtggttccggggcctgaaccgcatccagacccagatccgggtggtgaatgccttccgcagcagcctgtatgagggcctggagaagccagagagccgcagcagcatccacaacttcatgacccaccctgagttcagaattgaggacagcgagccccacatccccctgattgatgacacagatgctgaagatgatgcccccaccaagaggaacagcagccccccacccagccccaacaagaacaacaatgctgtggacagcggcatccacctgaccatcgagatgaacaagagcgccaccagcagcagccctggcagccccctgcacagcctggagaccagcctgtag

SEQ ID NO: 144369 - DNA, 3663 bp, Artificial Sequence; identical to SEQ ID NO: 144365
  Description of Artificial Sequence: Synthetic coding sequence

SEQ ID NO: 144370 - DNA, 306 bp, Artificial Sequence
  Description of Artificial Sequence: Synthetic coding sequence
atgggagacatggccaacaacagcgtggcctacagcggcgtgaagaacagcctgaaggaggccaaccatgatggagactttggcatcaccctggccgagctgcgggccctgatggagctgcggagcacagatgccctgaggaagatccaggagagctatggagatgtgtatggcatctgcaccaagctgaagaccagccccaatgaaggagagttctactatgcctgcttctggttctttgtgcagagggtgctgtacatctggctgatcaatgaacatgcctacatcatcctggccatcgtgtag

SEQ ID NO: 144371 - DNA, 3600 bp, Artificial Sequence
  Description of Artificial Sequence: Synthetic coding sequence
atgggagacatgaccaacagcgacttctacagcaagaaccagagaaatgaaagcagccacggcggggagtttggctgcaccatggaggagctgcggagcctgatggagctgcggggcacagaggccgtggtgaagatcaaggagacctacggggacacagaggccatctgccggcggctgaagaccagccctgtggagggcctgcctggaacagccccagacctggagaagaggaagcagatcttcggccagaacttcatcccccccaagaagcccaagaccttcctgcagctggtgtgggaggccctgcaggatgtgaccctcatcatcctggagattgctgccatcatcagcctgggcctgtccttctaccaccccccaggagagggcaatgaaggctgtgccacagcccagggcggcgcagaagatgaaggagaggccgaggccggctggattgagggcgccgccatcctgctgagcgtcatctgtgtggtgctggtgacagccttcaatgactggagcaaggagaagcagttccggggcctgcagagccgcatcgagcaggagcagaagttcaccgtggtgcgggccggccaggtggtgcagatccctgtggccgagatcgtggtgggggacatcgcccaggtgaagtacggggacctgctgcctgcagatggcctcttcatccagggcaatgacctgaagattgatgagagcagcctgaccggggagagtgaccaggtgaggaagtctgtggacaaggaccccatgctgctgagcggcacccacgtgatggagggcagcggccgcatgctggtgacagctgtgggcgtgaacagccagacaggcatcatcttcaccctgctgggcgccggcggggaggaggaggagaagaaggacaagaagggcgtgaagaagggagatggcctgcagctgcctgctgctgatggagctgctgccagcaatgctgctgacagcgccaatgccagcctggtgaatggcaagatgcaggatggaaatgtggatgccagccagagcaaggccaagcagcaggatggagctgctgccatggagatgcagcccctgaagtctgctgagggcggagatgctgatgacaggaagaaggcctccatgcacaagaaggagaagtctgtgctgcagggcaagctgaccaagctggccgtgcagatcggcaaggccggcctggtgatgtctgccatcaccgtcatcatcctggtgctgtacttcaccgtggacacctttgtggtgaacaagaagccctggctgcctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcaggcctacgtgggagatgtgcactacaaggagatcccagaccccagcagcatcaacaccaagaccatggagctgctgatcaatgccatcgccatcaacagcgcctacaccaccaagatcctgcccccagagaaggagggcgccctgccccggcaggtgggcaacaagacagaatgtggcctgctgggctttgtgctggacctgaagcaggactatgagcctgtgcgcagccagatgcctgaggagaagctgtacaaggtgtacaccttcaacagcgtgaggaagtccatgagcaccgtcatcaagctgcctgatgagagcttcaggatgtacagcaaaggagccagcgagatcgtgctgaagaagtgctgcaagatcctgaatggagctggggagcccagggtcttccggccccgggacagagatgagatggtgaagaaggtgattgagcccatggcctgtgatggcctgcggaccatctgtgtggcctacagagacttccccagcagccctgagccagactgggacaatgaaaatgacatcctgaatgagctgacctgcatctgtgtggtgggcatcgaggaccctgtgcggcctgaggtgcctgaggccatcaggaagtgccagagagctggcatcaccgtgaggatggtgactggagacaacatcaacacagcccgggccatcgccatcaagtgtggcatcatccaccctggagaggacttcctgtgcctggagggcaaggagttcaacagacgcatcagaaatgagaagggggagattgagcaggagagaattgacaagatctggcccaagctgcgggtgctggcccggagcagccccacagacaagcacaccctggtgaagggcatcatcgacagcacccacacagagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcagcagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagaccctgctgctgaggaagccctacggcaggaacaagcccctcatcagcaggaccatgatgaagaacatcctgggccatgctgtgtaccagctggccctgatcttcaccctgctgtttgtgggggagaagatgttccagattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcaggaaccccatcttctgcaccatcgtgctgggcacctttgccatccagatcgtcatcgtgcagtttggaggcaagcccttcagctgcagccccctgcagctggaccagtggatgtggtgcatcttcatcggcctgggggagctggtgtggggccaggtgattgccaccatccccaccagccggctgaagttcctgaaggaggccggccgcctgacccagaaggaggagatccctgaggaggagctgaatgaagatgtggaggagattgaccatgctgagcgggagctgcggcggggccagatcctgtggttccggggcctgaaccgcatccagacccagatcgaggtggtgaacaccttcaagagcggggccagcttccagggcgccctgcggcggcagagctctgtgaccagccagagccaggatgtggccaacctgagcagccccagccgggtgtccctgagcaatgccctgagcagccccaccagcctgcccccagctgctgctggccgggagtag

SEQ ID NO: 144372 - DNA, 3690 bp, Artificial Sequence
  Description of Artificial Sequence: Synthetic coding sequence
atgggagacatgaccaacagcgacttctacagcaagaaccagagaaatgaaagcagccacggcggggagtttggctgcaccatggaggagctgcggagcctgatggagctgcggggcacagaggccgtggtgaagatcaaggagacctacggggacacagaggccatctgccggcggctgaagaccagccctgtggagggcctgcctggaacagccccagacctggagaagaggaagcagatcttcggccagaacttcatcccccccaagaagcccaagaccttcctgcagctggtgtgggaggccctgcaggatgtgaccctcatcatcctggagattgctgccatcatcagcctgggcctgtccttctaccaccccccaggagagggcaatgaaggctgtgccacagcccagggcggcgcagaagatgaaggagaggccgaggccggctggattgagggcgccgccatcctgctgagcgtcatctgtgtggtgctggtgacagccttcaatgactggagcaaggagaagcagttccggggcctgcagagccgcatcgagcaggagcagaagttcaccgtggtgcgggccggccaggtggtgcagatccctgtggccgagatcgtggtgggggacatcgcccaggtgaagtacggggacctgctgcctgcagatggcctcttcatccagggcaatgacctgaagattgatgagagcagcctgaccggggagagtgaccaggtgaggaagtctgtggacaaggaccccatgctgctgagcggcacccacgtgatggagggcagcggccgcatgctggtgacagctgtgggcgtgaacagccagacaggcatcatcttcaccctgctgggcgccggcggggaggaggaggagaagaaggacaagaagggcgtgaagaagggagatggcctgcagctgcctgctgctgatggagctgctgccagcaatgctgctgacagcgccaatgccagcctggtgaatgccaagcagcaggatggagctgctgccatggagatgcagcccctgaagtctgctgagggcggagatgctgatgacaggaagaaggcctccatgcacaagaaggagaagtctgtgctgcagggcaagctgaccaagctggccgtgcagatcggcaaggccggcctggtgatgtctgccatcaccgtcatcatcctggtgctgtacttcaccgtggacacctttgtggtgaacaagaagccctggctgcctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcaggcctacgtgggagatgtgcactacaaggagatcccagaccccagcagcatcaacaccaagaccatggagctgctgatcaatgccatcgccatcaacagcgcctacaccaccaagatcctgcccccagagaaggagggcgccctgccccggcaggtgggcaacaagacagaatgtggcctgctgggctttgtgctggacctgaagcaggactatgagcctgtgcgcagccagatgcctgaggagaagctgtacaaggtgtacaccttcaacagcgtgaggaagtccatgagcaccgtcatcaagctgcctgatgagagcttcaggatgtacagcaaaggagccagcgagatcgtgctgaagaagtgctgcaagatcctgaatggagctggggagcccagggtcttccggccccgggacagagatgagatggtgaagaaggtgattgagcccatggcctgtgatggcctgcggaccatctgtgtggcctacagagacttccccagcagccctgagccagactgggacaatgaaaatgacatcctgaatgagctgacctgcatctgtgtggtgggcatcgaggaccctgtgcggcctgaggtgcctgaggccatcaggaagtgccagagagctggcatcaccgtgaggatggtgactggagacaacatcaacacagcccgggccatcgccatcaagtgtggcatcatccaccctggagaggacttcctgtgcctggagggcaaggagttcaacagacgcatcagaaatgagaagggggagattgagcaggagagaattgacaagatctggcccaagctgcgggtgctggcccggagcagccccacagacaagcacaccctggtgaagggcatcatcgacagcacccacacagagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcagcagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagaccctgctgctgaggaagccctacggcaggaacaagcccctcatcagcaggaccatgatgaagaacatcctgggccatgctgtgtaccagctggccctgatcttcaccctgctgtttgtgggggagaagatgttccagattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcaggaaccccatcttctgcaccatcgtgctgggcacctttgccatccagatcgtcatcgtgcagtttggaggcaagcccttcagctgcagccccctgcagctggaccagtggatgtggtgcatcttcatcggcctgggggagctggtgtggggccaggtgattgccaccatccccaccagccggctgaagttcctgaaggaggccggccgcctgacccagaaggaggagatccctgaggaggagctgaatgaagatgtggaggagattgaccatgctgagcgggagctgcggcggggccagatcctgtggttccggggcctgaaccgcatccagacccagatccgggtggtgaaggccttccgcagcagcctgtatgagggcctggagaagccagagagcaggaccagcatccacaacttcatggcccaccctgagttcagaattgaggacagccagccccacatccccctgattgatgacacagacctggaggaggatgctgccctgaagcagaacagcagcccccccagcagcctgaacaagaacaacagcgccattgattctggcatcaacctgaccacagacaccagcaagagcgccaccagcagcagccctggcagccccatccacagcctggagaccagcctgtag

SEQ ID NO: 144373 - DNA, 3732 bp, Artificial Sequence
  Description of Artificial Sequence: Synthetic coding sequence
atgggagacatgaccaacagcgacttctacagcaagaaccagagaaatgaaagcagccacggcggggagtttggctgcaccatggaggagctgcggagcctgatggagctgcggggcacagaggccgtggtgaagatcaaggagacctacggggacacagaggccatctgccggcggctgaagaccagccctgtggagggcctgcctggaacagccccagacctggagaagaggaagcagatcttcggccagaacttcatcccccccaagaagcccaagaccttcctgcagctggtgtgggaggccctgcaggatgtgaccctcatcatcctggagattgctgccatcatcagcctgggcctgtccttctaccaccccccaggagagggcaatgaaggctgtgccacagcccagggcggcgcagaagatgaaggagaggccgaggccggctggattgagggcgccgccatcctgctgagcgtcatctgtgtggtgctggtgacagccttcaatgactggagcaaggagaagcagttccggggcctgcagagccgcatcgagcaggagcagaagttcaccgtggtgcgggccggccaggtggtgcagatccctgtggccgagatcgtggtgggggacatcgcccaggtgaagtacggggacctgctgcctgcagatggcctcttcatccagggcaatgacctgaagattgatgagagcagcctgaccggggagagtgaccaggtgaggaagtctgtggacaaggaccccatgctgctgagcggcacccacgtgatggagggcagcggccgcatgctggtgacagctgtgggcgtgaacagccagacaggcatcatcttcaccctgctgggcgccggcggggaggaggaggagaagaaggacaagaagggcgtgaagaagggagatggcctgcagctgcctgctgctgatggagctgctgccagcaatgctgctgacagcgccaatgccagcctggtgaatggcaagatgcaggatggaaatgtggatgccagccagagcaaggccaagcagcaggatggagctgctgccatggagatgcagcccctgaagtctgctgagggcggagatgctgatgacaggaagaaggcctccatgcacaagaaggagaagtctgtgctgcagggcaagctgaccaagctggccgtgcagatcggcaaggccggcctggtgatgtctgccatcaccgtcatcatcctggtgctgtacttcaccgtggacacctttgtggtgaacaagaagccctggctgcctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcaggcctacgtgggagatgtgcactacaaggagatcccagaccccagcagcatcaacaccaagaccatggagctgctgatcaatgccatcgccatcaacagcgcctacaccaccaagatcctgcccccagagaaggagggcgccctgccccggcaggtgggcaacaagacagaatgtggcctgctgggctttgtgctggacctgaagcaggactatgagcctgtgcgcagccagatgcctgaggagaagctgtacaaggtgtacaccttcaacagcgtgaggaagtccatgagcaccgtcatcaagctgcctgatgagagcttcaggatgtacagcaaaggagccagcgagatcgtgctgaagaagtgctgcaagatcctgaatggagctggggagcccagggtcttccggccccgggacagagatgagatggtgaagaaggtgattgagcccatggcctgtgatggcctgcggaccatctgtgtggcctacagagacttccccagcagccctgagccagactgggacaatgaaaatgacatcctgaatgagctgacctgcatctgtgtggtgggcatcgaggaccctgtgcggcctgaggtgcctgaggccatcaggaagtgccagagagctggcatcaccgtgaggatggtgactggagacaacatcaacacagcccgggccatcgccatcaagtgtggcatcatccaccctggagaggacttcctgtgcctggagggcaaggagttcaacagacgcatcagaaatgagaagggggagattgagcaggagagaattgacaagatctggcccaagctgcgggtgctggcccggagcagccccacagacaagcacaccctggtgaagggcatcatcgacagcacccacacagagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcagcagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagaccctgctgctgaggaagccctacggcaggaacaagcccctcatcagcaggaccatgatgaagaacatcctgggccatgctgtgtaccagctggccctgatcttcaccctgctgtttgtgggggagaagatgttccagattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcaggaaccccatcttctgcaccatcgtgctgggcacctttgccatccagatcgtcatcgtgcagtttggaggcaagcccttcagctgcagccccctgcagctggaccagtggatgtggtgcatcttcatcggcctgggggagctggtgtggggccaggtgattgccaccatccccaccagccggctgaagttcctgaaggaggccggccgcctgacccagaaggaggagatccctgaggaggagctgaatgaagatgtggaggagattgaccatgctgagcgggagctgcggcggggccagatcctgtggttccggggcctgaaccgcatccagacccagatccgggtggtgaaggccttccgcagcagcctgtatgagggcctggagaagccagagagcaggaccagcatccacaacttcatggcccaccctgagttcagaattgaggacagccagccccacatccccctgattgatgacacagacctggaggaggatgctgccctgaagcagaacagcagcccccccagcagcctgaacaagaacaacagcgccattgattctggcatcaacctgaccacagacaccagcaagagcgccaccagcagcagccctggcagccccatccacagcctggagaccagcctgtag

SEQ ID NO: 144374 - DNA, 3732 bp, Artificial Sequence; identical to SEQ ID NO: 144373
  Description of Artificial Sequence: Synthetic coding sequence

SEQ ID NO: 144375 - DNA, 3597 bp, Artificial Sequence
  Description of Artificial Sequence: Synthetic coding sequence
atgggagacatgaccaacagcgacttctacagcaagaaccagagaaatgaaagcagccacggcggggagtttggctgcaccatggaggagctgcggagcctgatggagctgcggggcacagaggccgtggtgaagatcaaggagacctacggggacacagaggccatctgccggcggctgaagaccagccctgtggagggcctgcctggaacagccccagacctggagaagaggaagcagatcttcggccagaacttcatcccccccaagaagcccaagaccttcctgcagctggtgtgggaggccctgcaggatgtgaccctcatcatcctggagattgctgccatcatcagcctgggcctgtccttctaccaccccccaggagagggcaatgaaggctgtgccacagcccagggcggcgcagaagatgaaggagaggccgaggccggctggattgagggcgccgccatcctgctgagcgtcatctgtgtggtgctggtgacagccttcaatgactggagcaaggagaagcagttccggggcctgcagagccgcatcgagcaggagcagaagttcaccgtggtgcgggccggccaggtggtgcagatccctgtggccgagatcgtggtgggggacatcgcccaggtgaagtacggggacctgctgcctgcagatggcctcttcatccagggcaatgacctgaagattgatgagagcagcctgaccggggagagtgaccaggtgaggaagtctgtggacaaggaccccatgctgctgagcggcacccacgtgatggagggcagcggccgcatgctggtgacagctgtgggcgtgaacagccagacaggcatcatcttcaccctgctgggcgccggcggggaggaggaggagaagaaggacaagaaggccaagcagcaggatggagctgctgccatggagatgcagcccctgaagtctgctgagggcggagatgctgatgacaggaagaaggcctccatgcacaagaaggagaagtctgtgctgcagggcaagctgaccaagctggccgtgcagatcggcaaggccggcctggtgatgtctgccatcaccgtcatcatcctggtgctgtacttcaccgtggacacctttgtggtgaacaagaagccctggctgcctgagtgcacccctgtgtatgtgcagtactttgtgaagttcttcatcattggagtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcaggcctacgtgggagatgtgcactacaaggagatcccagaccccagcagcatcaacaccaagaccatggagctgctgatcaatgccatcgccatcaacagcgcctacaccaccaagatcctgcccccagagaaggagggcgccctgccccggcaggtgggcaacaagacagaatgtggcctgctgggctttgtgctggacctgaagcaggactatgagcctgtgcgcagccagatgcctgaggagaagctgtacaaggtgtacaccttcaacagcgtgaggaagtccatgagcaccgtcatcaagctgcctgatgagagcttcaggatgtacagcaagggggccagcgagatcgtgctgaagaagtgctgcaagatcctgaatggagctggggagcccagggtcttccggccccgggacagagatgagatggtgaagaaggtgattgagcccatggcctgtgatggcctgcggaccatctgtgtggcctacagagacttccccagcagccctgagccagactgggacaatgaaaatgacatcctgaatgagctgacctgcatctgtgtggtgggcattgaagatcctgtgcggcctgaggtgcctgaggccatcaggaagtgccagagagctggcatcaccgtgaggatggtgactggagacaacatcaacacagcccgggccatcgccatcaagtgtggcatcatccaccctggagaggacttcctgtgcctggagggcaaggagttcaacagacgcatcagaaatgaaaaaggagaaattgagcaggagagaattgacaagatctggcccaagctgcgggtgctggcccggagcagccccacagacaagcacaccctggtgaagggcatcatcgacagcacccacacagagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcagcagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagaccctgctgctgaggaagccctatggaagaaacaagcccctcatcagcaggaccatgatgaagaacatcctgggccatgctgtgtaccagctggccctgatcttcaccctgctgtttgtgggggagaagatgttccagattgacagcggcagaaatgcccccctgcacagccccccatctgagcactacaccatcatcttcaacacctttgtgatgatgcagctgttcaatgagatcaatgccaggaagatccacggggagagaaatgtgtttgatggcatcttcaggaaccccatcttctgcaccatcgtgctgggcacctttgccatccagatcgtgattgtgcagtttggaggcaagcccttcagctgcagccccctgcagctggaccagtggatgtggtgcatcttcatcggcctgggggagctggtgtggggccaggtgattgccaccatccccaccagccggctgaagttcctgaaggaggccggccgcctgacccagaaggaggagatccctgaggaggagctgaatgaagatgtggaggagattgaccacgccgagcgggagctgcggcggggccagatcctgtggttccggggcctgaaccgcatccagacccagatccgggtggtgaaggccttccgcagcagcctgtatgagggcctggagaagccagagagcaggaccagcatccacaacttcatggcccaccctgagttcagaattgaggacagccagccccacatccccctgattgatgacacagacctggaggaggatgctgccctgaagcagaacagcagcccccccagcagcctgaacaagaacaacagcgccatcgacagcggcatcaacctgaccacagacaccagcaagagcgccaccagcagcagccctggcagccccatccacagcctggagaccagcctgtag

SEQ ID NO: 144376 - DNA, 3597 bp, Artificial Sequence; identical to SEQ ID NO: 144375
  Description of Artificial Sequence: Synthetic coding sequence

SEQ ID NO: 144377 - DNA, 1299 bp, Artificial Sequence
  Description of Artificial Sequence: Synthetic coding sequence
atgacagtggtgcaggcctacgtgggagatgtgcactacaaggagatcccagaccccagcagcatcaacaccaagaccatggagctgctgatcaatgccatcgccatcaacagcgcctacaccaccaagatcctgcccccagagaaggagggcgccctgccccggcaggtgggcaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagaccctgctgctgaggaagccctatggaagaaacaagcccctcatcagcaggaccatgatgaagaacatcctgggccatgctgtgtaccagctggccctgatcttcaccctgctgtttgtgggggagaagatgttccagattgacagcggcagaaatgcccccctgcacagccccccatctgagcactacaccatcatcttcaacacctttgtgatgatgcagctgttcaatgagatcaatgccaggaagatccacggggagagaaatgtgtttgatggcatcttcaggaaccccatcttctgcaccatcgtgctgggcacctttgccatccagatcgtgattgtgcagtttggaggcaagcccttcagctgcagccccctgcagctggaccagtggatgtggtgcatcttcatcggcctgggggagctggtgtggggccaggtgattgccaccatccccaccagccggctgaagttcctgaaggaggccggccgcctgacccagaaggaggagatccctgaggaggagctgaatgaagatgtggaggagattgaccacgccgagcgggagctgcggcggggccagatcctgtggttccggggcctgaaccgcatccagacccagatccgggtggtgaaggccttccgcagcagcctgtatgagggcctggagaagccagagagcaggaccagcatccacaacttcatggcccaccctgagttcagaattgaggacagccagccccacatccccctgattgatgacacagacctggaggaggatgctgccctgaagcagaacagcagcccccccagcagcctgaacaagaacaacagcgccatcgacagcggcatcaacctgaccacagacaccagcaagagcgccaccagcagcagccctggcagccccatccacagcctggagaccagcctgtag

SEQ ID NO: 144378 - DNA, 3537 bp, Artificial Sequence
  Description of Artificial Sequence: Synthetic coding sequence
atggagctgcggggcacagaggccgtggtgaagatcaaggagacctacggggacacagaggccatctgccggcggctgaagaccagccctgtggagggcctgcctggaacagccccagacctggagaagaggaagcagatcttcggccagaacttcatcccccccaagaagcccaagaccttcctgcagctggtgtgggaggccctgcaggatgtgaccctcatcatcctggagattgctgccatcatcagcctgggcctgtccttctaccaccccccaggagagggcaatgaaggctgtgccacagcccagggcggcgcagaagatgaaggagaggccgaggccggctggattgagggcgccgccatcctgctgagcgtcatctgtgtggtgctggtgacagccttcaatgactggagcaaggagaagcagttccggggcctgcagagccgcatcgagcaggagcagaagttcaccgtggtgcgggccggccaggtggtgcagatccctgtggccgagatcgtggtgggggacatcgcccaggtgaagtacggggacctgctgcctgcagatggcctcttcatccagggcaatgacctgaagattgatgagagcagcctgaccggggagagtgaccaggtgaggaagtctgtggacaaggaccccatgctgctgagcggcacccacgtgatggagggcagcggccgcatgctggtgacagctgtgggcgtgaacagccagacaggcatcatcttcaccctgctgggcgccggcggggaggaggaggagaagaaggacaagaagggcaagatgcaggatggaaatgtggatgccagccagagcaaggccaagcagcaggatggagctgctgccatggagatgcagcccctgaagtctgctgagggcggagatgctgatgacaggaagaaggcctccatgcacaagaaggagaagtctgtgctgcagggcaagctgaccaagctggccgtgcagatcggcaaggccggcctggtgatgtctgccatcaccgtcatcatcctggtgctgtacttcaccgtggacacctttgtggtgaacaagaagccctggctgcctgagtgcacccctgtgtatgtgcagtactttgtgaagttcttcatcattggagtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcaggcctacgtgggagatgtgcactacaaggagatcccagaccccagcagcatcaacaccaagaccatggagctgctgatcaatgccatcgccatcaacagcgcctacaccaccaagatcctgcccccagagaaggagggcgccctgccccggcaggtgggcaacaagacagaatgtggcctgctgggctttgtgctggacctgaagcaggactatgagcctgtgcgcagccagatgcctgaggagaagctgtacaaggtgtacaccttcaacagcgtgaggaagtccatgagcaccgtcatcaagctgcctgatgagagcttcaggatgtacagcaagggggccagcgagatcgtgctgaagaagtgctgcaagatcctgaatggagctggggagcccagggtcttccggccccgggacagagatgagatggtgaagaaggtgattgagcccatggcctgtgatggcctgcggaccatctgtgtggcctacagagacttccccagcagccctgagccagactgggacaatgaaaatgacatcctgaatgagctgacctgcatctgtgtggtgggcattgaagatcctgtgcggcctgaggtgcctgaggccatcaggaagtgccagagagctggcatcaccgtgaggatggtgactggagacaacatcaacacagcccgggccatcgccatcaagtgtggcatcatccaccctggagaggacttcctgtgcctggagggcaaggagttcaacagacgcatcagaaatgaaaaaggagaaattgagcaggagagaattgacaagatctggcccaagctgcgggtgctggcccggagcagccccacagacaagcacaccctggtgaagggcatcatcgacagcacccacacagagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcagcagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagaccctgctgctgaggaagccctatggaagaaacaagcccctcatcagcaggaccatgatgaagaacatcctgggccatgctgtgtaccagctggccctgatcttcaccctgctgtttgtgggggagaagatgttccagattgacagcggcagaaatgcccccctgcacagccccccatctgagcactacaccatcatcttcaacacctttgtgatgatgcagctgttcaatgagatcaatgccaggaagatccacggggagagaaatgtgtttgatggcatcttcaggaaccccatcttctgcaccatcgtgctgggcacctttgccatccagatcgtgattgtgcagtttggaggcaagcccttcagctgcagccccctgcagctggaccagtggatgtggtgcatcttcatcggcctgggggagctggtgtggggccaggtgattgccaccatccccaccagccggctgaagttcctgaaggaggccggccgcctgacccagaaggaggagatccctgaggaggagctgaatgaagatgtggaggagattgaccacgccgagcgggagctgcggcggggccagatcctgtggttccggggcctgaaccgcatccagacccagatccgggtggtgaaggccttccgcagcagcctgtatgagggcctggagaagccagagagcaggaccagcatccacaacttcatggcccaccctgagttcagaattgaggacagccagccccacatccccctgattgatgacacagacctggaggaggatgctgccctgaagcagaacagcagcccccccagcagcctgaacaagaacaacagcgccatcgacagcggcatcaacctgaccacagacaccagcaagagcgccaccagcagcagccctggcagccccatccacagcctggagaccagcctgtag

SEQ ID NO: 144379 - DNA, 3663 bp, Artificial Sequence
  Description of Artificial Sequence: Synthetic coding sequence
atgggagacatggccaacagcagcattgagttccaccccaagccccagcagcagagagatgtgccccaggccggcggcttcggctgcaccctggccgagctgcggaccctgatggagctgcggggagctgaggccctgcagaagattgaggaggcctatggagatgtgtctggcctgtgccggcggctgaagaccagccccacagagggcctggccgacaacaccaatgacctggagaagaggcggcagatctacggccagaacttcatcccccccaagcagcccaagaccttcctgcagctggtgtgggaggccctgcaggatgtgaccctcatcatcctggaggtggccgccatcgtgtccctgggcctgtccttctacgcccctcctggagaggagagcgaggcctgtggaaatgtgtctggaggagcagaagatgaaggagaggccgaggccggctggattgaaggagctgccatcctgctgagcgtcatctgtgtggtgctggtgacagccttcaatgactggagcaaggagaagcagttccggggcctgcagagcagaattgagcaggagcagaagttcaccgtcatcagaaatggccagctgctgcaggtgcctgtggccgccctggtggtgggggacatcgcccaggtgaagtatggagacctgctgcctgcagatggagtgctgatccaggccaatgacctgaagattgatgagagcagcctgactggagagagtgaccacgtgaggaagtctgctgacaaggaccccatgctgctgagcggcacccacgtgatggagggcagcggccgcatggtggtgacagctgtgggcgtgaacagccagacaggcatcatcttcaccctgctgggcgctggaggagaggaggaggagaagaaggacaagaagggcaagcagcaggatggagccatggagagcagccagaccaaggccaagaagcaggatggagctgtggccatggagatgcagcccctgaagtctgctgagggcggggagatggaggagcgggagaagaagaaggccaatgcccccaagaaggagaagtctgtgctgcagggcaagctgaccaagctggccgtgcagatcggcaaggccggcctggtgatgtctgccatcaccgtcatcatcctggtgctgtacttcgtcatcgagacctttgtggtggagggccgcacctggctggctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcagagctacctgggggacacccactacaaggagatcccagcccccagcgccctgacccccaagatcctggacctgctggtgcacgccatcagcatcaacagcgcctacaccaccaagatcctgcccccagagaaggagggcgccctgccccggcaggtgggcaacaagacagaatgtgccctgctgggctttgtgctggacctgaagagggacttccagcctgtgcgggagcagatccctgaggacaagctgtacaaggtgtacaccttcaacagcgtgaggaagtccatgagcaccgtcatccgcatgccagatggcggcttccgcctcttcagcaaaggagccagcgagatcctgctgaagaagtgcaccaacatcctgaacagcaatggagagctgcggggcttccggccccgggacagagatgacatggtgaggaagatcatcgagcccatggcctgtgatggcctgcggaccatctgcatcgcctacagagacttctctgctggccaggagccagactgggacaatgaaaatgaggtggtgggggacctgacctgcatcgctgtggtgggcatcgaggaccctgtgcggcctgaggtgcctgaggccatcaggaagtgccagagagctggcatcaccgtgaggatggtgactggagacaacatcaacacagcccgggccatcgccgccaagtgtggcatcatccagcccggggaggacttcctgtgcctggagggcaaggagttcaacagacgcatcagaaatgagaagggggagattgagcaggagcggctggacaaggtgtggcccaagctgcgggtgctggcccggagcagccccacagacaagcacaccctggtgaagggcatcatcgacagcaccaccggggagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagagcctgctgctgaggaagccctacggccgggacaagcccctcatcagcaggaccatgatgaagaacatcctgggccatgctgtgtaccagctggccatcatcttcaccctgctgtttgtgggggagctgttctttgatattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcagcaaccccatcttctgcaccatcgtgctgggcaccttcggcatccagatcgtcatcgtgcagtttggaggcaagcccttcagctgcagccccctgagcacagagcagtggctgtggtgcctgtttgtgggcgtgggggagctggtgtggggccaggtgattgccaccatccccaccagccagctgaagtgcctgaaggaggccggccacggccctgggaaggatgagatgacagatgaggagctggccgagggggaggaggagattgaccatgctgagcgggagctgcggcggggccagatcctgtggttccggggcctgaaccgcatccagacccagatccgggtggtgaaggccttccgcagcagcctgtatgagggcctggagaagccagagagcaagaccagcatccacaacttcatggccaccccagagttcctgatcaatgactacacccacaacatccccctgattgatgacacagatgtggatgaaaatgaggagcggctgcgggcccctcctccacccagccccaaccagaacaacaatgccatcgacagcggcatctacctgaccacccacgtgaccaagagcgccaccagctctgtgttcagcagcagccctggcagccccctgcacagcgtggagaccagcctgtag

SEQ ID NO: 144380 - DNA, 3663 bp, Artificial Sequence; identical to SEQ ID NO: 144379
  Description of Artificial Sequence: Synthetic coding sequence

SEQ ID NO: 144381 - DNA, 3522 bp, Artificial Sequence
  Description of Artificial Sequence: Synthetic coding sequence
atgggagacatggccaacagcagcattgagttccaccccaagccccagcagcagagagatgtgccccaggccggcggcttcggctgcaccctggccgagctgcggaccctgatggagctgcggggagctgaggccctgcagaagattgaggaggcctatggagatgtgtctggcctgtgccggcggctgaagaccagccccacagagggcctggccgacaacaccaatgacctggagaagaggcggcagatctacggccagaacttcatcccccccaagcagcccaagaccttcctgcagctggtgtgggaggccctgcaggatgtgaccctcatcatcctggaggtggccgccatcgtgtccctgggcctgtccttctacgcccctcctggagaggagagcgaggcctgtggaaatgtgtctggaggagcagaagatgaaggagaggccgaggccggctggattgaaggagctgccatcctgctgagcgtcatctgtgtggtgctggtgacagccttcaatgactggagcaaggagaagcagttccggggcctgcagagcagaattgagcaggagcagaagttcaccgtcatcagaaatggccagctgctgcaggtgcctgtggccgccctggtggtgggggacatcgcccaggtgaagtatggagacctgctgcctgcagatggagtgctgatccaggccaatgacctgaagattgatgagagcagcctgactggagagagtgaccacgtgaggaagtctgctgacaaggaccccatgctgctgagcggcacccacgtgatggagggcagcggccgcatggtggtgacagctgtgggcgtgaacagccagacaggcatcatcttcaccctgctgggcgctggaggagaggaggaggagaagaaggacaagaagggcaagcagcaggatggagccatggagagcagccagaccaaggccaagaagcaggatggagctgtggccatggagatgcagcccctgaagtctgctgagggcggggagatggaggagcgggagaagaagaaggccaatgcccccaagaaggagaagtctgtgctgcagggcaagctgaccaagctggccgtgcagatcggcaaggccggcctggtgatgtctgccatcaccgtcatcatcctggtgctgtacttcgtcatcgagacctttgtggtggagggccgcacctggctggctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcagagctacctgggggacacccactacaaggagatcccagcccccagcgccctgacccccaagatcctggacctgctggtgcacgccatcagcatcaacagcgcctacaccaccaagatcctgcccccagagaaggagggcgccctgccccggcaggtgggcaacaagacagaatgtgccctgctgggctttgtgctggacctgaagagggacttccagcctgtgcgggagcagatccctgaggacaagctgtacaaggtgtacaccttcaacagcgtgaggaagtccatgagcaccgtcatccgcatgccagatggcggcttccgcctcttcagcaaaggagccagcgagatcctgctgaagaagtgcaccaacatcctgaacagcaatggagagctgcggggcttccggccccgggacagagatgacatggtgaggaagatcatcgagcccatggcctgtgatggcctgcggaccatctgcatcgcctacagagacttctctgctggccaggagccagactgggacaatgaaaatgaggtggtgggggacctgacctgcatcgctgtggtgggcatcgaggaccctgtgcggcctgaggtgcctgaggccatcaggaagtgccagagagctggcatcaccgtgaggatggtgactggagacaacatcaacacagcccgggccatcgccgccaagtgtggcatcatccagcccggggaggacttcctgtgcctggagggcaaggagttcaacagacgcatcagaaatgagaagggggagattgagcaggagcggctggacaaggtgtggcccaagctgcgggtgctggcccggagcagccccacagacaagcacaccctggtgaagggcatcatcgacagcaccaccggggagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagagcctgctgctgaggaagccctacggccgggacaagcccctcatcagcaggaccatgatgaagaacatcctgggccatgctgtgtaccagctggccatcatcttcaccctgctgtttgtgggggagctgttctttgatattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcagcaaccccatcttctgcaccatcgtgctgggcaccttcggcatccagatcgtcatcgtgcagtttggaggcaagcccttcagctgcagccccctgagcacagagcagtggctgtggtgcctgtttgtgggcgtgggggagctggtgtggggccaggtgattgccaccatccccaccagccagctgaagtgcctgaaggaggccggccacggccctgggaaggatgagatgacagatgaggagctggccgagggggaggaggagattgaccatgctgagcgggagctgcggcggggccagatcctgtggttccggggcctgaaccgcatccagacccagatggaggtggtgtccaccttcaagaggagcggctctgtgcagggcgctgtgagaagaagaagctctgtgctgagccagctgcatgatgtgaccaacctgagcacccccacccacgccatcctgtctgctgccaaccccaccagcgctgctggcaaccctggaggagagagcgtgccctag

SEQ ID NO: 144382 - DNA, 3480 bp, Artificial Sequence
  Description of Artificial Sequence: Synthetic coding sequence
atgggagacatggccaacagcagcattgagttccaccccaagccccagcagcagagagatgtgccccaggccggcggcttcggctgcaccctggccgagctgcggaccctgatggagctgcggggagctgaggccctgcagaagattgaggaggcctatggagatgtgtctggcctgtgccggcggctgaagaccagccccacagagggcctggccgacaacaccaatgacctggagaagaggcggcagatctacggccagaacttcatcccccccaagcagcccaagaccttcctgcagctggtgtgggaggccctgcaggatgtgaccctcatcatcctggaggtggccgccatcgtgtccctgggcctgtccttctacgcccctcctggagaggagagcgaggcctgtggaaatgtgtctggaggagcagaagatgaaggagaggccgaggccggctggattgaaggagctgccatcctgctgagcgtcatctgtgtggtgctggtgacagccttcaatgactggagcaaggagaagcagttccggggcctgcagagcagaattgagcaggagcagaagttcaccgtcatcagaaatggccagctgctgcaggtgcctgtggccgccctggtggtgggggacatcgcccaggtgaagtatggagacctgctgcctgcagatggagtgctgatccaggccaatgacctgaagattgatgagagcagcctgactggagagagtgaccacgtgaggaagtctgctgacaaggaccccatgctgctgagcggcacccacgtgatggagggcagcggccgcatggtggtgacagctgtgggcgtgaacagccagacaggcatcatcttcaccctgctgggcgctggaggagaggaggaggagaagaaggacaagaaggccaagaagcaggatggagctgtggccatggagatgcagcccctgaagtctgctgagggcggggagatggaggagcgggagaagaagaaggccaatgcccccaagaaggagaagtctgtgctgcagggcaagctgaccaagctggccgtgcagatcggcaaggccggcctggtgatgtctgccatcaccgtcatcatcctggtgctgtacttcgtcatcgagacctttgtggtggagggccgcacctggctggctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcagagctacctgggggacacccactacaaggagatcccagcccccagcgccctgacccccaagatcctggacctgctggtgcacgccatcagcatcaacagcgcctacaccaccaagatcctgcccccagagaaggagggcgccctgccccggcaggtgggcaacaagacagaatgtgccctgctgggctttgtgctggacctgaagagggacttccagcctgtgcgggagcagatccctgaggacaagctgtacaaggtgtacaccttcaacagcgtgaggaagtccatgagcaccgtcatccgcatgccagatggcggcttccgcctcttcagcaaaggagccagcgagatcctgctgaagaagtgcaccaacatcctgaacagcaatggagagctgcggggcttccggccccgggacagagatgacatggtgaggaagatcatcgagcccatggcctgtgatggcctgcggaccatctgcatcgcctacagagacttctctgctggccaggagccagactgggacaatgaaaatgaggtggtgggggacctgacctgcatcgctgtggtgggcatcgaggaccctgtgcggcctgaggtgcctgaggccatcaggaagtgccagagagctggcatcaccgtgaggatggtgactggagacaacatcaacacagcccgggccatcgccgccaagtgtggcatcatccagcccggggaggacttcctgtgcctggagggcaaggagttcaacagacgcatcagaaatgagaagggggagattgagcaggagcggctggacaaggtgtggcccaagctgcgggtgctggcccggagcagccccacagacaagcacaccctggtgaagggcatcatcgacagcaccaccggggagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagagcctgctgctgaggaagccctacggccgggacaagcccctcatcagcaggaccatgatgaagaacatcctgggccatgctgtgtaccagctggccatcatcttcaccctgctgtttgtgggggagctgttctttgatattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcagcaaccccatcttctgcaccatcgtgctgggcaccttcggcatccagatcgtcatcgtgcagtttggaggcaagcccttcagctgcagccccctgagcacagagcagtggctgtggtgcctgtttgtgggcgtgggggagctggtgtggggccaggtgattgccaccatccccaccagccagctgaagtgcctgaaggaggccggccacggccctgggaaggatgagatgacagatgaggagctggccgagggggaggaggagattgaccatgctgagcgggagctgcggcggggccagatcctgtggttccggggcctgaaccgcatccagacccagatggaggtggtgtccaccttcaagaggagcggctctgtgcagggcgctgtgagaagaagaagctctgtgctgagccagctgcatgatgtgaccaacctgagcacccccacccacgccatcctgtctgctgccaaccccaccagcgctgctggcaaccctggaggagagagcgtgccctag

SEQ ID NO: 144383 - DNA, 3480 bp, Artificial Sequence; identical to SEQ ID NO: 144382
  Description of Artificial Sequence: Synthetic coding sequence

SEQ ID NO: 144384 - DNA, 3465 bp, Artificial Sequence
  Description of Artificial Sequence: Synthetic coding sequence
atgggagacatggccaacagcagcattgagttccaccccaagccccagcagcagagagatgtgccccaggccggcggcttcggctgcaccctggccgagctgcggaccctgatggagctgcggggagctgaggccctgcagaagattgaggaggcctatggagatgtgtctggcctgtgccggcggctgaagaccagccccacagagggcctggccgacaacaccaatgacctggagaagaggcggcagatctacggccagaacttcatcccccccaagcagcccaagaccttcctgcagctggtgtgggaggccctgcaggatgtgaccctcatcatcctggaggtggccgccatcgtgtccctgggcctgtccttctacgcccctcctggagaggagagcgaggcctgtggaaatgtgtctggaggagcagaagatgaaggagaggccgaggccggctggattgaaggagctgccatcctgctgagcgtcatctgtgtggtgctggtgacagccttcaatgactggagcaaggagaagcagttccggggcctgcagagcagaattgagcaggagcagaagttcaccgtcatcagaaatggccagctgctgcaggtgcctgtggccgccctggtggtgggggacatcgcccaggtgaagtatggagacctgctgcctgcagatggagtgctgatccaggccaatgacctgaagattgatgagagcagcctgactggagagagtgaccacgtgaggaagtctgctgacaaggaccccatgctgctgagcggcacccacgtgatggagggcagcggccgcatggtggtgacagctgtgggcgtgaacagccagacaggcatcatcttcaccctgctgggcgctggaggagaggaggaggagaagaaggacaagaaggccaagaagcaggatggagctgtggccatggagatgcagcccctgaagtctgctgagggcggggagatggaggagcgggagaagaagaaggccaatgcccccaagaaggagaagtctgtgctgcagggcaagctgaccaagctggccgtgcagatcggcaaggccggcctggtgatgtctgccatcaccgtcatcatcctggtgctgtacttcgtcatcgagacctttgtggtggagggccgcacctggctggctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcagagctacctgggggacacccactacaaggagatcccagcccccagcgccctgacccccaagatcctggacctgctggtgcacgccatcagcatcaacagcgcctacaccaccaagatcctgcccccagagaaggagggcgccctgccccggcaggtgggcaacaagacagaatgtgccctgctgggctttgtgctggacctgaagagggacttccagcctgtgcgggagcagatccctgaggacaagctgtacaaggtgtacaccttcaacagcgtgaggaagtccatgagcaccgtcatccgcatgccagatggcggcttccgcctcttcagcaaaggagccagcgagatcctgctgaagaagtgcaccaacatcctgaacagcaatggagagctgcggggcttccggccccgggacagagatgacatggtgaggaagatcatcgagcccatggcctgtgatggcctgcggaccatctgcatcgcctacagagacttctctgctggccaggagccagactgggacaatgaaaatgaggtggtgggggacctgacctgcatcgctgtggtgggcatcgaggaccctgtgcggcctgaggtgcctgaggccatcaggaagtgccagagagctggcatcaccgtgaggatggtgactggagacaacatcaacacagcccgggccatcgccgccaagtgtggcatcatccagcccggggaggacttcctgtgcctggagggcaaggagttcaacagacgcatcagaaatgagaagggggagattgagcaggagcggctggacaaggtgtggcccaagctgcgggtgctggcccggagcagccccacagacaagcacaccctggtgaagggcatcatcgacagcaccaccggggagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagagcctgctgctgaggaagccctacggccgggacaagcccctcatcagcaggaccatgatgaagaacatcctgggccatgctgtgtaccagctggccatcatcttcaccctgctgtttgtgggggagctgttctttgatattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcagcaaccccatcttctgcaccatcgtgctgggcaccttcggcatccagatcgtcatcgtgcagtttggaggcaagcccttcagctgcagccccctgagcacagagcagtggctgtggtgcctgtttgtgggcgtgggggagctggtgtggggccaggtgattgccaccatccccaccagccagctgaagtgcctgaaggaggccggccacggccctgggaaggatgagatgacagatgaggagctggccgagggggaggaggagattgaccatgctgagcgggagctgcggcggggccagatcctgtggttccggggcctgaaccgcatccagacccagatggaggtggtgtccaccttcaagaggagcggctctgtgcagggcgctgtgagaagaagaagctctgtgctgagccagctgcatgatgtgaccaacctgagcacccccacccacgccatcctgtctgctgccaaccccaccagcgctgctggcagcgagagctag

SEQ ID NO: 144385 - DNA, 3513 bp, Artificial Sequence
  Description of Artificial Sequence: Synthetic coding sequence
atgaccaaccccagcgacagagtgctgcctgccaacagcatggccgagagccgggagggggactttggctgcaccgtgatggagctgaggaagctgatggagctgcggagcagagatgccctgacccagatcaacgtgcactacggcggcgtgcagaacctgtgcagccggctgaagaccagccctgtggagggcctgagcggcaacccagctgacctggagaagaggcggcaggtgtttggccacaacgtcatcccccccaagaagcccaagaccttcctggagctggtgtgggaggccctgcaggatgtgaccctcatcatcctggagattgctgccatcatcagcctggtgctgtccttctacagacctgctggggaggagaatgagctgtgtggccaggtggccaccaccccagaagatgaaaatgaggcccaggccggctggattgagggcgccgccatcctcttcagcgtcatcatcgtggtgctggtgacagccttcaatgactggagcaaggagaagcagttccggggcctgcagtgccgcatcgagcaggagcagaagttcagcatcatcagaaatggccagctgatccagctgcctgtggccgagatcgtggtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccatgctgctgagcggcacccacgtgatggagggcagcggccgcatggtggtgacagctgtgggcgtgaacagccagacaggcatcatcctgaccctgctgggcgtgaatgaagatgatgaaggagagaagaagaagaagggcaagaagcagggcgtgcctgagaacagaaacaaggccaagacccaggatggagtggccctggagatccagcccctgaacagccaggagggcatcgacaatgaggagaaggacaagaaggctgtgaaggtgcccaagaaggagaagtctgtgctgcagggcaagctgacccggctggccgtgcagatcggcaaggccggcctgctgatgtctgccctgaccgtcttcatcctgatcctgtacttcgtcatcgacaactttgtgatcaacagaagaccctggctgcctgaatgtacccccatctacatccagtactttgtgaagttcttcatcatcggcatcaccgtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcggcggcatccactaccggcagatccccagcccagatgtgttcctgcccaaggtgctggacctgattgtgaatggcatcagcatcaacagcgcctacaccagcaagatcctgcccccagagaaggagggcggcctgccccggcaggtgggcaacaagacagaatgtgccctgctgggctttgtgacagacctgaagcaggactaccaggccgtgagaaatgaggtgcctgaggagaagctgtacaaggtgtacaccttcaacagcgtgaggaagtccatgagcaccgtcatccggaaccccaatggaggcttcaggatgtacagcaaaggagccagcgagatcatcctgaggaagtgcaaccgcatcctggacaggaagggggaggccgtgcccttcaagaacaaggacagagatgacatggtgaggacagtgattgagcccatggcctgtgatggcctgcggaccatctgcatcgcctacagagactttgatgacacagagcccagctgggacaatgaaaatgagatcctgacagagctgacctgcatcgctgtggtgggcattgaagatcctgtgcggcctgaggtgcctgatgccatcgccaagtgcaagcaggccggcatcaccgtgaggatggtgactggagacaacatcaacacagcccgggccatcgccaccaagtgtggcatcctgaccccaggagatgacttcctgtgcctggagggcaaggagttcaacagactcatcagaaatgaaaaaggagaggtggagcaggagaagctggacaagatctggcccaagctgcgggtgctggcccggagcagccccacagacaagcacaccctggtgaagggcatcatcgacagcacagtgggggagcaccggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagagcctgctgaagaggcggccctatggaagaaacaagcccctcatcagcaggaccatgatgaagaacatcctgggccacgccttctaccagctgattgtcatcttcatcctggtgtttgctggggagaagttctttgacatcgacagcggcaggaaggcccccctgcacagcccccccagccagcactacaccatcgtgttcaacacctttgtgctgatgcagctgttcaatgagatcaacagcaggaagatccacggggagaagaatgtgttttctggcatctacagaaacatcatcttctgcagcgtggtgctgggcaccttcatctgccagatcttcatcgtggagtttggaggcaagcccttcagctgcaccagcctgagcctgagccagtggctgtggtgcctcttcatcggcattggagagctgctgtggggccagttcatcagcgccatccccaccaggagcctgaagttcctgaaggaggccggccacggcaccaccaaggaggagatcaccaaggatgctgagggcctggatgaaattgaccacgccgagatggagctgcggcggggccagatcctgtggttccggggcctgaaccgcatccagacccagattgatgtgatcaacaccttccagacaggagccagcttcaagggcgtgctgcggcggcagaacatgggccagcacctggatgtgaagctggtgcccagcagcagctatgtggccgtggcccctgtgaagagcagccccaccacctctgtgcctgctgtgagcagcccccccatgggcaaccagagcggccagagcgtgccctag

SEQ ID NO: 144386 - DNA, 390 bp, Artificial Sequence
  Description of Artificial Sequence: Synthetic coding sequence
tgaattggagagctgctgtggggccagttcatcagcgccatccccaccaggagcctgaagttcctgaaggaggccggccacggcaccaccaaggaggagatcaccaaggatgctgagggcctggatgaaattgaccatgctgagatggagctgcggcggggccagatcctgtggttccggggcctgaaccgcatccagacccagattgatgtgatcaacaccttccagacaggagccagcttcaagggcgtgctgcggcggcagaacatgggccagcacctggatgtgaagctggtgcccagcagcagctatgtggccgtggcccctgtgaagagcagccccaccacctctgtgcctgctgtgagcagcccccccatgggcagcgagtag

SEQ ID NO: 144387 - DNA, 3618 bp, Artificial Sequence
  Description of Artificial Sequence: Synthetic coding sequence
atgaccaaccccagcgacagagtgctgcctgccaacagcatggccgagagccgggagggggactttggctgcaccgtgatggagctgaggaagctgatggagctgcggagcagagatgccctgacccagatcaacgtgcactacggcggcgtgcagaacctgtgcagccggctgaagaccagccctgtggagggcctgagcggcaacccagctgacctggagaagaggcggcaggtgtttggccacaacgtcatcccccccaagaagcccaagaccttcctggagctggtgtgggaggccctgcaggatgtgaccctcatcatcctggagattgctgccatcatcagcctggtgctgtccttctacagacctgctggggaggagaatgagctgtgtggccaggtggccaccaccccagaagatgaaaatgaggcccaggccggctggattgagggcgccgccatcctcttcagcgtcatcatcgtggtgctggtgacagccttcaatgactggagcaaggagaagcagttccggggcctgcagtgccgcatcgagcaggagcagaagttcagcatcatcagaaatggccagctgatccagctgcctgtggccgagatcgtggtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccatgctgctgagcggcacccacgtgatggagggcagcggccgcatggtggtgacagctgtgggcgtgaacagccagacaggcatcatcctgaccctgctgggcgtgaatgaagatgatgaaggagagaagaagaagaagggcaagaagcagggcgtgcctgagaacagaaacaaggccaagacccaggatggagtggccctggagatccagcccctgaacagccaggagggcatcgacaatgaggagaaggacaagaaggctgtgaaggtgcccaagaaggagaagtctgtgctgcagggcaagctgacccggctggccgtgcagatcggcaaggccggcctgctgatgtctgccctgaccgtcttcatcctgatcctgtacttcgtcatcgacaactttgtgatcaacagaagaccctggctgcctgaatgtacccccatctacatccagtactttgtgaagttcttcatcatcggcatcaccgtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcggcggcatccactaccggcagatccccagcccagatgtgttcctgcccaaggtgctggacctgattgtgaatggcatcagcatcaacagcgcctacaccagcaagatcctgcccccagagaaggagggcggcctgccccggcaggtgggcaacaagacagaatgtgccctgctgggctttgtgacagacctgaagcaggactaccaggccgtgagaaatgaggtgcctgaggagaagctgtacaaggtgtacaccttcaacagcgtgaggaagtccatgagcaccgtcatccggaaccccaatggaggcttcaggatgtacagcaaaggagccagcgagatcatcctgaggaagtgcaaccgcatcctggacaggaagggggaggccgtgcccttcaagaacaaggacagagatgacatggtgaggacagtgattgagcccatggcctgtgatggcctgcggaccatctgcatcgcctacagagactttgatgacacagagcccagctgggacaatgaaaatgagatcctgacagagctgacctgcatcgctgtggtgggcattgaagatcctgtgcggcctgaggtgcctgatgccatcgccaagtgcaagcaggccggcatcaccgtgaggatggtgactggagacaacatcaacacagcccgggccatcgccaccaagtgtggcatcctgaccccaggagatgacttcctgtgcctggagggcaaggagttcaacagactcatcagaaatgaaaaaggagaggtggagcaggagaagctggacaagatctggcccaagctgcgggtgctggcccggagcagccccacagacaagcacaccctggtgaagggcatcatcgacagcacagtgggggagcaccggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagagcctgctgaagaggcggccctatggaagaaacaagcccctcatcagcaggaccatgatgaagaacatcctgggccacgccttctaccagctgattgtcatcttcatcctggtgtttgctggggagaagttctttgacatcgacagcggcaggaaggcccccctgcacagcccccccagccagcactacaccatcgtgttcaacacctttgtgctgatgcagctgttcaatgagatcaacagcaggaagatccacggggagaagaatgtgttttctggcatctacagaaacatcatcttctgcagcgtggtgctgggcaccttcatctgccagatcttcatcgtggagtttggaggcaagcccttcagctgcaccagcctgagcctgagccagtggctgtggtgcctcttcatcggcattggagagctgctgtggggccagttcatcagcgccatccccaccaggagcctgaagttcctgaaggaggccggccacggcaccaccaaggaggagatcaccaaggatgctgagggcctggatgaaattgaccacgccgagatggagctgcggcggggccagatcctgtggttccggggcctgaaccgcatccagacccagatcaaggtggtgaaggccttccacagcagcctgcacgagagcatccagaagccctacaaccagaagagcatccacagcttcatgacccaccctgagtttgccatcgaggaggagctgcccaggacccccctgctggatgaggaggaggaggagaacccagacaaggccagcaagtttggcaccagggtgctgctgctggatggagaggtgaccccctatgccaacaccaacaacaatgctgtggactgcaaccaggtgcagctgccccagagcgacagcagcctgcagagcctggagacctctgtgtag

SEQ ID NO: 144388 - DNA, 3513 bp, Artificial Sequence; identical to SEQ ID NO: 144385
  Description of Artificial Sequence: Synthetic coding sequence

SEQ ID NO: 144389 - DNA, 3477 bp, Artificial Sequence
  Description of Artificial Sequence: Synthetic coding sequence
atgaccaaccccagcgacagagtgctgcctgccaacagcatggccgagagccgggagggggactttggctgcaccgtgatggagctgaggaagctgatggagctgcggagcagagatgccctgacccagatcaacgtgcactacggcggcgtgcagaacctgtgcagccggctgaagaccagccctgtggagggcctgagcggcaacccagctgacctggagaagaggcggcaggtgtttggccacaacgtcatcccccccaagaagcccaagaccttcctggagctggtgtgggaggccctgcaggatgtgaccctcatcatcctggagattgctgccatcatcagcctggtgctgtccttctacagacctgctggggaggagaatgagctgtgtggccaggtggccaccaccccagaagatgaaaatgaggcccaggccggctggattgagggcgccgccatcctcttcagcgtcatcatcgtggtgctggtgacagccttcaatgactggagcaaggagaagcagttccggggcctgcagtgccgcatcgagcaggagcagaagttcagcatcatcagaaatggccagctgatccagctgcctgtggccgagatcgtggtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccatgctgctgagcggcacccacgtgatggagggcagcggccgcatggtggtgacagctgtgggcgtgaacagccagacaggcatcatcctgaccctgctgggcgtgaatgaagatgatgaaggagagaagaagaagaaggccaagacccaggatggagtggccctggagatccagcccctgaacagccaggagggcatcgacaatgaggagaaggacaagaaggctgtgaaggtgcccaagaaggagaagtctgtgctgcagggcaagctgacccggctggccgtgcagatcggcaaggccggcctgctgatgtctgccctgaccgtcttcatcctgatcctgtacttcgtcatcgacaactttgtgatcaacagaagaccctggctgcctgaatgtacccccatctacatccagtactttgtgaagttcttcatcatcggcatcaccgtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcggcggcatccactaccggcagatccccagcccagatgtgttcctgcccaaggtgctggacctgattgtgaatggcatcagcatcaacagcgcctacaccagcaagatcctgcccccagagaaggagggcggcctgccccggcaggtgggcaacaagacagaatgtgccctgctgggctttgtgacagacctgaagcaggactaccaggccgtgagaaatgaggtgcctgaggagaagctgtacaaggtgtacaccttcaacagcgtgaggaagtccatgagcaccgtcatccggaaccccaatggaggcttcaggatgtacagcaaaggagccagcgagatcatcctgaggaagtgcaaccgcatcctggacaggaagggggaggccgtgcccttcaagaacaaggacagagatgacatggtgaggacagtgattgagcccatggcctgtgatggcctgcggaccatctgcatcgcctacagagactttgatgacacagagcccagctgggacaatgaaaatgagatcctgacagagctgacctgcatcgctgtggtgggcattgaagatcctgtgcggcctgaggtgcctgatgccatcgccaagtgcaagcaggccggcatcaccgtgaggatggtgactggagacaacatcaacacagcccgggccatcgccaccaagtgtggcatcctgaccccaggagatgacttcctgtgcctggagggcaaggagttcaacagactcatcagaaatgaaaaaggagaggtggagcaggagaagctggacaagatctggcccaagctgcgggtgctggcccggagcagccccacagacaagcacaccctggtgaagggcatcatcgacagcacagtgggggagcaccggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagagcctgctgaagaggcggccctatggaagaaacaagcccctcatcagcaggaccatgatgaagaacatcctgggccacgccttctaccagctgattgtcatcttcatcctggtgtttgctggggagaagttctttgacatcgacagcggcaggaaggcccccctgcacagcccccccagccagcactacaccatcgtgttcaacacctttgtgctgatgcagctgttcaatgagatcaacagcaggaagatccacggggagaagaatgtgttttctggcatctacagaaacatcatcttctgcagcgtggtgctgggcaccttcatctgccagatcttcatcgtggagtttggaggcaagcccttcagctgcaccagcctgagcctgagccagtggctgtggtgcctcttcatcggcattggagagctgctgtggggccagttcatcagcgccatccccaccaggagcctgaagttcctgaaggaggccggccacggcaccaccaaggaggagatcaccaaggatgctgagggcctggatgaaattgaccacgccgagatggagctgcggcggggccagatcctgtggttccggggcctgaaccgcatccagacccagattgatgtgatcaacaccttccagacaggagccagcttcaagggcgtgctgcggcggcagaacatgggccagcacctggatgtgaagctggtgcccagcagcagctatgtggccgtggcccctgtgaagagcagccccaccacctctgtgcctgctgtgagcagcccccccatgggcaaccagagcggccagagcgtgccctag

SEQ ID NO: 144390 - DNA, 3405 bp, Artificial Sequence
  Description of Artificial Sequence: Synthetic coding sequence
atgaccaaccccagcgacagagtgctgcctgccaacagcatggccgagagccgggagggggactttggctgcaccgtgatggagctgaggaagctgatggagctgcggagcagagatgccctgacccagatcaacgtgcactacggcggcgtgcagaacctgtgcagccggctgaagaccagccctgtggagggcctgagcggcaacccagctgacctggagaagaggcggcaggtgtttggccacaacgtcatcccccccaagaagcccaagaccttcctggagctggtgtgggaggccctgcaggatgtgaccctcatcatcctggagattgctgccatcatcagcctggtgctgtccttctacagacctgctggggaggagaatgagctgtgtggccaggtggccaccaccccagaagatgaaaatgaggcccaggccggctggattgagggcgccgccatcctcttcagcgtcatcatcgtggtgctggtgacagccttcaatgactggagcaaggagaagcagttccggggcctgcagtgccgcatcgagcaggagcagaagttcagcatcatcagaaatggccagctgatccagctgcctgtggccgagatcgtggtgggggacatcgcccaggtgaagtacggggacctgctgcctgcagatggcatcctgatccagggcaatgacctgaagattgatgagagcagcctgaccggggagagtgaccacgtgaagaagagcctggacaaggaccccatgctgctgagcggcacccacgtgatggagggcagcggccgcatggtggtgacagctgtgggcgtgaacagccagacaggcatcatcctgaccctgctgggcgtgaatgaagatgatgaaggagagaagaagaagaagggcaagaagcagggcgtgcctgagaacagaaacaaggccaagacccaggatggagtggccctggagatccagcccctgaacagccaggagggcatcgacaatgaggagaaggacaagaaggctgtgaaggtgcccaagaaggagaagtctgtgctgcagggcaagctgacccggctggccgtgcagatcggcaaggccggcctgctgatgtctgccctgaccgtcttcatcctgatcctgtacttcgtcatcgacaactttgtgatcaacagaagaccctggctgcctgaatgtacccccatctacatccagtactttgtgaagttcttcatcatcggcatcaccgtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccatgaacaggatgacagtggtgcaggcctacatcggcggcatccactaccggcagatccccagcccagatgtgttcctgcccaaggtgctggacctgattgtgaatggcatcagcatcaacagcgcctacaccagcaagatcctgcccccagagaaggagggcggcctgccccggcaggtgggcaacaagacagaatgtgccctgctgggctttgtgacagacctgaagcaggactaccaggccgtgagaaatgaggtgcctgaggagaagctgtacaaggtgtacaccttcaacagcgtgaggaagtccatgagcaccgtcatccggaaccccaatggaggcttcaggatgtacagcaaaggagccagcgagatcatcctgaggaagtgcaaccgcatcctggacaggaagggggaggccgtgcccttcaagaacaaggacagagatgacatggtgaggacagtgattgagcccatggcctgtgatggcctgcggaccatctgcatcgcctacagagactttgatgacacagagcccagctgggacaatgaaaatgagatcctgacagagctgacctgcatcgctgtggtgggcattgaagatcctgtgcggcctgaggtgcctgatgccatcgccaagtgcaagcaggccggcatcaccgtgaggatggtgactggagacaacatcaacacagcccgggccatcgccaccaagtgtggcatcctgaccccaggagatgacttcctgtgcctggagggcaaggagttcaacagactcatcagaaatgaaaaaggagaggtggagcaggagaagctggacaagatctggcccaagctgcgggtgctggcccggagcagccccacagacaagcacaccctggtgaagggcatcatcgacagcacagtgggggagcaccggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtcatcgtggccttcaccggggcctgcatcacccaggacagccccctgaaggctgtgcagatgctgtgggtgaacctgatcatggacacctttgccagcctggccctggccacagagcccccaacagagagcctgctgaagaggcggccctatggaagaaacaagcccctcatcagcaggaccatgatgaagaacatcctgggccacgccttctaccagctgattgtcatcttcatcctggtgtttgctggggagaagttctttgacatcgacagcggcaggaaggcccccctgcacagcccccccagccagcactacaccatcgtgttcaacacctttgtgctgatgcagctgttcaatgagatcaacagcaggaagatccacggggagaagaatgtgttttctggcatctacagaaacatcatcttctgcagcgtggtgctgggcaccttcatctgccagttcatcagcgccatccccaccaggagcctgaagttcctgaaggaggccggccacggcaccaccaaggaggagatcaccaaggatgctgagggcctggatgaaattgaccacgccgagatggagctgcggcggggccagatcctgtggttccggggcctgaaccgcatccagacccagattgatgtgatcaacaccttccagacaggagccagcttcaagggcgtgctgcggcggcagaacatgggccagcacctggatgtgaagctggtgcccagcagcagctatgtggccgtggcccctgtgaagagcagccccaccacctctgtgcctgctgtgagcagcccccccatgggcaaccagagcggccagagcgtgccctag

SEQ ID NO: 144391 - DNA, 354 bp, Artificial Sequence
  Description of Artificial Sequence: Synthetic coding sequence
tgaggaggcaagcccttcagctgcaccagcctgagcctgagccagtggctgtggtgcctcttcatcggcatcggggagctgctgtggggccagttcatcagcgccatccccaccaggagcctgaagttcctgaaggaggccggccacggcaccaccaaggaggagatcaccaaggatgctgagggcctggatgaaattgaccatgctgagatggagctgcggcggggccagatcctgtggttccggggcctgaaccgcatccagacccagcacctgctgcaggacagcgacctgctgcctgacaaggaggaggccatcatcagcagcagcctcttccccagctgcaacttctag

SEQ ID NO: 144392 - DNA, 2667 bp, Artificial Sequence
  Description of Artificial Sequence: Synthetic coding sequence
atgaaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctgggcctggccctgggggaggagtggacagctgctggatag

SEQ ID NO: 144393 - DNA, 2877 bp, Artificial Sequence
  Description of Artificial Sequence: Synthetic coding sequence
aaggtggcccgcttccagaagatccccaacggggagaatgagaccatgatccctgtgctgaccagcaagaaggccagcgagctgcctgtgtctgaggtggccagcatcctgcaggccgacctgcagaatggcctgaacaagtgtgaggtgagccacagaagagccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaagctgtggacctgagcattgatgagagcagcctgaccggggagaccaccccctgcagcaaggtgacagccccccagcctgctgccaccaacggggacctggccagccgcagcaacatcgccttcatgggcaccctggtgcgctgtgggaaggccaagggcgtggtgattggcaccggggagaacagcgagtttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcacgccgaggtgactggagtgggctacaaccagtttggagaggtgattgtggatggagatgtggtgcacggcttctacaacccagctgtgtccagaattgtggaggccggctgtgtgtgcaatgatgctgtgatccggaacaacaccctgatgggcaagcccacagaaggagccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcatcgacccccccaggactggagtgaaggaggccgtgaccaccctgattgccagcggcgtgtccatcaagatgatcactggagacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacatcggcgtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagcccccaagaaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgaaattggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgagcagcaccagcagcagcttcctggaggtgagcagcagcagcggcaactttgtggccgtgtggctgtgggagaggagcggccagcagctggtggagatccacccccacctggagaccggcctgcccctgacagaagatgtgtcctgtgtgtag

SEQ ID NO: 144394 - DNA, 2850 bp, Artificial Sequence
  Description of Artificial Sequence: Synthetic coding sequence
atgaaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgagcagcaccagcagcagcttcctggaggtgtggctgtgggagaggagcggccagcagctggtggagatccacccccacctggagaccggcctgcccctgacagaagatgtgtcctgtgtgtag

SEQ ID NO: 144395 - DNA, 2922 bp, Artificial Sequence
  Description of Artificial Sequence: Synthetic coding sequence
atggacagcctgctgccccccagccgcttctcctacttcaagaagtaccccctgcacgccatccgccgctacctgagcaccctgaggaaccagagagctgaggagcaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgtggctgtgggagaggagcggccagcagctggtggagatccacccccacctggagaccggcctgcccctgacagaagatgtgtcctgtgtgtag

SEQ ID NO: 144396 - DNA, 2820 bp, Artificial Sequence
  Description of Artificial Sequence: Synthetic coding sequence
atgaaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgtggctgtgggagaggagcggccagcagctggtggagatccacccccacctggagaccggcctgcccctgacagaagatgtgtcctgtgtgtag

SEQ ID NO: 144397 - DNA, 2760 bp, Artificial Sequence
  Description of Artificial Sequence: Synthetic coding sequence
atgaaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgagcagcaccagcagcagcttcctggaggtgtag

SEQ ID NO: 144398 - DNA, 2712 bp, Artificial Sequence
  Description of Artificial Sequence: Synthetic coding sequence
atgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgagcagcaccagcagcagcttcctggaggtgtag

SEQ ID NO: 144399 - DNA, 363 bp, Artificial Sequence
  Description of Artificial Sequence: Synthetic coding sequence
atgaaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcagtag

SEQ ID NO: 144400 - DNA, 2712 bp, Artificial Sequence; identical to SEQ ID NO: 144398
  Description of Artificial Sequence: Synthetic coding sequence

SEQ ID NO: 144401 - DNA, 2772 bp, Artificial Sequence
  Description of Artificial Sequence: Synthetic coding sequence
atgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaggccgtggacctgagcattgatgagagcagcctgactggagagaccaccccctgcagcaaggtgacagccccccagcctgctgccaccaatggagacctggccagccgcagcaacatcgccttcatgggcaccctggtgcgctgtgggaaggccaagggcgtggtgattggaactggagaaaattctgaatttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcatgctgaggtgactggagtgggctacaaccagtttggagaggtgattgtggatggagatgtggtgcacggcttctacaacccagctgtgagccgcatcgtggaggccggctgtgtgtgcaatgatgctgtgatccggaacaacaccctgatgggcaagcccacagagggcgccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcattgatcctcccaggactggagtgaaggaggccgtgaccaccctcatcgccagcggcgtgtccatcaagatgatcaccggggacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacattggagtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagccacccaggaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgagatcggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgtggctgtgggagaggagcggccagcagctggtggagatccacccccacctggagaccggcctgcccctgacagaagatgtgtcctgtgtgtag

SEQ ID NO: 144402 - DNA, 249 bp, Artificial Sequence
  Description of Artificial Sequence: Synthetic coding sequence
atgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcactag

SEQ ID NO: 144403 - DNA, 2760 bp, Artificial Sequence; identical to SEQ ID NO: 144397
  Description of Artificial Sequence: Synthetic coding sequence

SEQ ID NO: 144404 - DNA, 309 bp, Artificial Sequence
  Description of Artificial Sequence: Synthetic coding sequence
atgaaggtggcccgcttccagaagatccccaatggagaaaatgagaccatgatccctgtgctgaccagcaagaaggccagcgagctgcctgtgtctgaggtggccagcatcctgcaggccgacctgcagaatggcctgaacaagtgtgaggtgagccaccggcgggccttccacggctggaatgaatttgacatcagtgaagatgagcccctgtggaagaagtacatcagccagttcaagaaccccctcatcatgctgctgctggccagcgctgtgatctctgtgctgatgcaccagtttgatgactag

SEQ ID NO: 144405 - DNA, 2760 bp, Artificial Sequence; identical to SEQ ID NO: 144397
  Description of Artificial Sequence: Synthetic coding sequence

SEQ ID NO: 144406 - DNA, 2772 bp, Artificial Sequence; identical to SEQ ID NO: 144401
  Description of Artificial Sequence: Synthetic coding sequence

SEQ ID NO: 144407 - DNA, 2835 bp, Artificial Sequence
  Description of Artificial Sequence: Synthetic coding sequence
atggacagcctgctgccccccagccgcttctcctacttcaagaagtaccccctgcacgccatccgccgctacctgagcaccctgaggaaccagagagctgaggagcaggtggcccgcttccagaagatccccaatggagaaaatgagaccatgatccctgtgctgaccagcaagaaggccagcgagctgcctgtgtctgaggtggccagcatcctgcagttcaagaaccccctcatcatgctgctgctggccagcgctgtgatctctgtgctgatgcaccagtttgatgatgctgtgtccatcaccgtggccatcctgattgtggtgacagtggcctttgtgcaggagtacagaagtgagaagagcctggaggagctgagcaagctggtgcccccagagtgccactgtgtgcgggagggcaagctggagcacaccctggcccgggacctggtgcctggggacacagtgtgcctgtctgtgggggacagagtgcctgctgacctgcggctgtttgaagctgtggacctgagcattgatgagagcagcctgaccggggagaccaccccctgcagcaaggtgacagccccccagcctgctgccaccaacggggacctggccagccgcagcaacatcgccttcatgggcaccctggtgcgctgtgggaaggccaagggcgtggtgattggcaccggggagaacagcgagtttggagaggtgttcaagatgatgcaggccgaggaggcccccaagacccccctgcagaagtccatggacctgctgggcaagcagctgtccttctacagctttggcatcatcggcatcatcatgctggtgggctggctgctgggcaaggacatcctggagatgttcaccatctctgtgtccctggccgtggccgccatccctgagggcctgcccatcgtggtgacagtgaccctggccctgggcgtgatgaggatggtgaagaagagggccatcgtgaagaagctgcccatcgtggagaccctgggctgctgcaacgtcatctgcagcgacaagacaggcaccctgaccaagaatgagatgacagtgacccacatcttcaccagtgatggcctgcacgccgaggtgactggagtgggctacaaccagtttggagaggtgattgtggatggagatgtggtgcacggcttctacaacccagctgtgtccagaattgtggaggccggctgtgtgtgcaatgatgctgtgatccggaacaacaccctgatgggcaagcccacagaaggagccctgattgccctggccatgaagatgggcctggatggcctgcagcaggactacatcaggaaggccgagtaccccttcagcagcgagcagaagtggatggctgtgaagtgtgtgcacaggacccagcaggacaggcctgagatctgcttcatgaagggggcctatgagcaggtgatcaagtactgcaccacctaccagagcaagggccagaccctgaccctgacccagcagcagagagatgtgtaccagcaggagaaggccaggatgggcagcgctggcctgcgggtgctggccctggccagcggccctgagctgggccagctgaccttcctgggcctggtgggcatcatcgacccccccaggactggagtgaaggaggccgtgaccaccctgattgccagcggcgtgtccatcaagatgatcactggagacagccaggagacagctgtggccatcgccagccggctgggcctgtacagcaagaccagccagagcgtgtctggagaggagattgatgccatggatgtgcagcagctgagccagatcgtgcccaaggtggccgtgttctaccgggccagccccaggcacaagatgaagatcatcaagagcctgcagaagaatggatctgtggtggccatgactggagatggagtgaatgatgctgtggccctgaaggctgctgacatcggcgtggccatgggccagacaggaacagatgtgtgcaaggaggccgctgacatgatcctggtggatgatgacttccagaccatcatgtctgccatcgaggagggcaagggcatctacaacaacatcaagaactttgtgcgcttccagctgagcaccagcattgctgccctgaccctcatcagcctggccaccctgatgaacttccccaaccccctgaatgccatgcagatcctgtggatcaacatcatcatggatggccccccagcccagagcctgggcgtggagcctgtggacaaggatgtgatcaggaagcccccaagaaactggaaggacagcatcctgaccaagaacctgatcctgaagatcctggtgagcagcatcatcatcgtgtgtggcaccctgtttgtgttctggagggagctgcgggacaacgtcatcaccccccgggacaccaccatgaccttcacctgctttgtgttctttgacatgtttaatgccctgagcagccgcagccagaccaagtctgtgtttgaaattggcctgtgcagcaacaggatgttctgctatgctgtgctgggcagcatcatgggccagctgctggtgatctacttcccccccctgcagaaggtgttccagacagagagcctgagcatcctggacctgctcttcctgctgggcctgaccagctctgtgtgcatcgtggccgagatcatcaagaaggtggagaggagccgggagaagatccagaagcacgtgagcagcaccagcagcagcttcctggaggtgtggctgtgggagaggagcggccagcagctggtggagatccacccccacctggagaccggcctgcccctgacagaagatgtgtcctgtgtgtag

SEQ ID NO: 144408 - DNA, 2841 bp, Artificial Sequence
  Description of Artificial Sequence: Synthetic coding sequence
atggtggagggccgggtgtctgagttcctgaagaagctgggcttcagcggcggcggccggcagtaccaggccctggagaaggatgaggaggaggccctgattgatgagcagagcgagctgaaggccatcgagaaggagaagaaggtgacagccctgccccccaaggaggcctgcaagtgccagaaggaggacctggcccgggccttctgtgtggacctgcacacaggcctgtctgagttctctgtgacccagaggcggctggcccacggctggaatgaatttgtggccgacaacagcgagcctgtgtggaagaagtacctggaccagttcaagaaccccctcatcctgctgctgctgggcagcgccctggtgtctgtgctgaccaaggagtatgaagatgctgtgtccatcgccacagctgtgctggtggtggtgacagtggccttcatccaggagtacagaagtgagaagagcctggaggagctgaccaagatggtgcccccagagtgcaactgcctgcgggagggcaagctgcagcacctgctggcccgggagctggtgcctggagatgtggtgtccctgagcatcggggaccgcatcccagctgacatccggctgacagaggtgacagacctgctggtggatgagagcagcttcaccggggaggccgagccctgcagcaagacagacagccccctgaccggcggcggggacctgaccaccctgagcaacatcgtgttcatgggcaccctggtgcagtatggccggggccagggcgtggtgattggcaccggggagagcagccagtttggagaggtgttcaagatgatgcaggccgaggagacccccaagacccccctgcagaagtccatggaccggctgggcaagcagctgaccctcttctcctttggcatcatcggcctcatcatgctgattggctggagccagggcaagcagctgctgtccatgttcaccatcggcgtgtccctggccgtggccgccatccctgagggcctgcccatcgtggtgatggtgaccctggtgctgggcgtgctgaggatggccaagaagagggtcatcgtgaagaagctgcccatcgtggagaccctgggctgctgcagcgtgctgtgcagcgacaagacaggcaccctgacagccaatgagatgacagtgacccagctggtgaccagtgatggcctgcgggcagaggtgtctggagtgggctatgatggccagggcaccgtgtgcctgctgcccagcaaggaggtgatcaaggagttcagcaatgtgtctgtgggcaagctggtggaggccggctgtgtggccaacaatgctgtgatcaggaagaatgctgtgatgggccagcccacagaaggagccctgatggccctggccatgaagatggacctgagtgacatcaagaacagctacatcaggaagaaggagatccccttcagcagcgagcagaagtggatggctgtgaagtgcagcctgaagacagaggaccaggaggacatctacttcatgaagggggccctggaggaggtgatccgctactgcaccatgtacaacaatggaggcatccccctgcccctgaccccccagcagaggagcttctgcctgcaggaggagaagaggatgggcagcctgggcctgcgggtgctggccctggccagcggccctgagctgggccgcctgaccttcctgggcctggtgggcatcattgatcctccccgggtgggcgtgaaggaggccgtgcaggtgctgtctgagagcggcgtgtctgtgaagatgatcactggagatgccctggagacagccctggccatcggcaggaacatcggcctgtgcaatggcaagctgcaggccatgtctggagaggaggtggacagcgtggagaagggggagctggccgacagagtgggcaaggtgtctgtgttcttccgcaccagccccaagcacaagctgaagatcatcaaggccctgcaggagagcggggccatcgtggccatgactggagatggagtgaatgatgctgtggccctgaagtctgctgacattggaattgccatgggccagacaggaacagatgtgtccaaggaggccgccaacatgatcctggtggatgatgacttcagcgccatcatgaatgctgtggaggagggcaagggcatcttctacaacatcaagaactttgtgcgcttccagctgagcaccagcatcagcgccctgagcctcatcaccctgagcacagtgttcaacctgcccagccccctgaatgccatgcagatcctgtggatcaacatcatcatggatggccccccagcccagagcctgggcgtggagcctgtggacaaggatgccttccggcagccccccaggtctgtgcgggacaccatcctgagccgggccctgatcctgaagatcctgatgtctgctgccatcatcatcagcggcaccctcttcatcttctggaaggagatgcctgaggaccgggccagcacccccaggaccaccaccatgaccttcacctgctttgtgttctttgacctcttcaatgccctgacctgccgcagccagaccaagctgatctttgaaattggcttcctgaggaaccacatgttcctgtacagcgtgctgggcagcatcctgggccagctggccgtcatctacatcccccccctgcagagggtcttccagacagagaacctgggcgccctggacctgctcttcctgaccggcctggccagcagcgtcttcatcctgtctgagctgctgaagctgtgtgagaagtactgctgcagccccaagagggtgcagatgcacccagaagatgtgtag

SEQ ID NO: 144409 - DNA, 2928 bp, Artificial Sequence
  Description of Artificial Sequence: Synthetic coding sequence
atggtggagggccgggtgtctgagttcctgaagaagctgggcttcagcggcggcggccggcagtaccaggccctggagaaggatgaggaggaggccctgattgatgagcagagcgagctgaaggccatcgagaaggagaagaaggtgacagccctgccccccaaggaggcctgcaagtgccagaaggaggacctggcccgggccttctgtgtggacctgcacacaggcctgtctgagttctctgtgacccagaggcggctggcccacggctggaatgaatttgtggccgacaacagcgagcctgtgtggaagaagtacctggaccagttcaagaaccccctcatcctgctgctgctgggcagcgccctggtgtctgtgctgaccaaggagtatgaagatgctgtgtccatcgccacagctgtgctggtggtggtgacagtggccttcatccaggagtacagaagtgagaagagcctggaggagctgaccaagatggtgcccccagagtgcaactgcctgcgggagggcaagctgcagcacctgctggcccgggagctggtgcctggagatgtggtgtccctgagcatcggggaccgcatcccagctgacatccggctgacagaggtgacagacctgctggtggatgagagcagcttcaccggggaggccgagccctgcagcaagacagacagccccctgaccggcggcggggacctgaccaccctgagcaacatcgtgttcatgggcaccctggtgcagtatggccggggccagggcgtggtgattggcaccggggagagcagccagtttggagaggtgttcaagatgatgcaggccgaggagacccccaagacccccctgcagaagtccatggaccggctgggcaagcagctgaccctcttctcctttggcatcatcggcctcatcatgctgattggctggagccagggcaagcagctgctgtccatgttcaccatcggcgtgtccctggccgtggccgccatccctgagggcctgcccatcgtggtgatggtgaccctggtgctgggcgtgctgaggatggccaagaagagggtcatcgtgaagaagctgcccatcgtggagaccctgggctgctgcagcgtgctgtgcagcgacaagacaggcaccctgacagccaatgagatgacagtgacccagctggtgaccagtgatggcctgcgggcagaggtgtctggagtgggctatgatggccagggcaccgtgtgcctgctgcccagcaaggaggtgatcaaggagttcagcaatgtgtctgtgggcaagctggtggaggccggctgtgtggccaacaatgctgtgatcaggaagaatgctgtgatgggccagcccacagaaggagccctgatggccctggccatgaagatggacctgagtgacatcaagaacagctacatcaggaagaaggagatccccttcagcagcgagcagaagtggatggctgtgaagtgcagcctgaagacagaggaccaggaggacatctacttcatgaagggggccctggaggaggtgatccgctactgcaccatgtacaacaatggaggcatccccctgcccctgaccccccagcagaggagcttctgcctgcaggaggagaagaggatgggcagcctgggcctgcgggtgctggccctggccagcggccctgagctgggccgcctgaccttcctgggcctggtgggcatcattgatcctccccgggtgggcgtgaaggaggccgtgcaggtgctgtctgagagcggcgtgtctgtgaagatgatcactggagatgccctggagacagccctggccatcggcaggaacatcggcctgtgcaatggcaagctgcaggccatgtctggagaggaggtggacagcgtggagaagggggagctggccgacagagtgggcaaggtgtctgtgttcttccgcaccagccccaagcacaagctgaagatcatcaaggccctgcaggagagcggggccatcgtggccatgactggagatggagtgaatgatgctgtggccctgaagtctgctgacattggaattgccatgggccagacaggaacagatgtgtccaaggaggccgccaacatgatcctggtggatgatgacttcagcgccatcatgaatgctgtggaggagggcaagggcatcttctacaacatcaagaactttgtgcgcttccagctgagcaccagcatcagcgccctgagcctcatcaccctgagcacagtgttcaacctgcccagccccctgaatgccatgcagatcctgtggatcaacatcatcatggatggccccccagcccagaggagcagccagaagacagaggtgtgctgcacagctgtgcggctgggcgtggagggccgcggggagagcacctgggccggccgggccggcctgggcgtggagcctgtggacaaggatgccttccggcagcccccaagatctgtgcgggacaccatcctgagccgggccctgatcctgaagatcctgatgtctgctgccatcatcatcagcggcaccctcttcatcttctggaaggagatgccagaagatcgggccagcacccccaggaccaccaccatgaccttcacctgctttgtgttctttgacctcttcaatgccctgacctgccgcagccagaccaagctgatctttgagatcggcttcctgaggaaccacatgttcctgtacagcgtgctgggcagcatcctgggccagctggccgtcatctacatcccccccctgcagagggtcttccagacagagaacctgggcgccctggacctgctcttcctgaccggcctggccagctctgtgttcatcctgtctgagctgctgaagctgtgtgagaagtactgctgcagccccaagagggtgcagatgcacccagaagatgtgtag

SEQ ID NO: 144410 - DNA, 2388 bp, Artificial Sequence
  Description of Artificial Sequence: Synthetic coding sequence
atgaggaccccatctgccagcccccggcagtgcctgtcctggagcctgagccccagcagcagcctgcgggagggcaagctgcagcacctgctggcccgggagctggtgcctggagatgtggtgtccctgagcattggagaccgcatcccagctgacatccggctgacagaggtgacagacctgctggtggatgagagcagcttcaccggggaggccgagccctgcagcaagacagacagccccctgactggaggaggagacctgaccaccctgagcaacatcgtgttcatgggcaccctggtgcagtatggccggggccagggcgtggtgattggaactggagagagcagccagtttggagaggtgttcaagatgatgcaggccgaggagacccccaagacccccctgcagaagtccatggaccggctgggcaagcagctgaccctcttctcctttggcatcatcggcctcatcatgctgattggctggagccagggcaagcagctgctgtccatgttcaccatcggcgtgtccctggccgtggccgccatccctgagggcctgcccatcgtggtgatggtgaccctggtgctgggcgtgctgaggatggccaagaagagggtgattgtgaagaagctgcccatcgtggagaccctgggctgctgcagcgtgctgtgcagcgacaagacaggcaccctgacagccaatgagatgacagtgacccagctggtgaccagtgatggcctgcgggcagaggtgtctggagtgggctatgatggccagggcaccgtgtgcctgctgcccagcaaggaggtgatcaaggagttcagcaatgtgtctgtgggcaagctggtggaggccggctgtgtggccaacaatgctgtgatcaggaagaatgctgtgatgggccagcccacagagggcgccctgatggccctggccatgaagatggacctgagtgacatcaagaacagctacatcaggaagaaggagatccccttcagcagcgagcagaagtggatggctgtgaagtgcagcctgaagacagaggaccaggaggacatctacttcatgaagggggccctggaggaggtgatccgctactgcaccatgtacaacaacggcggcatccccctgcccctgaccccccagcagaggagcttctgcctgcaggaggagaagaggatgggcagcctgggcctgcgggtgctggccctggccagcggccctgagctgggccgcctgaccttcctgggcctggtgggcatcatcgaccccccccgggtgggcgtgaaggaggccgtgcaggtgctgtctgagagcggcgtgtctgtgaagatgatcactggagatgccctggagacagccctggccatcggcagaaatattggcctgtgcaatggcaagctgcaggccatgtctggagaggaggtggacagcgtggagaagggggagctggccgacagagtgggcaaggtgtctgtgttcttccgcaccagccccaagcacaagctgaagatcatcaaggccctgcaggagagcggggccatcgtggccatgactggagatggagtgaatgatgctgtggccctgaagtctgctgacatcggcatcgccatgggccagacaggaacagatgtgtccaaggaggccgccaacatgatcctggtggatgatgacttcagcgccatcatgaatgctgtggaggagggcaagggcatcttctacaacatcaagaactttgtgcgcttccagctgagcaccagcatcagcgccctgagcctcatcaccctgagcaccgtcttcaacctgcccagccccctgaatgccatgcagatcctgtggatcaacatcatcatggatggccccccagcccagagcctgggcgtggagcctgtggacaaggatgccttccggcagcccccaagatctgtgcgggacaccatcctgagccgggccctgatcctgaagatcctgatgtctgctgccatcatcatcagcggcaccctcttcatcttctggaaggagatgccagaagatcgggccagcacccccaggaccaccaccatgaccttcacctgctttgtgttctttgacctcttcaatgccctgacctgccgcagccagaccaagctgatctttgagatcggcttcctgaggaaccacatgttcctgtacagcgtgctgggcagcatcctgggccagctggccgtcatctacatcccccccctgcagagggtcttccagacagagaacctgggcgccctggacctgctcttcctgaccggcctggccagctctgtgttcatcctgtctgagctgctgaagctgtgtgagaagtactgctgcagccccaagagggtgcagatgcacccagaagatgtgtag

SEQ ID NO: 144411 - DNA, 3090 bp, Artificial Sequence
  Description of Artificial Sequence: Synthetic coding sequence
atggaggccgcccacctgctgcctgctgctgatgtgctgcggcacttctctgtgacagctgagggcggcctgagccctgcccaggtgactggagcccgggagagatatggccccaatgagctgcccagcgaggagggcaagagcctgtgggagctggtgctggagcagtttgaggacctgctggtgcgcatcctgctgctggccgccctggtgtcctttgtgctggcctggtttgaggagggggaggagaccaccacagcctttgtggagcccctggtgatcatgctgatcctggtggccaatgccatcgtgggcgtgtggcaggagagaaatgctgagagcgccatcgaggccctgaaggagtatgagcctgagatgggcaaggtgatccgcagtgacagaaaaggagtgcagaggatccgggcccgggacatcgtgcctggggacatcgtggaggtggccgtgggggacaaggtgcctgctgacctgcggctcatcgagatcaagagcaccaccctgcgggtggaccagagcatcctgactggagagagcgtgtctgtgaccaagcacacagaggccatcccagaccccagggctgtgaaccaggacaagaagaacatgctgttcagcggcaccaacatcaccagcggcaaggctgtgggcgtggccgtggccaccggcctgcacacagagctgggcaagatccgcagccagatggctgctgtggagcctgagaggacccccctgcagaggaagctggatgaatttggccggcagctgagccacgccatcagcgtcatctgtgtggccgtgtgggtgatcaacatcggccactttgctgaccctgcccacggcggctcctggctgcggggagctgtgtactacttcaagattgctgtggccctggccgtggccgccatccctgagggcctgcctgctgtgatcaccacctgcctggccctgggcaccaggaggatggccaggaagaatgccatcgtgcgcagcctgcccagcgtggagaccctgggctgcaccagcgtcatctgcagcgacaagacaggcaccctgaccaccaaccagatgtctgtgtgcaggatgtttgtggtggccgaggctgatgctggcagctgcctgctgcacgagttcaccatcagcggcaccacctacaccccagagggggaggtgcggcagggcgaccagcctgtgcgctgtggccagtttgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagacctgcaggccctgagccgggtggagcgggccggggcctgcaacacagtcatcaagcagctgatgaggaaggagttcaccctggagttcagccgggacaggaagtccatgtctgtgtactgcacccccacccggccccaccccaccggccagggcagcaagatgtttgtgaagggggcccctgagagcgtcatcgagcgctgcagctctgtgcgggtgggcagcaggacagcccccctgacccccaccagccgggagcagatcctggccaagatccgggactggggcagcggcagtgacaccctgcgctgcctggccctggccaccagagatgccccacccaggaaggaggacatggagctggatgactgcagcaagtttgtgcagtatgaaacagacctgacctttgtgggctgtgtgggcatgctggacccccccaggcctgaggtggccgcctgcatcacccgctgctaccaggccggcatccgggtggtgatgatcactggagacaacaagggcacagctgtggccatctgccggcggctgggcatctttggagacacagaagatgtggccggcaaggcctacacaggccgggagtttgatgacctgagccctgagcagcagaggcaggcctgcaggacagcccgctgctttgcccgggtggagcccgcccacaagagcagaattgtggagaacctgcagagcttcaatgagatcacagccatgactggagatggagtgaatgatgccccagccctgaagaaggccgagatcggcatcgccatgggcagcggcacagctgtggccaagtctgctgctgagatggtgctgagtgatgacaactttgccagcatcgtggccgctgtggaggagggccgggccatctacagcaacatgaagcagttcatccgctacctgatcagcagcaatgtgggggaggtggtgtgcatcttcctgacagccatcctgggcctgcctgaggccctgatccctgtgcagctgctgtgggtgaacctggtgacagatggcctgcctgccacagccctgggcttcaaccccccagacctggacatcatggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcacgcctgcctgtacccaggcctgctgaggacagtgtcccaggcctggagccggcagcccctgaccacctcctggaccccagaccacacaggcctggccagcctgaagaagtag

SEQ ID NO: 144412 - DNA, 3132 bp, Artificial Sequence
  Description of Artificial Sequence: Synthetic coding sequence
atggaggccgcccacctgctgcctgctgctgatgtgctgcggcacttctctgtgacagctgagggcggcctgagccctgcccaggtgactggagcccgggagagatatggccccaatgagctgcccagcgaggagggcaagagcctgtgggagctggtgctggagcagtttgaggacctgctggtgcgcatcctgctgctggccgccctggtgtcctttgtgctggcctggtttgaggagggggaggagaccaccacagcctttgtggagcccctggtgatcatgctgatcctggtggccaatgccatcgtgggcgtgtggcaggagagaaatgctgagagcgccatcgaggccctgaaggagtatgagcctgagatgggcaaggtgatccgcagtgacagaaaaggagtgcagaggatccgggcccgggacatcgtgcctggggacatcgtggaggtggccgtgggggacaaggtgcctgctgacctgcggctcatcgagatcaagagcaccaccctgcgggtggaccagagcatcctgactggagagagcgtgtctgtgaccaagcacacagaggccatcccagaccccagggctgtgaaccaggacaagaagaacatgctgttcagcggcaccaacatcaccagcggcaaggctgtgggcgtggccgtggccaccggcctgcacacagagctgggcaagatccgcagccagatggctgctgtggagcctgagaggacccccctgcagaggaagctggatgaatttggccggcagctgagccacgccatcagcgtcatctgtgtggccgtgtgggtgatcaacatcggccactttgctgaccctgcccacggcggctcctggctgcggggagctgtgtactacttcaagattgctgtggccctggccgtggccgccatccctgagggcctgcctgctgtgatcaccacctgcctggccctgggcaccaggaggatggccaggaagaatgccatcgtgcgcagcctgcccagcgtggagaccctgggctgcaccagcgtcatctgcagcgacaagacaggcaccctgaccaccaaccagatgtctgtgtgcaggatgtttgtggtggccgaggctgatgctggcagctgcctgctgcacgagttcaccatcagcggcaccacctacaccccagagggggaggtgcggcagggcgaccagcctgtgcgctgtggccagtttgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagacctgcaggccctgagccgggtggagcgggccggggcctgcaacacagtcatcaagcagctgatgaggaaggagttcaccctggagttcagccgggacaggaagtccatgtctgtgtactgcacccccacccggccccaccccaccggccagggcagcaagatgtttgtgaagggggcccctgagagcgtcatcgagcgctgcagctctgtgcgggtgggcagcaggacagcccccctgacccccaccagccgggagcagatcctggccaagatccgggactggggcagcggcagtgacaccctgcgctgcctggccctggccaccagagatgccccacccaggaaggaggacatggagctggatgactgcagcaagtttgtgcagtatgaaacagacctgacctttgtgggctgtgtgggcatgctggacccccccaggcctgaggtggccgcctgcatcacccgctgctaccaggccggcatccgggtggtgatgatcactggagacaacaagggcacagctgtggccatctgccggcggctgggcatctttggagacacagaagatgtggccggcaaggcctacacaggccgggagtttgatgacctgagccctgagcagcagaggcaggcctgcaggacagcccgctgctttgcccgggtggagcccgcccacaagagcagaattgtggagaacctgcagagcttcaatgagatcacagccatgactggagatggagtgaatgatgccccagccctgaagaaggccgagatcggcatcgccatgggcagcggcacagctgtggccaagtctgctgctgagatggtgctgagtgatgacaactttgccagcatcgtggccgctgtggaggagggccgggccatctacagcaacatgaagcagttcatccgctacctgatcagcagcaatgtgggggaggtggtgtgcatcttcctgacagccatcctgggcctgcctgaggccctgatccctgtgcagctgctgtgggtgaacctggtgacagatggcctgcctgccacagccctgggcttcaaccccccagacctggacatcatggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcacgcctgcctgtacccaggcctgctgaggacagtgtcccaggcctggagccggcagcccctgaccacctcctggaccccagaccacactggaagaaatgaacctgaggtgtctgctggcaacagagtggagagccctgtgtgcaccagtgactag

SEQ ID NO: 144413 - DNA, 3159 bp, Artificial Sequence
  Description of Artificial Sequence: Synthetic coding sequence
atggaggccgcccacctgctgcctgctgctgatgtgctgcggcacttctctgtgacagctgagggcggcctgagccctgcccaggtgactggagcccgggagagatatggccccaatgagctgcccagcgaggagggcaagagcctgtgggagctggtgctggagcagtttgaggacctgctggtgcgcatcctgctgctggccgccctggtgtcctttgtgctggcctggtttgaggagggggaggagaccaccacagcctttgtggagcccctggtgatcatgctgatcctggtggccaatgccatcgtgggcgtgtggcaggagagaaatgctgagagcgccatcgaggccctgaaggagtatgagcctgagatgggcaaggtgatccgcagtgacagaaaaggagtgcagaggatccgggcccgggacatcgtgcctggggacatcgtggaggtggccgtgggggacaaggtgcctgctgacctgcggctcatcgagatcaagagcaccaccctgcgggtggaccagagcatcctgactggagagagcgtgtctgtgaccaagcacacagaggccatcccagaccccagggctgtgaaccaggacaagaagaacatgctgttcagcggcaccaacatcaccagcggcaaggctgtgggcgtggccgtggccaccggcctgcacacagagctgggcaagatccgcagccagatggctgctgtggagcctgagaggacccccctgcagaggaagctggatgaatttggccggcagctgagccacgccatcagcgtcatctgtgtggccgtgtgggtgatcaacatcggccactttgctgaccctgcccacggcggctcctggctgcggggagctgtgtactacttcaagattgctgtggccctggccgtggccgccatccctgagggcctgcctgctgtgatcaccacctgcctggccctgggcaccaggaggatggccaggaagaatgccatcgtgcgcagcctgcccagcgtggagaccctgggctgcaccagcgtcatctgcagcgacaagacaggcaccctgaccaccaaccagatgtctgtgtgcaggatgtttgtggtggccgaggctgatgctggcagctgcctgctgcacgagttcaccatcagcggcaccacctacaccccagagggggaggtgcggcagggcgaccagcctgtgcgctgtggccagtttgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagacctgcaggccctgagccgggtggagcgggccggggcctgcaacacagtcatcaagcagctgatgaggaaggagttcaccctggagttcagccgggacaggaagtccatgtctgtgtactgcacccccacccggccccaccccaccggccagggcagcaagatgtttgtgaagggggcccctgagagcgtcatcgagcgctgcagctctgtgcgggtgggcagcaggacagcccccctgacccccaccagccgggagcagatcctggccaagatccgggactggggcagcggcagtgacaccctgcgctgcctggccctggccaccagagatgccccacccaggaaggaggacatggagctggatgactgcagcaagtttgtgcagtatgaaacagacctgacctttgtgggctgtgtgggcatgctggacccccccaggcctgaggtggccgcctgcatcacccgctgctaccaggccggcatccgggtggtgatgatcactggagacaacaagggcacagctgtggccatctgccggcggctgggcatctttggagacacagaagatgtggccggcaaggcctacacaggccgggagtttgatgacctgagccctgagcagcagaggcaggcctgcaggacagcccgctgctttgcccgggtggagcccgcccacaagagcagaattgtggagaacctgcagagcttcaatgagatcacagccatgactggagatggagtgaatgatgccccagccctgaagaaggccgagatcggcatcgccatgggcagcggcacagctgtggccaagtctgctgctgagatggtgctgagtgatgacaactttgccagcatcgtggccgctgtggaggagggccgggccatctacagcaacatgaagcagttcatccgctacctgatcagcagcaatgtgggggaggtggtgtgcatcttcctgacagccatcctgggcctgcctgaggccctgatccctgtgcagctgctgtgggtgaacctggtgacagatggcctgcctgccacagccctgggcttcaaccccccagacctggacatcatggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcacgcctgcctgtacccaggcctgctgaggacagtgtcccaggcctggagccggcagcccctgaccacctcctggaccccagaccacacaggcctggccagcctgggccagggccacagcatcgtgtccctgtctgagctgctgcgggagggcggcagccgggaggagatgagccagaagtag

SEQ ID NO: 144414 - DNA, 3090 bp, Artificial Sequence; identical to SEQ ID NO: 144411
  Description of Artificial Sequence: Synthetic coding sequence

SEQ ID NO: 144415 - DNA, 651 bp, Artificial Sequence
  Description of Artificial Sequence: Synthetic coding sequence
atggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcacggccctggcacccagcaccggctggccgtgcgggccgcccagaggggcaggaagcagggcagaaatgaacctgaggtgtctgctggcaacagagtggagagccctggccctgggggctag

SEQ ID NO: 144416 - DNA, 3000 bp, Artificial Sequence
  Description of Artificial Sequence: Synthetic coding sequence
atggaggccgcccacctgctgcctgctgctgatgtgctgcggcacttctctgtgacagctgagggcggcctgagccctgcccaggtgactggagcccgggagagatatggccccaatgagctgcccagcgaggagggcaagagcctgtgggagctggtgctggagcagtttgaggacctgctggtgcgcatcctgctgctggccgccctggtgtcctttgtgctggcctggtttgaggagggggaggagaccaccacagcctttgtggagcccctggtgatcatgctgatcctggtggccaatgccatcgtgggcgtgtggcaggagagaaatgctgagagcgccatcgaggccctgaaggagtatgagcctgagatgggcaaggtgatccgcagtgacagaaaaggagtgcagaggatccgggcccgggacatcgtgcctggggacatcgtggaggtggccgtgggggacaaggtgcctgctgacctgcggctcatcgagatcaagagcaccaccctgcgggtggaccagagcatcctgactggagagagcgtgtctgtgaccaagcacacagaggccatcccagaccccagggctgtgaaccaggacaagaagaacatgctgttcagcggcaccaacatcaccagcggcaaggctgtgggcgtggccgtggccaccggcctgcacacagagctgggcaagatccgcagccagatggctgctgtggagcctgagaggacccccctgcagaggaagctggatgaatttggccggcagctgagccacgccatcagcgtcatctgtgtggccgtgtgggtgatcaacatcggccactttgctgaccctgcccacggcggctcctggctgcggggagctgtgtactacttcaagattgctgtggccctggccgtggccgccatccctgagggcctgcctgctgtgatcaccacctgcctggccctgggcaccaggaggatggccaggaagaatgccatcgtgcgcagcctgcccagcgtggagaccctgggctgcaccagcgtcatctgcagcgacaagacaggcaccctgaccaccaaccagatgtctgtgtgcaggatgtttgtggtggccgaggctgatgctggcagctgcctgctgcacgagttcaccatcagcggcaccacctacaccccagagggggaggtgcggcagggcgaccagcctgtgcgctgtggccagtttgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagacctgcaggccctgagccgggtggagcgggccggggcctgcaacacagtcatcaagcagctgatgaggaaggagttcaccctggagttcagccgggacaggaagtccatgtctgtgtactgcacccccacccggccccaccccaccggccagggcagcaagatgtttgtgaagggggcccctgagagcgtcatcgagcgctgcagctctgtgcgggtgggcagcaggacagcccccctgacccccaccagccgggagcagatcctggccaagatccgggactggggcagcggcagtgacaccctgcgctgcctggccctggccaccagagatgccccacccaggaaggaggacatggagctggatgactgcagcaagtttgtgcagtatgaaacagacctgacctttgtgggctgtgtgggcatgctggacccccccaggcctgaggtggccgcctgcatcacccgctgctaccaggccggcatccgggtggtgatgatcactggagacaacaagggcacagctgtggccatctgccggcggctgggcatctttggagacacagaagatgtggccggcaaggcctacacaggccgggagtttgatgacctgagccctgagcagcagaggcaggcctgcaggacagcccgctgctttgcccgggtggagcccgcccacaagagcagaattgtggagaacctgcagagcttcaatgagatcacagccatgactggagatggagtgaatgatgccccagccctgaagaaggccgagatcggcatcgccatgggcagcggcacagctgtggccaagtctgctgctgagatggtgctgagtgatgacaactttgccagcatcgtggccgctgtggaggagggccgggccatctacagcaacatgaagcagttcatccgctacctgatcagcagcaatgtgggggaggtggtgtgcatcttcctgacagccatcctgggcctgcctgaggccctgatccctgtgcagctgctgtgggtgaacctggtgacagatggcctgcctgccacagccctgggcttcaaccccccagacctggacatcatggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcatgaggagatgagccagaagtag

SEQ ID NO: 144417 - DNA, 2997 bp, Artificial Sequence
  Description of Artificial Sequence: Synthetic coding sequence
atggaggccgcccacctgctgcctgctgctgatgtgctgcggcacttctctgtgacagctgagggcggcctgagccctgcccaggtgactggagcccgggagagatatggccccaatgagctgcccagcgaggagggcaagagcctgtgggagctggtgctggagcagtttgaggacctgctggtgcgcatcctgctgctggccgccctggtgtcctttgtgctggcctggtttgaggagggggaggagaccaccacagcctttgtggagcccctggtgatcatgctgatcctggtggccaatgccatcgtgggcgtgtggcaggagagaaatgctgagagcgccatcgaggccctgaaggagtatgagcctgagatgggcaaggtgatccgcagtgacagaaaaggagtgcagaggatccgggcccgggacatcgtgcctggggacatcgtggaggtggccgtgggggacaaggtgcctgctgacctgcggctcatcgagatcaagagcaccaccctgcgggtggaccagagcatcctgactggagagagcgtgtctgtgaccaagcacacagaggccatcccagaccccagggctgtgaaccaggacaagaagaacatgctgttcagcggcaccaacatcaccagcggcaaggctgtgggcgtggccgtggccaccggcctgcacacagagctgggcaagatccgcagccagatggctgctgtggagcctgagaggacccccctgcagaggaagctggatgaatttggccggcagctgagccacgccatcagcgtcatctgtgtggccgtgtgggtgatcaacatcggccactttgctgaccctgcccacggcggctcctggctgcggggagctgtgtactacttcaagattgctgtggccctggccgtggccgccatccctgagggcctgcctgctgtgatcaccacctgcctggccctgggcaccaggaggatggccaggaagaatgccatcgtgcgcagcctgcccagcgtggagaccctgggctgcaccagcgtcatctgcagcgacaagacaggcaccctgaccaccaaccagatgtctgtgtgcaggatgtttgtggtggccgaggctgatgctggcagctgcctgctgcacgagttcaccatcagcggcaccacctacaccccagagggggaggtgcggcagggcgaccagcctgtgcgctgtggccagtttgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagacctgcaggccctgagccgggtggagcgggccggggcctgcaacacagtcatcaagcagctgatgaggaaggagttcaccctggagttcagccgggacaggaagtccatgtctgtgtactgcacccccacccggccccaccccaccggccagggcagcaagatgtttgtgaagggggcccctgagagcgtcatcgagcgctgcagctctgtgcgggtgggcagcaggacagcccccctgacccccaccagccgggagcagatcctggccaagatccgggactggggcagcggcagtgacaccctgcgctgcctggccctggccaccagagatgccccacccaggaaggaggacatggagctggatgactgcagcaagtttgtgcagtatgaaacagacctgacctttgtgggctgtgtgggcatgctggacccccccaggcctgaggtggccgcctgcatcacccgctgctaccaggccggcatccgggtggtgatgatcactggagacaacaagggcacagctgtggccatctgccggcggctgggcatctttggagacacagaagatgtggccggcaaggcctacacaggccgggagtttgatgacctgagccctgagcagcagaggcaggcctgcaggacagcccgctgctttgcccgggtggagcccgcccacaagagcagaattgtggagaacctgcagagcttcaatgagatcacagccatgactggagatggagtgaatgatgccccagccctgaagaaggccgagatcggcatcgccatgggcagcggcacagctgtggccaagtctgctgctgagatggtgctgagtgatgacaactttgccagcatcgtggccgctgtggaggagggccgggccatctacagcaacatgaagcagttcatccgctacctgatcagcagcaatgtgggggaggtggtgtgcatcttcctgacagccatcctgggcctgcctgaggccctgatccctgtgcagctgctgtgggtgaacctggtgacagatggcctgcctgccacagccctgggcttcaaccccccagacctggacatcatggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcacggccacacccagagctag

SEQ ID NO: 144418 - DNA, 2997 bp, Artificial Sequence
  Description of Artificial Sequence: Synthetic coding sequence
atggaggccgcccacctgctgcctgctgctgatgtgctgcggcacttctctgtgacagctgagggcggcctgagccctgcccaggtgactggagcccgggagagatatggccccaatgagctgcccagcgaggagggcaagagcctgtgggagctggtgctggagcagtttgaggacctgctggtgcgcatcctgctgctggccgccctggtgtcctttgtgctggcctggtttgaggagggggaggagaccaccacagcctttgtggagcccctggtgatcatgctgatcctggtggccaatgccatcgtgggcgtgtggcaggagagaaatgctgagagcgccatcgaggccctgaaggagtatgagcctgagatgggcaaggtgatccgcagtgacagaaaaggagtgcagaggatccgggcccgggacatcgtgcctggggacatcgtggaggtggccgtgggggacaaggtgcctgctgacctgcggctcatcgagatcaagagcaccaccctgcgggtggaccagagcatcctgactggagagagcgtgtctgtgaccaagcacacagaggccatcccagaccccagggctgtgaaccaggacaagaagaacatgctgttcagcggcaccaacatcaccagcggcaaggctgtgggcgtggccgtggccaccggcctgcacacagagctgggcaagatccgcagccagatggctgctgtggagcctgagaggacccccctgcagaggaagctggatgaatttggccggcagctgagccacgccatcagcgtcatctgtgtggccgtgtgggtgatcaacatcggccactttgctgaccctgcccacggcggctcctggctgcggggagctgtgtactacttcaagattgctgtggccctggccgtggccgccatccctgagggcctgcctgctgtgatcaccacctgcctggccctgggcaccaggaggatggccaggaagaatgccatcgtgcgcagcctgcccagcgtggagaccctgggctgcaccagcgtcatctgcagcgacaagacaggcaccctgaccaccaaccagatgtctgtgtgcaggatgtttgtggtggccgaggctgatgctggcagctgcctgctgcacgagttcaccatcagcggcaccacctacaccccagagggggaggtgcggcagggcgaccagcctgtgcgctgtggccagtttgatggcctggtggagctggccaccatctgtgccctgtgcaatgattctgccctggactacaatgaggccaagggcgtgtatgagaaggtgggggaggccacagaaacagccctgacctgcctggtggagaagatgaatgtgtttgacacagacctgcaggccctgagccgggtggagcgggccggggcctgcaacacagtcatcaagcagctgatgaggaaggagttcaccctggagttcagccgggacaggaagtccatgtctgtgtactgcacccccacccggccccaccccaccggccagggcagcaagatgtttgtgaagggggcccctgagagcgtcatcgagcgctgcagctctgtgcgggtgggcagcaggacagcccccctgacccccaccagccgggagcagatcctggccaagatccgggactggggcagcggcagtgacaccctgcgctgcctggccctggccaccagagatgccccacccaggaaggaggacatggagctggatgactgcagcaagtttgtgcagtatgaaacagacctgacctttgtgggctgtgtgggcatgctggacccccccaggcctgaggtggccgcctgcatcacccgctgctaccaggccggcatccgggtggtgatgatcactggagacaacaagggcacagctgtggccatctgccggcggctgggcatctttggagacacagaagatgtggccggcaaggcctacacaggccgggagtttgatgacctgagccctgagcagcagaggcaggcctgcaggacagcccgctgctttgcccgggtggagcccgcccacaagagcagaattgtggagaacctgcagagcttcaatgagatcacagccatgactggagatggagtgaatgatgccccagccctgaagaaggccgagatcggcatcgccatgggcagcggcacagctgtggccaagtctgctgctgagatggtgctgagtgatgacaactttgccagcatcgtggccgctgtggaggagggccgggccatctacagcaacatgaagcagttcatccgctacctgatcagcagcaatgtgggggaggtggtgtgcatcttcctgacagccatcctgggcctgcctgaggccctgatccctgtgcagctgctgtgggtgaacctggtgacagatggcctgcctgccacagccctgggcttcaaccccccagacctggacatcatggagaagctgcccaggagcccccgggaggccctgatcagcggctggctgttcttccgctacctggccatcggcgtgtatgtgggcctggccaccgtggccgccgccacctggtggtttgtgtatgatgctgagggcccccacatcaacttctaccagctgaggaacttcctgaagtgcagcgaggacaaccccctgtttgctggcatcgactgtgaggtgtttgagagccgcttccccaccaccatggccctgtctgtgctggtgaccatcgagatgtgcaatgccctgaacagcgtgtctgagaaccagagcctgctgaggatgccaccctggatgaacccctggctgctggtggccgtggccatgtccatggccctgcacttcctgatcctgctggtgccccccctgcccctcatcttccaggtgacccccctgagcggccggcagtgggtggtggtgctgcagatcagcctgcccgtcatcctgctggatgaggccctgaagtacctgagcaggaaccacatgcatgagatgagccagaagtag

SEQ ID NO: 144419 - DNA, 1386 bp, Artificial Sequence
  Description of Artificial Sequence: Synthetic coding sequence
atgacagtgcccaaggagatgcctgagaagtgggcccgggcccaggcccctccttcctggagcaggaagaagcccagctggggcacagaggaggagcggcgggcccgggccaatgaccgggagtacaatgagaagttccagtatgccagcaactgcatcaagaccagcaagtacaacatcctgaccttcctgcctgtgaacctgtttgagcagttccaggaggtggccaacacctacttcctgttcctgctgatcctgcagctgatcccccagatcagcagcctgtcctggttcaccaccatcgtgcccctggtgctggtgctgaccatcacagctgtgaaggatgccacagatgactacttccgccacaagagtgacaaccaggtgaacaaccggcagagccaggtgctgatcaatggcatcctgcagcaggagcagtggatgaatgtgtgtgtgggggacatcatcaagctggagaacaaccagtttgtggccgctgacctgctgctgctgagcagcagcgagccccacggcctgtgctacatcgagacagctgagctggatggagagaccaacatgaaggtgcggcaggccatccctgtgaccagcgagctgggggacatcagcaagctggccaagtttgatggagaggtgatctgtgagccccccaacaacaagctggacaagttcagcggcaccctgtactggaaggagaacaagttccccctgagcaaccagaacatgctgctgcggggctgtgtgctgaggaacacagagtggtgcttcggcctggtgatctttgctggccctgacaccaagctgatgcagaacagcggccgcaccaagttcaagaggaccagcattgaccggctgatgaacaccctggtgctgtggatcttcggcttcctggtgtgcatgggcgtcatcctggccatcggaaatgccatctgggagcacgaggtgggcatgaggttccaggtgtacctgccctgggatgaggccgtggacagcgccttcttcagcggcttcctgtccttctggagctacatcatcatcctgaacacagtggtgcccatcagcctgtatgtgtctgtggaggtgatccggctgggccacagctacttcatcaactgggacaagaagatgttctgcatgaagaagaggaccccagctgaggcccggaccaccaccctgaatgaggagctgggccaggtggagtacatcttcagtgacaagacaggcaccctgacccagaacatcatggtgttcaacaagtgcagcatcaatggccacagctatgtgggcagcgagggccccaggaggaagggccccagctggccaggcaccgtggcccacgcctacagccacagcaccctgggcggctag

SEQ ID NO: 144420 - DNA, 1164 bp, Artificial Sequence
  Description of Artificial Sequence: Synthetic coding sequence
atggctgtgtgtgccaagaagaggcctcctgaggaggagcggcgggcccgggccaatgaccgggagtacaatgagaagttccagtatgccagcaactgcatcaagaccagcaagtacaacatcctgaccttcctgcctgtgaacctgtttgagcagttccaggaggtggccaacacctacttcctgttcctgctgatcctgcagctgatcccccagatcagcagcctgtcctggttcaccaccatcgtgcccctggtgctggtgctgaccatcacagctgtgaaggatgccacagatgactacttccgccacaagagtgacaaccaggtgaacaaccggcagagccaggtgctgatcaatggcatcctgcagcaggagcagtggatgaatgtgtgtgtgggggacatcatcaagctggagaacaaccagtttgtggccgctgacctgctgctgctgagcagcagcgagccccacggcctgtgctacattgaaacagctgagctggatggagagaccaacatgaaggtgcggcaggccatccctgtgaccagcgagctgggggacatcagcaagctggccaagtttgatggagaggtgatctgtgagccccccaacaacaagctggacaagttcagcggcaccctgtactggaaggagaacaagttccccctgagcaaccagaacatgctgctgcggggctgtgtgctgaggaacacagagtggtgcttcggcctggtgatctttgctggccctgacaccaagctgatgcagaacagcggccgcaccaagttcaagaggaccagcattgaccggctgatgaacaccctggtgctgtggatcttcggcttcctggtgtgcatgggcgtcatcctggccatcggaaatgccatctgggagcacgaggtgggcatgaggttccaggtgtacctgccctgggatgaagctgtggacagcgccttcttcagcggcttcctgtccttctggagctacatcatcatcctgaacacagtggtgcccatcagcctgtatgtgcgctacgtgcccagcctgacctggggcctgagccgggagagcggcggccccatcgagctgttcttctccatgaagatgaagagcctgcggagcaatgagaagagcagcagcagctgcaccgtgaacatctag

SEQ ID NO: 144421 - DNA, 3672 bp, Artificial Sequence
  Description of Artificial Sequence: Synthetic coding sequence
atggacaccctgcgggctgtgcccctcttcagcatcagcggcctcttctccttcccctacagagtgagccacggcattgctggcatcctgctgggggagatggctgtgtgtgccaagaagaggcctcctgaggaggagcggcgggcccgggccaatgaccgggagtacaatgagaagttccagtatgccagcaactgcatcaagaccagcaagtacaacatcctgaccttcctgcctgtgaacctgtttgagcagttccaggaggtggccaacacctacttcctgttcctgctgatcctgcagctgatcccccagatcagcagcctgtcctggttcaccaccatcgtgcccctggtgctggtgctgaccatcacagctgtgaaggatgccacagatgactacttccgccacaagagtgacaaccaggtgaacaaccggcagagccaggtgctgatcaatggcatcctgcagcaggagcagtggatgaatgtgtgtgtgggggacatcatcaagctggagaacaaccagtttgtggccgctgacctgctgctgctgagcagcagcgagccccacggcctgtgctacatcgagacagctgagctggatggagagaccaacatgaaggtgcggcaggccatccctgtgaccagcgagctgggggacatcagcaagctggccaagtttgatggagaggtgatctgtgagccccccaacaacaagctggacaagttcagcggcaccctgtactggaaggagaacaagttccccctgagcaaccagaacatgctgctgcggggctgtgtgctgaggaacacagagtggtgcttcggcctggtgatctttgctggccctgacaccaagctgatgcagaacagcggccgcaccaagttcaagaggaccagcattgaccggctgatgaacaccctggtgctgtggatcttcggcttcctggtgtgcatgggcgtcatcctggccatcggaaatgccatctgggagcacgaggtgggcatgaggttccaggtgtacctgccctgggatgaggccgtggacagcgccttcttcagcggcttcctgtccttctggagctacatcatcatcctgaacacagtggtgcccatcagcctgtatgtgtctgtggaggtgatccggctgggccacagctacttcatcaactgggacaagaagatgttctgcatgaagaagaggaccccagctgaggcccggaccaccaccctgaatgaggagctgggccaggtggagtacatcttcagtgacaagacaggcaccctgacccagaacatcatggtgttcaacaagtgcagcatcaatggccacagctatggagatgtgtttgatgtgctgggccacaaggccgagctgggggagaggcctgagcctgtggacttctccttcaaccccctggccgacaagaagttcctgttctgggaccccagcctgctggaggccgtgaagatcggggacccccacacccatgagttcttccggctgctgagcctgtgccacacagtgatgtctgaggagaagaatgaaggagagctgtactacaaggcccagagcccagatgagggcgccctggtgacagctgccaggaactttggatttgtgttccgcagcaggacccccaagaccatcaccgtgcatgagatgggcacagccatcacctaccagctgctggccatcctggacttcaacaacatcaggaagaggatgtctgtcatcgtgaggaaccctgagggcaagatccggctgtactgcaagggagctgacaccatcctgctggaccggctgcaccacagcacccaggagctgctgaacaccaccatggaccacctgaatgaatatgctggggagggcctgcggaccctggtgctggcctacaaggacctggatgaggagtactatgaggagtgggccgagcggcggctgcaggccagcctggcccaggacagcagagaagatcggctggccagcatctatgaggaggtggagaacaacatgatgctgctgggcgccacagccatcgaggacaagctgcagcagggcgtgcctgagaccatcgccctgctgaccctggccaacatcaagatctgggtgctgactggagacaagcaggagacagctgtgaacatcggctacagctgcaagatgctgacagatgacatgacagaggtgttcatcgtgacaggccacacagtgctggaggtgcgggaggagctgaggaaggcccgggagaagatgatggacagcagccgctctgtgggcaatggcttcacctaccaggacaagctgagcagcagcaagctgacctctgtgctggaggccgtggccggggagtatgccctggtgatcaatggccacagcctggcccacgccctggaggccgacatggagctggagttcctggagacagcctgtgcctgcaaggccgtcatctgctgccgggtgacccccctgcagaaggcccaggtggtggagctggtgaagaagtacaagaaggctgtgaccctggccatcggagatggagccaatgatgtgtccatgatcaagacagcccacatcggcgtgggcatcagcggccaggagggcatccaggccgtgctggccagtgactacagcttcagccagttcaagttcctgcagaggctgctgctggtgcacggccgctggagctacctgaggatgtgcaagttcctgtgctacttcttctacaagaactttgccttcaccatggtgcacttctggtttggcttcttctgtggcttcagcgcccagacagtgtatgaccagtacttcatcaccctgtacaacatcgtgtacaccagcctgcctgtgctggccatgggcgtgtttgaccaggatgtgcctgagcagaggtccatggagtaccccaagctgtatgagcccggccagctgaacctgctcttcaacaagcgggagttcttcatctgcatcgcccagggcatctacacctctgtgctgatgttcttcatcccctacggcgtgtttgctgatgccaccagagatgatggcacccagctggccgactaccagagctttgctgtgacagtggccaccagcctggtgattgtggtgtctgtgcagatcggcctggacaccggctactggacagccatcaaccacttcttcatctggggcagcctggccgtgtactttgccatcctgtttgccatgcacagcaatggcctgtttgacatgttccccaaccagttccgctttgtgggcaatgcccagaacaccctggcccagcccaccgtgtggctgaccatcgtgctgaccaccgtggtgtgcatcatgcctgtggtggccttccgcttcctgcggctgaacctgaagccagacctgagtgacacagtgcgctacacccagctggtgaggaagaagcagaaggcccagcaccgctgcatgagaagagtgggccgcacaggcagccgccgcagcggctacgccttcagccaccaggagggctttggagagctgatcatgtctgggaagaacatgaggctgagcagcctggccctgagcagcttcaccaccaggagcagcagctcctggattgagagcctgcggaggaagaagagtgacagcgccagcagccccagcggcggcgctgacaagcccctgaagggctag

SEQ ID NO: 144422 - DNA, 3444 bp, Artificial Sequence
  Description of Artificial Sequence: Synthetic coding sequence
atggctgaccagatccccctgtaccctgtgcgctctgctgctgctgctgctgccaacaggaagagagctgcctactacagcgctgctggccccaggcctggagctgacagacacagccgctaccagctggaggatgaaagtgcccacctggatgagatgcccctgatgatgtctgaggagggctttgaaaatgaggagagtgactaccacaccctgccccgggcccgcatcatgcagaggaagaggggcctggagtggtttgtgtgtgatggctggaagttcctgtgcaccagctgctgcggctggctgatcaacatctgcaggaggaagaaggagctgaaggccaggacagtgtggctgggctgcccagagaagtgtgaggagaagcaccccaggaacagcatcaagaaccagaagtacaacgtgttcaccttcatccctggggtgctgtatgagcagttcaagttcttcctgaacctgtacttcctggtgatcagctgcagccagtttgtgcctgccctgaagattggctacctgtacacctactgggcccccctgggctttgtgctggccgtgaccatgacccgggaggccattgatgagttccgccgcttccagagggacaaggaggtgaacagccagctgtacagcaagctgactgtgcggggcaaggtgcaggtgaagagcagtgacatccaggtgggggacctgatcatcgtggagaagaaccagaggatccccagcgacatggtgttcctgcggaccagcgagaaggccggcagctgcttcatcagaacagaccagctggatggagaaacagactggaagctgaaggtggccgtgtcctgcacccagcagctgcctgccctgggggacctcttcagcatcagcgcctacgtgtatgcccagaagccccagatggacatccacagctttgagggcaccttcaccagagaagattctgacccccccatccacgagagcctgagcattgagaacaccctgtgggccagcaccatcgtggccagcggcaccgtgattggagtggtgatctacacaggcaaggagaccaggtctgtgatgaacaccagcaaccccaagaacaaggtgggcctgctggacctggagctgaaccggctgaccaaggccctcttcctggccctggtggccctgagcatcgtgatggtgaccctgcagggctttgtgggcccctggtacagaaacctcttccgcttcctgctgctcttctcctacatcatccccatcagcctgcgggtgaacctggacatgggcaaggctgtgtatggctggatgatgatgaaggatgagaacatccctggcaccgtggtgaggaccagcaccatccctgaggagctgggccgcctggtgtacctgctgacagacaagacaggcaccctgacccagaatgagatgatcttcaagaggctgcacctgggcaccgtgtcctatggagctgacaccatggatgagatccagagccacgtgcgggacagctacagccagatgcagagccaggccggcggcaacaacacaggcagcacccccctgaggaaggcccagagcagcgcccccaaggtgaggaagtctgtgagcagccgcatccacgaggccgtgaaggccatcgtgctgtgccacaacgtgacccctgtgtatgagagccgggccggcgtgacagaggagacagaatttgctgaggccgaccaggacttcagtgatgagaacagaacctaccaggccagcagcccagatgaggtggccctggtgcagtggacagagagcgtgggcctgaccctggtgtcccgggacctgacctccatgcagctgaagaccccatctggccaggtgctgtccttctgcatcctgcagctgttccccttcaccagcgagagcaagaggatgggcgtgattgtgagagatgagagcacagctgagatcaccttctacatgaagggagcagatgtggccatgagccccatcgtgcagtacaatgactggctggaggaggagtgtggcaacatggcccgggagggcctgcggaccctggtggtggccaagaaggccctgacagaggagcagtaccaggactttgagagccgctacacccaggccaagctgtccatgcatgacaggagcctgaaggtggccgctgtggtggagagcctggagcgggagatggagctgctgtgcctgactggagtggaggaccagctgcaggctgatgtgcggcccaccctggagatgctgagaaatgccggcatcaagatctggatgctgaccggggacaagctggagacagccacctgcatcgccaagagcagccacctggtgtccaggacccaggacatccacatcttccggcaggtgaccagcagaggagaggcccacctggagctgaatgccttccggaggaagcatgactgtgccctggtgatcagcggggacagcctggaggtgtgcctgaagtactatgagcacgagtttgtggagctggcctgccagtgcccagctgtggtgtgctgccgctgcagccccacccagaaggccagaattgtgaccctgctgcagcagcacactggaagaaggacctgtgccatcggagatggcggcaatgatgtgtccatgatccaggccgctgactgtggcattggaattgagggcaaggagggcaagcaggccagcctggccgctgacttcagcatcacccagttccgccacatcggccgcctgctgatggtgcacggcaggaacagctacaagaggtctgctgccctgggccagtttgtgatgcaccggggcctcatcatcagcaccatgcaggccgtgttcagctctgtgttctactttgcctctgtgcccctgtaccagggcttcctgatggtgggctacgccaccatctacaccatgtttcctgtgttcagcctggtgctggaccaggatgtgaagccagagatggccatgctgtacccagagctgtacaaggacctgaccaagggccgcagcctgtccttcaagaccttcctgatctgggtgctgatcagcatctaccagggcggcatcctgatgtatggagccctggtgctgtttgaaagtgaatttgtgcacgtggtggccatctccttcaccgccctgatcctgacagagctgctgatggtggccctgactgtgaggacctggcactggctgatggtggtggccgagttcctgagcctgggctgctacgtgagcagcctggccttcctgaatgagtactttggaattggccgggtgtcctttggagccttcctggatgtggccttcatcaccaccgtgaccttcctgtggaaggtgtctgccatcaccgtggtgtcctgcctgcccctgtatgtgctgaagtacctgcggaggaagctgagccccccatcctactgcaagctggccagctag

SEQ ID NO: 144423 - DNA, 408 bp, Artificial Sequence
  Description of Artificial Sequence: Synthetic coding sequence
atgcaggccgtgttcagctctgtgttctactttgcctctgtgcccctgtaccagggcttcctgatggtgggctacgccaccatctacaccatgtttcctgtgttcagcctggtgctggaccaggatgtgaagccagagatggccatgctgtacccagagctgtacaaggacctgaccaagagccagcaggacggccgcagcaacagacggcagcacgagcggctgaccagcggcaccagcggccacgtgtgggaccccggcagcttcttccgcatccgggtgtctggaaaaggagccagaaatgctgggaagatcctggtgctgcagaacctgccccacctgggcttcaacaagtacctgccccggcggcacccccacgtgtggggccctggggccctgcgggtgtag

SEQ ID NO: 144424 - DNA, 3411 bp, Artificial Sequence
  Description of Artificial Sequence: Synthetic coding sequence
atggctgaccagatccccctgtaccctgtgcgctctgctgctgctgctgctgccaacaggaagagagctgcctactacagcgctgctggccccaggcctggagctgacagacacagccgctaccagctggaggatgaaagtgcccacctggatgagatgcccctgatgatgtctgaggagggctttgaaaatgaggagagtgactaccacaccctgccccgggcccgcatcatgcagaggaagaggggcctggagtggtttgtgtgtgatggctggaagttcctgtgcaccagctgctgcggctggctgatcaacatctgcaggaggaagaaggagctgaaggccaggacagtgtggctgggctgcccagagaagtgtgaggagaagcaccccaggaacagcatcaagaaccagaagtacaacgtgttcaccttcatccctggggtgctgtatgagcagttcaagttcttcctgaacctgtacttcctggtgatcagctgcagccagtttgtgcctgccctgaagattggctacctgtacacctactgggcccccctgggctttgtgctggccgtgaccatgacccgggaggccattgatgagttccgccgcttccagagggacaaggaggtgaacagccagctgtacagcaagctgactgtgcggggcaaggtgcaggtgaagagcagtgacatccaggtgggggacctgatcatcgtggagaagaaccagaggatccccagcgacatggtgttcctgcggaccagcgagaaggccggcagctgcttcatcagaacagaccagctggatggagaaacagactggaagctgaaggtggccgtgtcctgcacccagcagctgcctgccctgggggacctcttcagcatcagcgcctacgtgtatgcccagaagccccagatggacatccacagctttgagggcaccttcaccagagaagattctgacccccccatccacgagagcctgagcattgagaacaccctgtgggccagcaccatcgtggccagcggcaccgtgattggagtggtgatctacacaggcaaggagaccaggtctgtgatgaacaccagcaaccccaagaacaaggtgggcctgctggacctggagctgaaccggctgaccaaggccctcttcctggccctggtggccctgagcatcgtgatggtgaccctgcagggctttgtgggcccctggtacagaaacctcttccgcttcctgctgctcttctcctacatcatccccatcagcctgcgggtgaacctggacatgggcaaggctgtgtatggctggatgatgatgaaggatgagaacatccctggcaccgtggtgaggaccagcaccatccctgaggagctgggccgcctggtgtacctgctgacagacaagacaggcaccctgacccagaatgagatgatcttcaagaggctgcacctgggcaccgtgtcctatggagctgacaccatggatgagatccagagccacgtgcgggacagctacagccagatgcagagccaggccggcggcaacaacacaggcagcacccccctgaggaaggcccagagcagcgcccccaaggtgaggaagtctgtgagcagccgcatccacgaggccgtgaaggccatcgtgctgtgccacaacgtgacccctgtgtatgagagccgggccggcgtgacagaggagacagaatttgctgaggccgaccaggacttcagtgatgagaacagaacctaccaggccagcagcccagatgaggtggccctggtgcagtggacagagagcgtgggcctgaccctggtgtcccgggacctgacctccatgcagctgaagaccccatctggccaggtgctgtccttctgcatcctgcagctgttccccttcaccagcgagagcaagaggatgggcgtgattgtgagagatgagagcacagctgagatcaccttctacatgaagggagcagatgtggccatgagccccatcgtgcagtacaatgactggctggaggaggagtgtggcaacatggcccgggagggcctgcggaccctggtggtggccaagaaggccctgacagaggagcagtaccaggactttgagagccgctacacccaggccaagctgtccatgcatgacaggagcctgaaggtggccgctgtggtggagagcctggagcgggagatggagctgctgtgcctgactggagtggaggaccagctgcaggctgatgtgcggcccaccctggagatgctgagaaatgccggcatcaagatctggatgctgaccggggacaagctggagacagccacctgcatcgccaagagcagccacctggtgtccaggacccaggacatccacatcttccggcaggtgaccagcagaggagaggcccacctggagctgaatgccttccggaggaagcatgactgtgccctggtgatcagcggggacagcctggaggtgtgcctgaagtactatgagcacgagtttgtggagctggcctgccagtgcccagctgtggtgtgctgccgctgcagccccacccagaaggccagaattgtgaccctgctgcagcagcacactggaagaaggacctgtgccatcggagatggcggcaatgatgtgtccatgatccaggccgctgactgtggcattggaattgagggcaaggagggcaagcaggccagcctggccgctgacttcagcatcacccagttccgccacatcggccgcctgctgatggtgcacggcaggaacagctacaagaggtctgctgccctgggccagtttgtgatgcaccggggcctcatcatcagcaccatgcaggccgtgttcagctctgtgttctactttgcctctgtgcccctgtaccagggcttcctgatggtgggctacgccaccatctacaccatgtttcctgtgttcagcctggtgctggaccaggatgtgaagccagagatggccatgctgtacccagagctgtacaaggacctgaccaagggccgcagcctgtccttcaagaccttcctgatctgggtgctgatcagcatctaccagggcggcatcctgatgtatggagccctggtgctgtttgaaagtgaatttgtgcacgtggtggccatctccttcaccgccctgatcctgacagagctgctgatggtggccctgactgtgaggacctggcactggctgatggtggtggccgagttcctgagcctgggctgctacgtgagcagcctggccttcctgaatgagtactttgatgtggccttcatcaccaccgtgaccttcctgtggaaggtgtctgccatcaccgtggtgtcctgcctgcccctgtatgtgctgaagtacctgcggaggaagctgagcccccccagctactgcaagctggccagctag

SEQ ID NO: 144425 - DNA, 411 bp, Artificial Sequence
  Description of Artificial Sequence: Synthetic coding sequence
atgcccctgatgatgtctgaggagggctttgaaaatgaggagagtgactaccacaccctgccccgggcccgcatcatgcagaggaagaggggcctggagtggtttgtgtgtgatggctggaagttcctgtgcaccagctgctgcggctggctgatcaacatctgcaggaggaagaaggagctgaaggccaggacagtgtggctgggctgcccagagaagtgtgaggagaagcaccccaggaacagcatcaagaaccagaagtacaacgtgttcaccttcatccctggggtgctgtatgagcagttcaagttcttcctgaacctgtacttcctggtgatcagctgcagccagtttgtgcctgccctgaagattggctacctgtacacctactgggcccccctgatgacctag

SEQ ID NO: 144426 - DNA, 609 bp, Artificial Sequence
  Description of Artificial Sequence: Synthetic coding sequence
atgcagaggaagaggggcctggagtggtttgtgtgtgatggctggaagttcctgtgcaccagctgctgcggctggctgatcaacatctgcaggaggaagaaggagctgaaggccaggacagtgtggctgggctgcccagagaagtgtgaggagaagcaccccagaaattccatcaagaaccagaagtacaacgtgttcaccttcatccctggggtgctgtatgagcagttcaagttcttcctgaacctgtacttcctggtgatcagctgcagccagtttgtgcctgccctgaagattggctacctgtacacctactgggcccccctgggctttgtgctggccgtgaccatgacccgggaggccattgatgagttccgccgcttccagagggacaaggaggtgaacagccagctgtacagcaagctgactgtgcggggcaaggtgcaggtgaagagcagtgacatccaggtgggggacctgatcatcgtggagaagaaccagaggatccccagcgacatggtgttcctgcggaccagcgagaaggctgtgagcaacaacctggactactgcagccacctggtgctcttcatcttctgcttcctgaactag

SEQ ID NO: 144427 - DNA, 1374 bp, Artificial Sequence
  Description of Artificial Sequence: Synthetic coding sequence
atggcccgggagggcctgcggaccctggtggtggccaagaaggccctgacagaggagcagtaccaggactttgagagccgctacacccaggccaagctgtccatgcatgacaggagcctgaaggtggccgctgtggtggagagcctggagcgggagatggagctgctgtgcctgactggagtggaggaccagctgcaggctgatgtgcggcccaccctggagatgctgagaaatgccggcatcaagatctggatgctgactggagacaagctggagacagccacctgcatcgccaagagcagccacctggtgtccaggacccaggacatccacatcttccggcaggtgaccagcagaggagaggcccacctggagctgaatgccttccggaggaagcatgactgtgccctggtgatcagcggggacagcctggaggtgtgcctgaagtactatgaacatgaatttgtggagctggcctgccagtgcccagctgtggtgtgctgccgctgcagccccacccagaaggcccgcatcgtgaccctgctgcagcagcacacaggccgccgcacctgtgccatcggagatggcggcaatgatgtgtccatgatccaggccgctgactgtggcatcggcatcgagggcaaggagggcaagcaggccagcctggccgctgacttcagcatcacccagttccgccacatcggccgcctgctgatggtgcatggaagaaattcctacaagaggtctgctgccctgggccagtttgtgatgcaccggggcctcatcatcagcaccatgcaggccgtgttcagcagcgtcttctactttgcctctgtgcccctgtaccagggcttcctgatggtgggctacgccaccatctacaccatgtttcctgtgttcagcctggtgctggaccaggatgtgaagccagagatggccatgctgtacccagagctgtacaaggacctgaccaagggccgcagcctgtccttcaagaccttcctgatctgggtgctgatcagcatctaccagggcggcatcctgatgtacggggccctggtgctgtttgagagcgagtttgtgcacgtggtggccatctccttcaccgccctgatcctgacagagctgctgatggtggccctgactgtgaggacctggcactggctgatggtggtggccgagttcctgagcctgggctgctacgtgagcagcctggccttcctgaatgagtactttgatgtggccttcatcaccaccgtgaccttcctgtggaaggtgtctgccatcaccgtggtgtcctgcctgcccctgtatgtgctgaagtacctgcggaggaagctgagccccccatcctactgcaagctggccagctag

SEQ ID NO: 144428 - DNA, 4500 bp, Artificial Sequence
  Description of Artificial Sequence: Synthetic coding sequence
atggagcgggagcccgccggcacagaggagcccggccccccaggaagaagaagaagaagagagggccgcaccaggacagtgcgcagcaacctgctgcccccacctggagctgaggaccctgctgctggggccgccaagggggagaggagaagaagaagaggctgtgcccagcacctggccgacaaccggctgaagaccaccaagtacaccctgctgtccttcctgcccaagaacctgtttgagcagttccacaggcctgccaacgtgtactttgtgttcatcgccctgctgaactttgtgcctgctgtgaatgccttccagcccggcctggccctggcccctgtgctcttcatcctggccatcacagccttccgggacctgtgggaggactacagccgccacagaagtgaccacaagatcaaccacctgggctgcctggtgttcagccgggaggagaagaagtatgtgaaccgcttctggaaggagatccacgtgggggactttgtgcggctgcgctgcaatgagatcttccctgctgacatcctgctgctgagcagcagtgaccctgatggcctgtgccacattgaaacagccaacctggatggagagaccaacctgaagaggcggcaggtggtgcggggcttcagcgagctggtgtctgagttcaaccccctgaccttcacctctgtgattgaatgtgagaagcccaacaatgacctgagccgcttccggggctgcatcatccatgacaatggcaagaaggccggcctgtacaaggagaacctgctgctgcggggctgcaccctgaggaacacagatgctgtggtgggcatcgtcatctatgccggccacgagaccaaggccctgctgaacaacagcggcccccgctacaagaggagcaagctggagcggcagatgaactgtgatgtgctgtggtgtgtgctgctgctggtgtgcatgagcctcttctctgctgtgggccacggcctgtggatctggagataccaggagaagaagagcctcttctacgtgcccaagagtgatggcagcagcctgagccctgtgacagctgctgtgtacagcttcctgaccatgatcatcgtgctgcaggtgctgatccccatcagcctgtatgtgtccattgaaattgtgaaggcctgccaggtgtacttcatcaaccaggacatgcagctgtatgatgaggagacagacagccagctgcagtgccgggccctgaacatcacagaggacctgggccagatccagtacatcttcagtgacaagacaggcaccctgacagagaacaagatggtgttccgccgctgcaccgtgtctggagtggagtacagccatgatgccaatgcccagaggctggcccgctaccaggaggccgacagcgaggaggaggaggtggtgccccggggcggctctgtgtcccagaggggcagcatcggcagccaccagagcgtgcgggtggtgcacaggacccagagcaccaagagccacagaagaacaggcagcagagctgaggccaagagggcctccatgctgagcaagcacacagccttcagcagccccatggagaaggacatcaccccagaccccaagctgctggagaaggtgtctgaatgtgacaagagcctggccgtggcccggcaccaggagcacctgctggcccacctgagccctgagctgagtgatgtgtttgacttcttcatcgccctgaccatctgcaacacagtggtggtgaccagcccagaccagcccaggaccaaggtgcgggtgcgctttgagctgaagagccctgtgaagaccatcgaggacttcctgcggcgcttcacccccagctgcctgaccagcggctgcagcagcatcggcagcctggccgccaacaagagcagccacaagctgggcagcagcttccccagcacccccagcagtgatggcatgctgctgcggctggaggagcggctgggccagcccaccagcgccatcgccagcaatggctacagcagccaggccgacaactgggccagcgagctggcccaggagcaggagagcgagcgggagctgcgctatgaagctgagagcccagatgaagctgccctggtgtatgctgcccgggcctacaactgtgtgctggtggagcggctgcatgaccaggtgtctgtggagctgccccacctgggccgcctgacctttgagctgctgcacaccctgggctttgacagcgtgaggaagaggatgtctgtggtgatccgccaccccctgacagatgagatcaacgtgtacaccaagggagctgacagcgtggtgatggacctgctgcagccctgcagctctgtggatgcccggggccgccaccagaagaagatccgcagcaagacccagaactacctgaatgtgtatgctgctgagggcctgcggaccctgtgcatcgccaagagggtgctgagcaaggaggagtatgcctgctggctgcagagccacctggaggccgagagcagcctggagaacagcgaggagctgctcttccagagcgccatccggctggagaccaacctgcacctgctgggcgccactggaattgaggaccggctgcaggatggagtgcctgagaccatcagcaagctgcggcaggccggcctgcagatctgggtgctgactggagacaagcaggagacagctgtgaacatcgcctatgcctgcaagctgctggaccatgatgaggaggtgatcaccctgaatgccaccagccaggaggcctgtgccgccctgctggaccagtgcctgtgctacgtgcagagccggggcctgcagagggcccctgagaagaccaagggcaaggtgtccatgaggttcagcagcctgtgcccccccagcaccagcacagccagcggccggcggcccagcctggtgattgatggccgcagcctggcctatgccctggagaagaacctggaggacaagttcctgttcctggccaagcagtgccgctctgtgctgtgctgccgcagcacccccctgcagaagtccatggtggtgaagctggtgcgcagcaagctgaaggccatgaccctggccatcggagatggagccaatgatgtgtccatgatccaggtggctgatgtgggcgtgggcatcagcggccaggagggcatgcaggccgtgatggccagtgactttgctgtgcccaagttccgctacctggagcggctgctgatcctgcacggccactggtgctacagccggctggccaacatggtgctgtacttcttctacaagaacaccatgtttgtgggcctgctcttctggttccagttcttctgtggcttcagcgccagcaccatgattgaccagtggtacctgatcttcttcaacctgctcttcagcagcctgccccccctggtgactggagtgctggacagagatgtgcctgccaacgtgctgctgaccaacccccagctgtacaagagcggccagaacatggaggagtaccggcccaggaccttctggttcaacatggctgatgctgccttccagagcctggtgtgcttcagcatcccctacctggcctactatgacagcaatgtggacctcttcacctggggcacccccatcgtgaccatcgccctgctgaccttcctgctgcacctgggcatcgagaccaagacctggacctggctgaactggatcacctgtggcttctctgtgctgctcttcttcaccgtggccctgatctacaatgccagctgtgccacctgctacccacccagcaacccctactggaccatgcaggccctgctgggggaccccgtcttctacctgacctgcctgatgacccctgtggccgccctgctgcccaggctcttcttccgcagcctgcagggccgggtcttccccacccagctgcagctggcccggcagctgaccaggaagagcccccggcgctgcagcgcccccaaggagacctttgcccagggccgcctgcccaaggacagcggcacagagcacagcagcggccgcacagtgaagacctctgtgcccctgagccagcccagctggcacacccagcagcctgtgtgcagcctggaggccagcggggagcccagcacagtggacatgtccatgcctgtgcgggagcacaccctgctggagggcctgagcgccccagcccccatgagcagcgcccctggagaggccgtgctgcggagccctgggggctgcccagaggagagcaaggtgcgggccgccagcacaggccgggtgacccccctgagcagcctcttcagcctgcccaccttcagcctgctgaactggatcagctcctggagcctggtgtcccggctgggctctgtgctgcagttcagcaggacagagcagctggctgatggccaggccggccggggcctgcctgtgcagccccacagcggccgcagcggcctgcagggccctgaccaccggctgctgattggagccagcagccgccgcagccagtag

SEQ ID NO: 144429 - DNA, 3405 bp, Artificial Sequence
  Description of Artificial Sequence: Synthetic coding sequence
atggactgcagcctggtgaggaccctggtgcaccgctactgtgccggggaggagaactgggtggacagcaggaccatctacgtgggccaccgggagcccccacctggagctgaggcctacatcccccagcgctacccagacaaccgcatcgtgagcagcaagtacaccttctggaacttcatccccaagaacctgtttgagcagttccggcgggtggccaacttctacttcctgatcatcttcctggtgcagctgatcatcgacacccccaccagccctgtgaccagcggcctgcccctcttcttcgtcatcaccgtgacagccatcaagcagggctatgaggactggctgcggcacaaggctgacaatgccatgaaccagtgccctgtgcacttcatccagcacggcaagctggtgaggaagcagagcaggaagctgcgggtgggggacatcgtgatggtgaaggaggatgagaccttcccctgtgacctgatcttcctgagcagcaacagaggagatggcacctgccacgtgaccacagccagcctggatggagagagcagccacaagacccactatgctgtgcaggacaccaagggcttccacacagaagaagatattggaggcctgcacgccaccattgaatgtgagcagccccagcctgacctgtacaagtttgtgggccgcatcaacgtgtacagcgacctgaatgaccctgtggtgcggcccctgggcagcgagaacctgctgctgcggggggccaccctgaagaacacagagaagatctttggagtggccatctacacaggcatggagaccaagatggccctgaactaccagagcaagagccagaagaggtctgctgtggagaagtccatgaatgccttcctgattgtgtacctgtgcatcctgatcagcaaggccctgatcaacacagtgctgaagtacatgtggcagagcgagcccttcagagatgagccctggtacaaccagaagacagaaagtgagcggcagaggaacctcttcctgaaggccttcacagacttcctggccttcatggtgctcttcaactacatcatccctgtgtccatgtatgtgacagtggagatgcagaagttcctgggcagctacttcatcacctgggatgaggacatgtttgatgaggagaccggggagggccccctggtgaacaccagtgacctgaatgaggagctgggccaggtggagtacatcttcacagacaagacaggcaccctgacagagaacaacatggagttcaaggagtgctgcatcgagggccacgtgtatgtgccccacgtgatctgcaatggccaggtgctgcctgagagcagcggcatcgacatgattgacagcagccccagcgtgaatggccgggagcgggaggagctgttcttccgggccctgtgcctgtgccacacagtgcaggtgaaggatgatgacagcgtggatggccccaggaagagcccagatggcggcaagagctgtgtgtacatcagcagcagcccagatgaggtggccctggtggagggcgtgcagaggctgggcttcacctacctgcggctgaaggacaactacatggagatcctgaaccgggagaaccacatcgagagatttgagctgctggagatcctgagctttgattctgtgagaagaaggatgtctgtgattgtgaagagcgccaccggggagatctacctgttctgcaagggagctgacagcagcatcttcccccgggtgattgagggcaaggtggaccagatccgggcccgggtggagagaaatgctgtggagggcctgcggaccctgtgtgtggcctacaagaggctcatccaggaggagtatgagggcatctgcaagctgctgcaggccgccaaggtggccctgcaggaccgggagaagaagctggccgaggcctatgagcagatcgagaaggacctgaccctgctgggcgccacagctgtggaggaccggctgcaggagaaggctgctgacaccatcgaggccctgcagaaggccggcatcaaggtgtgggtgctgactggagacaagatggagacagctgctgccacctgctacgcctgcaagctgttcagaagaaacacccagctgctggagctgaccaccaagagaattgaggagcagagcctgcatgatgtgctgtttgagctgagcaagacagtgctgcggcacagcggcagcctgacccgggacaacctgagcggcctgtctgctgacatgcaggactatggcctcatcattgatggagctgccctgagcctcatcatgaagcccagagaagatggcagcagcggcaactaccgggagctgttcctggagatctgccgcagctgcagcgctgtgctgtgctgcaggatggcccccctgcagaaggcccagatcgtgaagctgatcaagttcagcaaggagcaccccatcaccctggccatcggagatggagccaatgatgtgtccatgatcctggaggcccacgtgggcatcggcgtgattggcaaggagggccggcaggccgccaggaacagcgactatgccatccccaagttcaagcacctgaagaagatgctgctggtgcacggccacttctactacatccgcatcagcgagctggtgcagtacttcttctacaagaatgtgtgcttcatcttcccccagttcctgtaccagttcttctgtggcttcagccagcagaccctgtatgacacagcctacctgaccctgtacaacatctccttcaccagcctgcccatcctgctgtacagcctgatggagcagcacgtgggcattgatgtgctgaagagggaccccaccctgtacagagatgtggccaagaatgccctgctgcgctggagggtcttcatctactggaccctgctgggcctgtttgatgccctggtgttcttctttggagcctactttgtgtttgagaacaccaccgtgaccagcaatggccagatctttggaaactggaccttcggcaccctggtgttcaccgtgatggtgttcaccgtgaccctgaagctggccctggacacccactactggacctggatcaaccactttgtgatctggggcagcctgctcttctacgtggtgttcagcctgctgtggggcggcgtcatctggcccttcctgaactaccagaggatgtactacgtgttcatccagatgctgagcagcggccctgcctggctggccatcgtgctgctggtgaccatcagcctgctgcctgatgtgctgaagaaggtgctgtgccggcagctgtggcccacagccacagagcgggtgcagaccaagagccagtgcctgtctgtggagcagagcaccatcttcatgctgagccagaccagcagcagcctgtccttctag

SEQ ID NO: 144430 - DNA, 3576 bp, Artificial Sequence
  Description of Artificial Sequence: Synthetic coding sequence
atggactgcagcctggtgaggaccctggtgcaccgctactgtgccggggaggagaactgggtggacagcaggaccatctacgtgggccaccgggagcccccacctggagctgaggcctacatcccccagcgctacccagacaaccgcatcgtgagcagcaagtacaccttctggaacttcatccccaagaacctgtttgagcagttccggcgggtggccaacttctacttcctgatcatcttcctggtgcagctgatcatcgacacccccaccagccctgtgaccagcggcctgcccctcttcttcgtcatcaccgtgacagccatcaagcagggctatgaggactggctgcggcacaaggctgacaatgccatgaaccagtgccctgtgcacttcatccagcacggcaagctggtgaggaagcagagcaggaagctgcgggtgggggacatcgtgatggtgaaggaggatgagaccttcccctgtgacctgatcttcctgagcagcaacagaggagatggcacctgccacgtgaccacagccagcctggatggagagagcagccacaagacccactatgctgtgcaggacaccaagggcttccacacagaagaagatattggaggcctgcacgccaccattgaatgtgagcagccccagcctgacctgtacaagtttgtgggccgcatcaacgtgtacagcgacctgaatgaccctgtggtgcggcccctgggcagcgagaacctgctgctgcggggggccaccctgaagaacacagagaagatctttggagtggccatctacacaggcatggagaccaagatggccctgaactaccagagcaagagccagaagaggtctgctgtggagaagtccatgaatgccttcctgattgtgtacctgtgcatcctgatcagcaaggccctgatcaacacagtgctgaagtacatgtggcagagcgagcccttcagagatgagccctggtacaaccagaagacagaaagtgagcggcagaggaacctcttcctgaaggccttcacagacttcctggccttcatggtgctcttcaactacatcatccctgtgtccatgtatgtgacagtggagatgcagaagttcctgggcagctacttcatcacctgggatgaggacatgtttgatgaggagaccggggagggccccctggtgaacaccagtgacctgaatgaggagctgggccaggtggagtacatcttcacagacaagacaggcaccctgacagagaacaacatggagttcaaggagtgctgcatcgagggccacgtgtatgtgccccacgtgatctgcaatggccaggtgctgcctgagagcagcggcatcgacatgattgacagcagccccagcgtgaatggccgggagcgggaggagctgttcttccgggccctgtgcctgtgccacacagtgcaggtgaaggatgatgacagcgtggatggccccaggaagagcccagatggcggcaagagctgtgtgtacatcagcagcagcccagatgaggtggccctggtggagggcgtgcagaggctgggcttcacctacctgcggctgaaggacaactacatggagatcctgaaccgggagaaccacatcgagagatttgagctgctggagatcctgagctttgattctgtgagaagaaggatgtctgtgattgtgaagagcgccaccggggagatctacctgttctgcaagggagctgacagcagcatcttcccccgggtgattgagggcaaggtggaccagatccgggcccgggtggagagaaatgctgtggagggcctgcggaccctgtgtgtggcctacaagaggctcatccaggaggagtatgagggcatctgcaagctgctgcaggccgccaaggtggccctgcaggaccgggagaagaagctggccgaggcctatgagcagatcgagaaggacctgaccctgctgggcgccacagctgtggaggaccggctgcaggagaaggctgctgacaccatcgaggccctgcagaaggccggcatcaaggtgtgggtgctgactggagacaagatggagacagctgctgccacctgctacgcctgcaagctgttcagaagaaacacccagctgctggagctgaccaccaagagaattgaggagcagagcctgcatgatgtgctgtttgagctgagcaagacagtgctgcggcacagcggcagcctgacccgggacaacctgagcggcctgtctgctgacatgcaggactatggcctcatcattgatggagctgccctgagcctcatcatgaagcccagagaagatggcagcagcggcaactaccgggagctgttcctggagatctgccgcagctgcagcgctgtgctgtgctgcaggatggcccccctgcagaaggcccagatcgtgaagctgatcaagttcagcaaggagcaccccatcaccctggccatcggagatggagccaatgatgtgtccatgatcctggaggcccacgtgggcatcggcgtgattggcaaggagggccggcaggccgccaggaacagcgactatgccatccccaagttcaagcacctgaagaagatgctgctggtgcacggccacttctactacatccgcatcagcgagctggtgcagtacttcttctacaagaatgtgtgcttcatcttcccccagttcctgtaccagttcttctgtggcttcagccagcagaccctgtatgacacagcctacctgaccctgtacaacatctccttcaccagcctgcccatcctgctgtacagcctgatggagcagcacgtgggcattgatgtgctgaagagggaccccaccctgtacagagatgtggccaagaatgccctgctgcgctggagggtcttcatctactggaccctgctgggcctgtttgatgccctggtgttcttctttggagcctactttgtgtttgagaacaccaccgtgaccagcaatggccagatctttggaaactggaccttcggcaccctggtgttcaccgtgatggtgttcaccgtgaccctgaagctggccctggacacccactactggacctggatcaaccactttgtgatctggggcagcctgctcttctacgtggtgttcagcctgctgtggggcggcgtcatctggcccttcctgaactaccagaggatgtactacgtgttcatccagatgctgagcagcggccctgcctggctggccatcgtgctgctggtgaccatcagcctgctgcctgatgtgctgaagaaggtgctgtgccggcagctgtggcccacagccacagagcgggtgcagaatggctgtgcccagccccgggaccgggacagcgagttcacccccctggccagcctgcagagccctggctaccagagcacctgccccagcgctgcctggtacagcagccacagccagcaggtgaccctggccgcctggaaggagaaggtgtccacagagcccccacccatcctgggcggcagccaccaccactgcagcagcatccccagccacagctgccccaggagccgggtgggcatgctggtgtag

SEQ ID NO: 144431 - DNA, 3405 bp, Artificial Sequence; identical to SEQ ID NO: 144429
  Description of Artificial Sequence: Synthetic coding sequence

SEQ ID NO: 144432 - DNA, 2808 bp, Artificial Sequence
  Description of Artificial Sequence: Synthetic coding sequence
tgatatgtgggccaccgggagcccccacctggagctgaggcctacatcccccagcgctacccagacaacagaattgtgagcagcaagtacaccttctggaacttcatccccaagaacctgtttgagcagttcagaagagtggccaacttctacttcctgatcatcttcctggtgcagctgatcatcgacacccccaccagccctgtgaccagcggcctgcccctcttctttgtgatcaccgtgacagccatcaagcagggctatgaggactggctgcggcacaaggctgacaatgccatgaaccagtgccctgtgcacttcatccagcacggcaagctggtgaggaagcagagcaggaagctgcgggtgggggacatcgtgatggtgaaggaggatgagaccttcccctgtgacctgatcttcctgagcagcaacagaggagatggcacctgccacgtgaccacagccagcctggatggagagagcagccacaagacccactatgctgtgcaggacaccaagggcttccacacagaggaggacatcggcggcctgcacgccaccattgaatgtgagcagccccagcctgacctgtacaagtttgtgggccgcatcaacgtgtacagcgacctgaatgaccctgtggtgcggcccctgggcagcgagaacctgctgctgcggggggccaccctgaagaacacagagaagatcttcggcgtggccatctacacaggcatggagaccaagatggccctgaactaccagagcaagagccagaagaggtctgctgtggagaagtccatgaatgccttcctgattgtgtacctgtgcatcctgatcagcaaggccctgatcaacacagtgctgaagtacatgtggcagagcgagcccttcagagatgagccctggtacaaccagaagacagagagcgagcggcagaggaacctcttcctgaaggccttcacagacttcctggccttcatggtgctcttcaactacatcatccctgtgtccatgtatgtgacagtggagatgcagaagttcctgggcagctacttcatcacctgggatgaggacatgtttgatgaggagactggagagggccccctggtgaacaccagtgacctgaatgaggagctgggccaggtggagtacatcttcacagacaagacaggcaccctgacagagaacaacatggagttcaaggagtgctgcatcgagggccacgtgtatgtgccccacgtgatctgcaatggccaggtgctgcctgagagcagcggcatcgacatgattgacagcagccccagcgtgaatggccgggagcgggaggagctgttcttccgggccctgtgcctgtgccacacagtgcaggtgaaggatgatgattctgtggatggccccaggaagagcccagatggcggcaagagctgtgtgtacatcagcagcagcccagatgaggtggccctggtggagggcgtgcagaggctgggcttcacctacctgcggctgaaggacaactacatggagatcctgaaccgggagaaccacatcgagagatttgagctgctggagatcctgagctttgacagcgtgagaagaaggatgtctgtcatcgtgaagagcgccactggagagatctacctgttctgcaagggagctgacagcagcatcttccccagggtcatcgagggcaaggtggaccagatccgggcccgggtggagagaaatgctgtggagggcctgcggaccctgtgtgtggcctacaagaggctcatccaggaggagtatgagggcatctgcaagctgctgcaggccgccaaggtggccctgcaggaccgggagaagaagctggccgaggcctatgagcagatcgagaaggacctgaccctgctgggcgccacagctgtggaggaccggctgcaggagaaggctgctgacaccatcgaggccctgcagaaggccggcatcaaggtgtgggtgctgaccggggacaagatggagacagctgctgccacctgctacgcctgcaagctgttcagaagaaacacccagctgctggagctgaccaccaagagaattgaggagcagagcctgcatgatgtgctgtttgagctgagcaagacagtgctgcggcacagcggcagcctgacccgggacaacctgagcggcctgtctgctgacatgcaggactatggcctcatcattgatggagctgccctgagcctcatcatgaagccccgggaggatggcagcagcggcaactaccgggagctgttcctggagatctgccgcagctgcagcgctgtgctgtgctgcaggatggcccccctgcagaaggcccagatcgtgaagctgatcaagttcagcaaggagcaccccatcaccctggccatcggagatggagccaatgatgtgtccatgatcctggaggcccacgtgggcattggagtcatcggcaaggagggccggcaggccgccaggaacagcgactatgccatccccaagttcaagcacctgaagaagatgctgctggtgcacggccacttctactacatccgcatcagcgagctggtgcagtacttcttctacaagaatgtgtgcttcatcttcccccagttcctgtaccagttcttctgtggcttcagccagcagaccctgtatgacacagcctacctgaccctgtacaacatctccttcaccagcctgcccatcctgctgtacagcctgatggagcagcacgtgggcattgatgtgctgaagagggaccccaccctgtaccgctaccacccccccaacagcctgtcctag

SEQ ID NO: 144433 - DNA, 1119 bp, Artificial Sequence
  Description of Artificial Sequence: Synthetic coding sequence
atgtctgtcatcgtgaagagcgccactggagagatctacctgttctgcaagggagctgacagcagcatcttccccagggtcatcgagggcaaggtggaccagatccgggcccgggtggagagaaatgctgtggagggcctgcggaccctgtgtgtggcctacaagaggctcatccaggaggagtatgagggcatctgcaagctgctgcaggccgccaaggtggccctgcaggaccgggagaagaagctggccgaggcctatgagcagatcgagaaggacctgaccctgctgggcgccacagctgtggaggaccggctgcaggagaaggctgctgacaccatcgaggccctgcagaaggccggcatcaaggtgtgggtgctgaccggggacaagatggagacagctgctgccacctgctacgcctgcaagctgttcagaagaaacacccagctgctggagctgaccaccaagagaattgaggagcagagcctgcatgatgtgctgtttgagctgagcaagacagtgctgcggcacagcggcagcctgacccgggacaacctgagcggcctgtctgctgacatgcaggactatggcctcatcattgatggagctgccctgagcctcatcatgaagccccgggaggatggcagcagcggcaactaccgggagctgttcctggagatctgccgcagctgcagcgctgtgctgtgctgcaggatggcccccctgcagaaggcccagatcgtgaagctgatcaagttcagcaaggagcaccccatcaccctggccatcggagatggagccaatgatgtgtccatgatcctggaggcccacgtgggcattggagtcatcggcaaggagggccggcaggccgccaggaacagcgactatgccatccccaagttcaagcacctgaagaagatgctgctggtgcacggccacttctactacatccgcatcagcgagctggtgcagtacttcttctacaagaatgtgtgcttcatcttcccccagttcctgtaccagttcttctgtggcttcagccagcagggccggcggcaggagtgcccagctgccctggcccgggtgcacctgctggatgcccctggcaccgtgtag

SEQ ID NO: 144434 - DNA, 1059 bp, Artificial Sequence
  Description of Artificial Sequence: Synthetic coding sequence
tgaagcatcttccccagggtcatcgagggcaaggtggaccagatccgggcccgggtggagagaaatgctgtggagggcctgcggaccctgtgtgtggcctacaagaggctcatccaggaggagtatgagggcatctgcaagctgctgcaggccgccaaggtggccctgcaggaccgggagaagaagctggccgaggcctatgagcagatcgagaaggacctgaccctgctgggcgccacagctgtggaggaccggctgcaggagaaggctgctgacaccatcgaggccctgcagaaggccggcatcaaggtgtgggtgctgaccggggacaagatggagacagctgctgccacctgctacgcctgcaagctgttcagaagaaacacccagctgctggagctgaccaccaagagaattgaggagcagagcctgcatgatgtgctgtttgagctgagcaagacagtgctgcggcacagcggcagcctgacccgggacaacctgagcggcctgtctgctgacatgcaggactatggcctcatcattgatggagctgccctgagcctcatcatgaagccccgggaggatggcagcagcggcaactaccgggagctgttcctggagatctgccgcagctgcagcgctgtgctgtgctgcaggatggcccccctgcagaaggcccagatcgtgaagctgatcaagttcagcaaggagcaccccatcaccctggccatcggagatggagccaatgatgtgtccatgatcctggaggcccacgtgggcattggagtcatcggcaaggagggccggcaggccgccaggaacagcgactatgccatccccaagttcaagcacctgaagaagatgctgctggtgcacggccacttctactacatccgcatcagcgagctggtgcagtacttcttctacaagaatgtgtgcttcatcttcccccagttcctgtaccagttcttctgtggcttcagccagcagggccggcggcaggagtgcccagctgccctggcccgggtgcacctgctggatgcccctggcaccgtgtag

SEQ ID NO: 144435 - DNA, 3405 bp, Artificial Sequence; identical to SEQ ID NO: 144429
  Description of Artificial Sequence: Synthetic coding sequence

SEQ ID NO: 144436 - DNA, 3534 bp, Artificial Sequence
  Description of Artificial Sequence: Synthetic coding sequence
atgtggcgctggatccggcagcagctgggctttgatcctccccaccagagcgacaccaggaccatctacgtggccaaccgcttcccccagaatggcctgtacaccccccagaagttcatcgacaaccgcatcatcagcagcaagtacacagtgtggaactttgtgcccaagaacctgtttgagcagttccggcgggtggccaacttctacttcctgatcatcttcctggtgcagctgatgattgacacccccaccagccctgtgaccagcggcctgcccctcttcttcgtcatcaccgtgacagccatcaagcagggctatgaggactggctgcggcacaacagcgacaatgaggtgaatggagcccctgtgtatgtggtgcgcagcggcggcctggtgaagaccaggagcaagaacatccgggtgggggacatcgtgcgcatcgccaaggatgagatcttccctgctgacctggtgctgctgagcagtgaccggctggatggcagctgccacgtgaccacagccagcctggatggagagaccaacctgaagacccacgtggccgtgcctgagacagccctgctgcagacagtggccaacctggacaccctggtggccgtgattgagtgccagcagcctgaggccgacctgtaccgcttcatgggccgcatgatcatcacccagcagatggaggagatcgtgcggcccctgggccctgagagcctgctgctgcggggggcccggctgaagaacaccaaggagatcttcggcgtggccgtgtacacaggcatggagaccaagatggccctgaactacaagagcaagagccagaagaggtctgctgtggagaagtccatgaacaccttcctgatcatctacctggtgatcctgatcagcgaggccgtcatcagcaccatcctgaagtacacctggcaggccgaggagaagtgggatgagccctggtacaaccagaagacagagcaccagaggaacagcagcaagatcctgcgcttcatcagtgacttcctggccttcctggtgctgtacaacttcatcatccccatcagcctgtatgtgacagtggagatgcagaagttcctgggcagcttcttcatcggctgggacctggacctgtaccacgaggagagtgaccagaaggcccaggtgaacaccagtgacctgaatgaggagctgggccaggtggagtatgtgttcacagacaagacaggcaccctgacagaaaatgagatgcagttcagagaatgttccatcaatggcatgaagtaccaggagatcaatggccgcctggtgcctgagggccccaccccagacagcagcgagggcaacctgagctacctgagcagcctgagccacctgaacaacctgagccacctgaccaccagcagcagcttccgcaccagcccagaaaatgaaacagagctgatcaaggagcatgacctcttcttcaaggctgtgtccctgtgccacacagtgcagatcagcaatgtgcagacagactgcacaggagatggcccctggcagagcaacctggcccccagccagctggagtactatgccagcagcccagatgagaaggccctggtggaggccgccgccagaattggaattgtgttcatcggcaacagcgaggagaccatggaggtgaagaccctgggcaagctggagcgctacaagctgctgcacatcctggagtttgacagcgacagaagaaggatgtctgtcatcgtgcaggcccccagcggggagaagctgctgtttgccaagggagctgagagcagcatcctgcccaagtgcatcggcggggagattgagaagacccgcatccacgtggatgaatttgccctgaagggcctgcggaccctgtgcatcgcctacaggaagttcaccagcaaggagtatgaggagattgacaagaggatctttgaggccaggacagccctgcagcagcgggaggagaagctggccgctgtgttccagttcatcgagaaggacctgatcctgctgggcgccacagctgtggaggaccggctgcaggacaaggtgcgggagaccatcgaggccctgaggatggccggcatcaaggtgtgggtgctgaccggggacaagcatgaaacagctgtgtctgtgtccctgagctgtggccacttccacaggaccatgaacatcctggagctgatcaaccagaagagtgacagtgaatgtgccgagcagctgcggcagctggcccggcgcatcacagaggaccacgtgatccagcacggcctggtggtggatggcaccagcctgagcctggccctgcgggagcacgagaagctgttcatggaggtgtgcaggaactgcagcgctgtgctgtgctgcaggatggcccccctgcagaaggccaaggtgatccgcctcatcaagatcagccctgagaagcccatcaccctggccgtgggagatggagccaatgatgtgtccatgatccaggaggcccacgtgggcatcggcatcatgggcaaggagggccggcaggccgccaggaacagcgactatgccatcgcccgcttcaagttcctgagcaagctgctgtttgtgcacggccacttctactacatcagaattgccaccctggtgcagtacttcttctacaagaatgtgtgcttcatcaccccccagttcctgtaccagttctactgcctcttcagccagcagaccctgtatgacagcgtgtacctgaccctgtacaacatctgcttcaccagcctgcccatcctgatctacagcctgctggagcagcacgtggacccccacgtgctgcagaacaagcccaccctgtacagagacatcagcaagaaccggctgctgagcatcaagaccttcctgtactggaccatcctgggcttcagccacgccttcatcttcttcttcggcagctacctgctgattggcaaggacaccagcctgctgggcaatggccagatgtttggaaactggaccttcggcaccctggtgttcaccgtgatggtgatcaccgtgacagtgaagatggccctggagacccacttctggacctggatcaaccacctggtgacctggggcagcatcatcttctactttgtgttcagcctcttctacggcggcatcctgtggcccttcctgggcagccagaacatgtactttgtgttcatccagctgctgagcagcggcagcgcctggtttgccatcatcctgatggtggtgacctgcctcttcctggacatcatcaagaaggtgtttgacagacacctgcaccccaccagcacagagaaggcccagctgacagagaccaatgccggcatcaagtgcctggacagcatgtgctgcttccctgagggggaggccgcctgtgcctctgtgggccgcatgctggagcgggtgattggccgctgcagccccacccacatcagccgctcctggagcgccagtgaccccttctacaccaatgacaggagcatcctgaccctgagcaccatggacagcagcacctgctag

SEQ ID NO: 144437 - DNA, 315 bp, Artificial Sequence
  Description of Artificial Sequence: Synthetic coding sequence
atgtactttgtgttcatccagctgctgagcagcggcagcgcctggtttgccatcatcctgatggtggtgacctgcctcttcctggacatcatcaagaaggtgtttgacagacacctgcaccccaccagcacagagaaggcccagatgtacagcaacacagtggccctgagtgatgagttcatcgccctgcagcccctgagccgggccaggaaccagctgagcaagctgcgctggaagaagatccgggtgcagagcgcccagcacatgaacctgctgaaggccagcacagagggccgcacagtgggcacctgctag

SEQ ID NO: 144438 - DNA, 4503 bp, Artificial Sequence
  Description of Artificial Sequence: Synthetic coding sequence
atggaccccagcatgggcgtgaacagcgtgaccatctctgtggagggcatgacctgcaacagctgtgtgtggaccatcgagcagcagatcggcaaggtgaatggagtgcaccacatcaaggtgtccctggaggagaagaatgccaccatcatctatgaccccaagctgcagacccccaagaccctgcaggaggccattgatgacatgggctttgatgctgtgatccacaacccagaccccctgcctgtgctgacagacaccctcttcctgactgtgacagccagcctgaccctgccctgggaccacatccagagcaccctgctgaagaccaagggcgtgacagacatcaagatctacccccagaagaggacagtggccgtgaccatcatccccagcatcgtgaatgccaaccagatcaaggagctggtgcctgagctgagcctggacaccggcaccctggagaagaagagcggggcctgtgaggaccacagcatggcccaggccggggaggtggtgctgaagatgaaggtggagggcatgacctgccacagctgcaccagcaccatcgagggcaagattggcaagctgcagggcgtgcagaggatcaaggtgtccctggacaaccaggaggccaccatcgtgtaccagccccacctgatctctgtggaggagatgaagaagcagatcgaggccatgggcttccctgcctttgtgaagaagcagcccaagtacctgaagctgggcgccattgatgtggagcggctgaagaacacccctgtgaagagcagcgagggcagccagcagaggagccccagctacaccaatgacagcacagccaccttcatcattgatggcatgcactgcaagagctgtgtgagcaacatcgagagcaccctgagcgccctgcagtatgtgagcagcatcgtggtgtccctggagaacagaagtgccatcgtgaagtacaatgccagctctgtgaccccagagagcctgaggaaggccattgaagctgtgtccccaggcctgtacagagtgtccatcaccagcgaggtggagagcaccagcaacagccccagcagcagcagcctgcagaagatccccctgaatgtggtgtcccagcccctgacccaggagaccgtcatcaacattgatggcatgacctgcaacagctgtgtgcagagcattgaaggagtcatcagcaagaagccaggagtgaagagcatccgggtgtccctggccaacagcaatggcaccgtggagtatgaccccctgctgaccagccctgagaccctgcggggggccatcgaggacatgggctttgatgccaccctgagtgacaccaatgagcccctggtggtgattgcccagcccagcagcgagatgcccctgctgaccagcaccaatgagttctacaccaagggcatgacccctgtgcaggacaaggaggagggcaagaacagcagcaagtgctacatccaggtgacaggcatgacctgtgccagctgtgtggccaacatcgagaggaacctgcggcgggaggagggcatctacagcatcctggtggccctgatggccggcaaggccgaggtgcgctacaacccagctgtgatccagccccccatgattgctgagttcatccgggagctgggctttggagccaccgtgattgaaaatgctgatgaaggagatggagtgctggagctggtggtgcggggcatgacctgtgccagctgtgtgcacaagattgagagcagcctgaccaagcaccggggcatcctgtactgcagcgtggccctggccaccaacaaggcccacatcaagtatgaccctgagatcatcggcccccgggacatcatccacaccatcgagagcctgggctttgaggccagcctggtgaagaaggacagaagtgccagccacctggaccacaagcgggagatccggcagtggaggaggagcttcctggtgtccctcttcttctgcatccctgtgatgggcctgatgatctacatgatggtgatggaccaccactttgccaccctgcaccacaaccagaacatgagcaaggaggagatgatcaacctgcacagctccatgttcctggagcggcagatcctgcccggcctgtctgtgatgaacctgctgtccttcctgctgtgtgtgcctgtgcagttcttcggcggctggtacttctacatccaggcctacaaggccctgaagcacaagacagccaacatggatgtgctgattgtgctggccaccaccatcgcctttgcctacagcctcatcatcctgctggtggccatgtatgaaagagccaaggtgaaccccatcaccttctttgacaccccacccatgctgtttgtgttcatcgccctgggccgctggctggagcacatcgccaagggcaagaccagcgaggccctggccaagctgatcagcctgcaggccacagaggccaccatcgtgaccctggacagcgacaacatcctgctgtctgaggagcaggtggatgtggagctggtgcagagaggagacatcatcaaggtggtgcctgggggcaagtttcctgtggatggccgggtgattgagggccacagcatggtggatgagagcctcatcactggagaggccatgcctgtggccaagaagccaggcagcacagtgattgctggcagcatcaaccagaatggcagcctgctgatctgtgccacccacgtgggcgctgacaccaccctgagccagatcgtgaagctggtggaggaggcccagaccagcaaggcccccatccagcagtttgctgacaagctgagcggctactttgtgcccttcatcgtgtttgtgtccatcgccaccctgctggtgtggatcgtgattggcttcctgaactttgagatcgtggagacctacttccctggctacaacagaagcatcagcaggacagagaccatcatccgctttgccttccaggccagcatcaccgtgctgtgcatcgcctgcccctgcagcctgggcctggccacccccacagctgtgatggtgggcaccggggtgggcgcccagaatggcatcctgatcaagggcggggagcccctggagatggcccacaaggtgaaggtggtggtgtttgacaagacaggcaccatcacccacggcacccctgtggtgaaccaggtgaaggtgctgacagagagcaaccgcatcagccaccacaagatcctggccatcgtgggcacagctgagagcaacagcgagcaccccctgggcacagccatcaccaagtactgcaagcaggagctggacacagagaccctgggcacctgcatcgacttccaggtggtgcccggctgcggcatcagctgcaaggtgaccaacatcgagggcctgctgcacaagaacaactggaacatcgaggacaacaacatcaagaatgccagcctggtgcagattgatgccagcaatgagcagagcagcaccagcagctccatgatcattgatgcccagatcagcaatgccctgaatgcccagcagtacaaggtgctgattggcaaccgggagtggatgatcagaaatggcctggtgatcaacaatgatgtgaatgacttcatgacagagcacgagaggaaaggaagaacagctgtgctggtggccgtggatgatgagctgtgtggcctcatcgccatcgctgacacagtgaagccagaggccgagctggccatccacatcctgaagtccatgggcctggaggtggtgctgatgaccggggacaacagcaagacagcccggagcatcgccagccaggtgggcatcaccaaggtgtttgctgaggtgctgcccagccacaaggtggccaaggtgaagcagctgcaggaggagggcaagagggtggccatggtgggagatggcatcaatgacagccctgccctggccatggccaacgtgggcatcgccatcggcaccggcacagatgtggccatcgaggccgcagatgtggtgctgatcagaaatgacctgctggatgtggtggccagcattgacctgagccgggagaccgtgaagaggatccgcatcaactttgtgtttgccctgatctacaacctggtgggcatccccatcgccgccggggtcttcatgcccatcggcctggtgctgcagccctggatgggcagcgctgccatggccgccagctctgtgtctgtggtgctgagcagcctcttcctgaagctgtacaggaagcccacctatgagagctatgagctgcctgcccggagccagatcggccagaagagccccagcgagatctctgtgcacgtgggcattgatgacaccagcaggaacagccccaagctgggcctgctggaccgcatcgtgaactacagccgggccagcatcaacagcctgctgagtgacaagaggagcctgaacagcgtggtgaccagcgagccagacaagcacagcctgctggtgggggacttccgggaggatgatgacacagccctgtag

SEQ ID NO: 144439 - DNA, 4269 bp, Artificial Sequence
  Description of Artificial Sequence: Synthetic coding sequence
atggaccccagcatgggcgtgaacagcgtgaccatctctgtggagggcatgacctgcaacagctgtgtgtggaccatcgagcagcagatcggcaaggtgaatggagtgcaccacatcaaggtgtccctggaggagaagaatgccaccatcatctatgaccccaagctgcagacccccaagaccctgcaggaggccattgatgacatgggctttgatgctgtgatccacaacccagaccccctgcctgtgctgacagacaccctcttcctgactgtgacagccagcctgaccctgccctgggaccacatccagagcaccctgctgaagaccaagggcgtgacagacatcaagatctacccccagaagaggacagtggccgtgaccatcatccccagcatcgtgaatgccaaccagatcaaggagctggtgcctgagctgagcctggacaccggcaccctggagaagaagagcggggcctgtgaggaccacagcatggcccaggccggggaggtggtgctgaagatgaaggtggagggcatgacctgccacagctgcaccagcaccatcgagggcaagattggcaagctgcagggcgtgcagaggatcaaggtgtccctggacaaccaggaggccaccatcgtgtaccagccccacctgatctctgtggaggagatgaagaagcagatcgaggccatgggcttccctgcctttgtgaagaagcagcccaagtacctgaagctgggcgccattgatgtggagcggctgaagaacacccctgtgaagagcagcgagggcagccagcagaggagccccagctacaccaatgacagcacagccaccttcatcattgatggcatgcactgcaagagctgtgtgagcaacatcgagagcaccctgagcgccctgcagtatgtgagcagcatcgtggtgtccctggagaacagaagtgccatcgtgaagtacaatgccagctctgtgaccccagagagcctgaggaaggccattgaagctgtgtccccaggcctgtacagagtgtccatcaccagcgaggtggagagcaccagcaacagccccagcagcagcagcctgcagaagatccccctgaatgtggtgtcccagcccctgacccaggagaccgtcatcaacattgatggcatgacctgcaacagctgtgtgcagagcattgaaggagtcatcagcaagaagccaggagtgaagagcatccgggtgtccctggccaacagcaatggcaccgtggagtatgaccccctgctgaccagccctgagaccctgcggggggccatcgaggacatgggctttgatgccaccctgagtgacaccaatgagcccctggtggtgattgcccagcccagcagcgagatgcccctgctgaccagcaccaatgagttctacaccaagggcatgacccctgtgcaggacaaggaggagggcaagaacagcagcaagtgctacatccaggtgacaggcatgacctgtgccagctgtgtggccaacatcgagaggaacctgcggcgggaggagggcatctacagcatcctggtggccctgatggccggcaaggccgaggtgcgctacaacccagctgtgatccagccccccatgattgctgagttcatccgggagctgggctttggagccaccgtgattgaaaatgctgatgaaggagatggagtgctggagctggtggtgcggggcatgacctgtgccagctgtgtgcacaagattgagagcagcctgaccaagcaccggggcatcctgtactgcagcgtggccctggccaccaacaaggcccacatcaagtatgaccctgagatcatcggcccccgggacatcatccacaccatcgagagcctgggctttgaggccagcctggtgaagaaggacagaagtgccagccacctggaccacaagcgggagatccggcagtggaggaggagcttcctggtgtccctcttcttctgcatccctgtgatgggcctgatgatctacatgatggtgatggaccaccactttgccaccctgcaccacaaccagaacatgagcaaggaggagatgatcaacctgcacagctccatgttcctggagcggcagatcctgcccggcctgtctgtgatgaacctgctgtccttcctgctgtgtgtgcctgtgcagggcaagaccagcgaggccctggccaagctgatcagcctgcaggccacagaggccaccatcgtgaccctggacagcgacaacatcctgctgtctgaggagcaggtggatgtggagctggtgcagagaggagacatcatcaaggtggtgcctgggggcaagtttcctgtggatggccgggtgattgagggccacagcatggtggatgagagcctcatcactggagaggccatgcctgtggccaagaagccaggcagcacagtgattgctggcagcatcaaccagaatggcagcctgctgatctgtgccacccacgtgggcgctgacaccaccctgagccagatcgtgaagctggtggaggaggcccagaccagcaaggcccccatccagcagtttgctgacaagctgagcggctactttgtgcccttcatcgtgtttgtgtccatcgccaccctgctggtgtggatcgtgattggcttcctgaactttgagatcgtggagacctacttccctggctacaacagaagcatcagcaggacagagaccatcatccgctttgccttccaggccagcatcaccgtgctgtgcatcgcctgcccctgcagcctgggcctggccacccccacagctgtgatggtgggcaccggggtgggcgcccagaatggcatcctgatcaagggcggggagcccctggagatggcccacaaggtgaaggtggtggtgtttgacaagacaggcaccatcacccacggcacccctgtggtgaaccaggtgaaggtgctgacagagagcaaccgcatcagccaccacaagatcctggccatcgtgggcacagctgagagcaacagcgagcaccccctgggcacagccatcaccaagtactgcaagcaggagctggacacagagaccctgggcacctgcatcgacttccaggtggtgcccggctgcggcatcagctgcaaggtgaccaacatcgagggcctgctgcacaagaacaactggaacatcgaggacaacaacatcaagaatgccagcctggtgcagattgatgccagcaatgagcagagcagcaccagcagctccatgatcattgatgcccagatcagcaatgccctgaatgcccagcagtacaaggtgctgattggcaaccgggagtggatgatcagaaatggcctggtgatcaacaatgatgtgaatgacttcatgacagagcacgagaggaaaggaagaacagctgtgctggtggccgtggatgatgagctgtgtggcctcatcgccatcgctgacacagtgaagccagaggccgagctggccatccacatcctgaagtccatgggcctggaggtggtgctgatgaccggggacaacagcaagacagcccggagcatcgccagccaggtgggcatcaccaaggtgtttgctgaggtgctgcccagccacaaggtggccaaggtgaagcagctgcaggaggagggcaagagggtggccatggtgggagatggcatcaatgacagccctgccctggccatggccaacgtgggcatcgccatcggcaccggcacagatgtggccatcgaggccgcagatgtggtgctgatcagaaatgacctgctggatgtggtggccagcattgacctgagccgggagaccgtgaagaggatccgcatcaactttgtgtttgccctgatctacaacctggtgggcatccccatcgccgccggggtcttcatgcccatcggcctggtgctgcagccctggatgggcagcgctgccatggccgccagctctgtgtctgtggtgctgagcagcctcttcctgaagctgtacaggaagcccacctatgagagctatgagctgcctgcccggagccagatcggccagaagagccccagcgagatctctgtgcacgtgggcattgatgacaccagcaggaacagccccaagctgggcctgctggaccgcatcgtgaactacagccgggccagcatcaacagcctgctgagtgacaagaggagcctgaacagcgtggtgaccagcgagccagacaagcacagcctgctggtgggggacttccgggaggatgatgacacagccctgtag

SEQ ID NO: 144440 - DNA, 264 bp, Artificial Sequence
  Description of Artificial Sequence: Synthetic coding sequence
gaatgtaatgaggagatcaagatggaccccagcatgggcgtgaacagcgtgaccatctctgtggagggcatgacctgcaacagctgtgtgtggaccatcgagcagcagatcggcaaggtgaatggagtgcaccacatcaaggtgtccctggaggagaagaatgccaccatcatcttctacgcccactggtttggatttgctgccctggatggcatctgcagcaatggctgcttcatctgcttctgcagcaccttcttctcctag

SEQ ID NO: 144441 - DNA, 1512 bp, Artificial Sequence
  Description of Artificial Sequence: Synthetic coding sequence
atggaccccagcatgggcgtgaacagcgtgaccatctctgtggagggcatgacctgcaacagctgtgtgtggaccatcgagcagcagatcggcaaggtgaatggagtgcaccacatcaaggtgaaggtggtggtgtttgacaagacaggcaccatcacccacggcacccctgtggtgaaccaggtgaaggtgctgacagagagcaaccgcatcagccaccacaagatcctggccatcgtgggcacagctgagagcaacagcgagcaccccctgggcacagccatcaccaagtactgcaagcaggagctggacacagagaccctgggcacctgcatcgacttccaggtggtgcccggctgcggcatcagctgcaaggtgaccaacatcgagggcctgctgcacaagaacaactggaacatcgaggacaacaacatcaagaatgccagcctggtgcagattgatgccagcaatgagcagagcagcaccagcagctccatgatcattgatgcccagatcagcaatgccctgaatgcccagcagtacaaggtgctgattggcaaccgggagtggatgatcagaaatggcctggtgatcaacaatgatgtgaatgacttcatgacagaacatgagaggaagggccgcacagctgtgctggtggccgtggatgatgagctgtgtggcctgattgccatcgctgacacagtgaagccagaggccgagctggccatccacatcctgaagtccatgggcctggaggtggtgctgatgactggagacaacagcaagacagcccggagcatcgccagccaggtgggcatcaccaaggtgtttgctgaggtgctgcccagccacaaggtggccaaggtgaagcagctgcaggaggagggcaagagggtggccatggtgggagatggcatcaatgacagccctgccctggccatggccaacgtgggcatcgccatcggcactggaacagatgtggccattgaagctgctgatgtggtgctgatcagaaatgacctgctggatgtggtggccagcattgacctgagccgggagaccgtgaagaggatccgcatcaactttgtgtttgccctgatctacaacctggtgggcatccccatcgctgctggggtcttcatgcccatcggcctggtgctgcagccctggatgggcagcgctgccatggccgccagctctgtgtctgtggtgctgagcagcctcttcctgaagctgtacaggaagcccacctatgagagctatgagctgcctgcccggagccagatcggccagaagagccccagcgagatctctgtgcacgtgggcattgatgacaccagcaggaacagccccaagctgggcctgctggacagaattgtgaactacagccgggccagcatcaacagcctgctgagtgacaagaggagcctgaacagcgtggtgaccagcgagccagacaagcacagcctgctggtgggggacttcagagaagatgatgacacagccctgtag

SEQ ID NO: 144442 - DNA, 2049 bp, Artificial Sequence
  Description of Artificial Sequence: Synthetic coding sequence
agaaaccaggagtgcaatgaggagatcaagatggaccccagcatgggcgtgaacagcgtgaccatctctgtggagggcatgacctgcaacagctgtgtgtggaccatcgagcagcagatcggcaaggtgaatggagtgcaccacatcaaggtgtccctggaggagaagaatgccaccatcatctatgaccccaagctgcagacccccaagaccctgcaggaggccattgatgacatgggctttgatgctgtgatccacaacccagaccccctgcctgtgctgacagacaccctcttcctgactgtgacagccagcctgaccctgccctgggaccacatccagagcaccctgctgaagaccaagggcgtgacagacatcaagatctacccccagaagaggacagtggccgtgaccatcatccccagcatcgtgaatgccaaccagatcaaggagctggtgcctgagctgagcctggacaccggcaccctggagaagaagagcggggcctgtgaggaccacagcatggcccaggccggggaggtggtgctgaagatgaaggtggagggcatgacctgccacagctgcaccagcaccatcgagggcaagattggcaagctgcagggcgtgcagaggatcaaggtgtccctggacaaccaggaggccaccatcgtgtaccagccccacctgatctctgtggaggagatgaagaagcagatcgaggccatgggcttccctgcctttgtgaagaagcagcccaagtacctgaagctgggcgccattgatgtggagcggctgaagaacacccctgtgaagagcagcgagggcagccagcagaggagccccagctacaccaatgacagcacagccaccttcatcattgatggcatgcactgcaagagctgtgtgagcaacatcgagagcaccctgagcgccctgcagtatgtgagcagcatcgtggtgtccctggagaacagaagtgccatcgtgaagtacaatgccagctctgtgaccccagagagcctgaggaaggccattgaagctgtgtccccaggcctgtacagagtgtccatcaccagcgaggtggagagcaccagcaacagccccagcagcagcagcctgcagaagatccccctgaatgtggtgtcccagcccctgacccaggagaccgtcatcaacattgatggcatgacctgcaacagctgtgtgcagagcattgaaggagtcatcagcaagaagccaggagtgaagagcatccgggtgtccctggccaacagcaatggcaccgtggagtatgaccccctgctgaccagccctgagaccctgcggggggccatcgaggacatgggctttgatgccaccctgagtgacaccaatgagcccctggtggtgattgcccagcccagcagcgagatgcccctgctgaccagcaccaatgagttctacaccaagggcatgacccctgtgcaggacaaggaggagggcaagaacagcagcaagtgctacatccaggtgacaggcatgacctgtgccagctgtgtggccaacatcgagaggaacctgcggcgggaggagggcatctacagcatcctggtggccctgatggccggcaaggccgaggtgcgctacaacccagctgtgatccagccccccatgattgctgagttcatccgggagctgggctttggagccaccgtgattgaaaatgctgatgaaggagatggagtgctggagctggtggtgcggggcatgacctgtgccagctgtgtgcacaagattgagagcagcctgaccaagcaccggggcatcctgtactgcagcgtggccctggccaccaacaaggcccacatcaagtatgaccctgagatcatcggcccccgggacatcatccacaccatcgaggtgtctgccaagaacctgtgcttctgtgtgctgacctacctgatcagcacccctgtgaaccacttctggtttgccagtgacagaggaaatgagaagaagagcaacagctttgagcacttcaagcaggacctgagccagaacctgatgtag

SEQ ID NO: 144443 - DNA, 825 bp, Artificial Sequence
  Description of Artificial Sequence: Synthetic coding sequence
atggaccccagcatgggcgtgaacagcgtgaccatctctgtggagggcatgacctgcaacagctgtgtgtggaccatcgagcagcagatcggcaaggtgaatggagtgcaccacatcaaggtgtccctggaggagaagaatgccaccatcatctatgaccccaagctgcagacccccaagaccctgcaggaggccattgatgacatgggctttgatgctgtgatccacaacccagaccccctgcctgtgctgacagacaccctcttcctgactgtgacagccagcctgaccctgccctgggaccacatccagagcaccctgctgaagaccaagggcgtgacagacatcaagatctacccccagaagaggacagtggccgtgaccatcatccccagcatcgtgaatgccaaccagatcaaggagctggtgcctgagctgagcctggacaccggcaccctggagaagaagagcggggcctgtgaggaccacagcatggcccaggccggggaggtggtgctgaagatgaaggtggagggcatgacctgccacagctgcaccagcaccatcgagggcaagattggcaagctgcagggcgtgcagaggatcaaggtgtccctggacaaccaggaggccaccatcgtgtaccagccccacctgatctctgtggaggagatgaagaagcagatcgaggccatgggcttccctgcctttgtgaagaagcagcccaagtacctgaagctgggcgccattgatgtggagcggctgaagaacacccctgtgaagagcagcgagggcagccagcagaggagccccagctaccagtag

SEQ ID NO: 144444 - DNA, 546 bp, Artificial Sequence
  Description of Artificial Sequence: Synthetic coding sequence
atgaggcccagcggcacctgtgccagctgtggcagtgaccccccaccacccacccaggtgcccagcagcagaaatgactgtggcagcacagtgcctgacaacccctttgtgaggaccctgccccacaccaccatgagcggccaccagctgcccccagctggcacccagaggcctggccctgctgcctgcctggtgcccggcagcctgcccagcctgcccagccagcccggcccctggggcgccctgggcacagctgctgctgagggcatgagctgcagcaacaccaggacagccctggagtttgccctcttccccaaggagatgctgctgggctcctggtacggctggggcctgagcctgtaccgccggggccgctgccaggacagcgcccaccctgaggaggacacctgcccccatggagagggcgccccagcccaggccggggagagcgtgcccagccagcagctgtgccaccaccctgctggcaactggggcggcctgtactgggtgattggcaaggccttcagcctggcctggaactgctag

SEQ ID NO: 144445 - DNA, 642 bp, Artificial Sequence
  Description of Artificial Sequence: Synthetic coding sequence
atgagggtgcggggccctgcccggctcatcgccagcggggcccggctgctgctgaggatgctgagcgccctgcccggctggggccctgcccacctgcagaggcccctgctgggccctgccagctgcctgggcatcctgcggcctgccatgacagcccacagctttgccctgcccgtcatcatcttcaccaccttctggggcctggtgggcattgctggcccctggtttgtgcccaagggccccaacagaggagtcatcatcaccatgctggtggccacagctgtgtgctgctacctgctgtgcccagccctgggcatgacagtggcccccctgagcctgaccacccccagcagcggccccagccccacccagctgtgcctggtgaccagcagcctgctgctggccccccgggaccctgacccccagggcctgcccggctcctggaagagcagccagagcagccagcctgcccgggccctgggcagccctggccacagcagcggcagaggagatgtgctgctgcagtacccccactgcagcggcgtgtgccccctgagccagggagatgctgctggggagctggtgtgggtgggcagcttccccctgcagacaggccagatgcctggcctgagccccagctag

SEQ ID NO: 144446 - DNA, 495 bp, Artificial Sequence
  Description of Artificial Sequence: Synthetic coding sequence
atgacagcccacagctttgccctgcctgtgatcatcttcaccaccttctggggcctggtgggcattgctggcccctggtttgtgcccaagggccccaacagaggagtcatcatcaccatgctggtggccacagctgtgtgctgctacctgctgtgcccagccctgggcatgacagtggcccccctgagcctgaccacccccagcagcggccccagccccacccagctgtgcctggtgaccagcagcctgctgctggccccccgggaccctgacccccagggcctgcccggctcctggaagagcagccagagcagccagcctgcccgggccctgggcagccctggccacagcagcggcagaggagatgtgctgctgcagtacccccactgcagcggcgtgtgccccctgagccagggagatgctgctggggagctggtgtgggtgggcagcttccccctgcagacaggccagatgcctggcctgagccccagctag

SEQ ID NO: 144447 - DNA, 393 bp, Artificial Sequence
  Description of Artificial Sequence: Synthetic coding sequence
atgagggtgcggggccctgcccggctcatcgccagcggggcccggctgctgctgaggatgctgagcgccctgcccggctggggccctgcccacctgcagaggcccctgctgggccctgccagctgcctgggcatcctgcggcctgccatgacagcccacagctttgccctgcccgtcatcatcttcaccaccttctggggcctggtgggcattgctggcccctggtttgtgcccaagggccccaacagaggagtcatcatcaccatgctggtggccacagctgtgtgctgctacctgttctggctgattgccatcctggcccagctgaaccccctgtttggcccccagctgaagaatgagaccatctggtacgtgcgcttcctgtgggagtag

SEQ ID NO: 144448 - DNA, 246 bp, Artificial Sequence
  Description of Artificial Sequence: Synthetic coding sequence
atgacagcccacagctttgccctgcctgtgatcatcttcaccaccttctggggcctggtgggcattgctggcccctggtttgtgcccaagggccccaacagaggagtcatcatcaccatgctggtggccacagctgtgtgctgctacctgttctggctgattgccatcctggcccagctgaaccccctgtttggcccccagctgaagaatgagaccatctggtacgtgcgcttcctgtgggagtag

SEQ ID NO: 144449 - DNA, 564 bp, Artificial Sequence
  Description of Artificial Sequence: Synthetic coding sequence
atgacagcccacagctttgccctgcctgtgatcatcttcaccaccttctggggcctggtgggcattgctggcccctggtttgtgcccaagggccccaacagaggagtcatcatcaccatgctggtggccacagctgtgtgctgctacctgttctggctgattgccatcctggcccagctgaaccccctgtttggcccccagctgaagaatgagaccatctggtgcccagccctgggcatgacagtggcccccctgagcctgaccacccccagcagcggccccagccccacccagctgtgcctggtgaccagcagcctgctgctggccccccgggaccctgacccccagggcctgcccggctcctggaagagcagccagagcagccagcctgcccgggccctgggcagccctggccacagcagcggcagaggagatgtgctgctgcagtacccccactgcagcggcgtgtgccccctgagccagggagatgctgctggggagctggtgtgggtgggcagcttccccctgcagacaggccagatgcctggcctgagccccagctag

SEQ ID NO: 144450 - DNA, 357 bp, Artificial Sequence
  Description of Artificial Sequence: Synthetic coding sequence
atggccagccagagccagggcatccagcagctgctgcaggccgagaagagagctgctgagaaggtgtctgaggccaggaagaggaagaacagaaggctgaagcaggccaaggaggaggcccaggccgagattgagcagtaccgcctgcagcgggagaaggagttcaaggccaaggaggccgccgccctgggcagccggggcagctgcagcacagaggtggagaaggagacccaggagaagatgaccatcctgcagacctacttccggcagaacagagatgaggtgctggacaacctgctggcctttgtgtgtgacatccggcctgagatccacgagaactaccgcatcaatggatag

SEQ ID NO: 144451 - DNA, 357 bp, Artificial Sequence
  Description of Artificial Sequence: Synthetic coding sequence
atggccagccagagccagggcatccagcagctgctgcaggccgagaagagagctgctgagaaggtggctgatgccaggaagaggaaggcccggcggctgaagcaggccaaggaggaggcccagatggaggtggagcagtaccgccgggagcgggagcacgagttccagagcaagcagcaggccgccatgggcagccagggcaacctgtctgctgaggtggagcaggccacccggcggcaggtgcagggcatgcagagcagccagcagaggaaccgggagcgggtgctggcccagctgctgggcatggtgtgtgatgtgcggccccaggtgcaccccaactaccgcatcagcgcctag

SEQ ID NO: 144452 - DNA, 237 bp, Artificial Sequence
  Description of Artificial Sequence: Synthetic coding sequence
atggccagccagagccagggcatccagcagctgctgcaggccgagaagagagctgctgagaaggtggctgatgccaggaagaggaaggcccggcggctgaagcaggccacccggcggcaggtgcagggcatgcagagcagccagcagaggaaccgggagcgggtgctggcccagctgctgggcatggtgtgtgatgtgcggccccaggtgcaccccaactaccgcatcagcgcctag

SEQ ID NO: 144453 - DNA, 357 bp, Artificial Sequence; identical to SEQ ID NO: 144451
  Description of Artificial Sequence: Synthetic coding sequence

SEQ ID NO: 144454 - DNA, 477 bp, Artificial Sequence
  Description of Artificial Sequence: Synthetic coding sequence
gggggccagcagcacgctgtgccctgcccccatggaggccctgggggccagggccagcccagggctgaggccgccggcaccggccagggccacagaggaggccacaggcctggagctgtggtgggcgccgcccagcacctgcaccggggcctgggcgtggccggcggcggccctggccctggccctgctgtgctgcagaccaggaaggcccggcggctgaagcaggccaaggaggaggcccagatggaggtggagcagtaccgccgggagcgggagcacgagttccagagcaagcagcaggccgccatgggcagccagggcaacctgtctgctgaggtggagcaggccacccggcggcaggtgcagggcatgcagagcagccagcagaggaaccgggagcgggtgctggcccagctgctgggcatggtgtgtgatgtgcggccccaggtgcaccccaactaccgcatcagcgcctag

SEQ ID NO: 144455 - DNA, 237 bp, Artificial Sequence; identical to SEQ ID NO: 144452
  Description of Artificial Sequence: Synthetic coding sequence

SEQ ID NO: 144456 - DNA, 237 bp, Artificial Sequence; identical to SEQ ID NO: 144452
  Description of Artificial Sequence: Synthetic coding sequence

SEQ ID NO: 144457 - DNA, 357 bp, Artificial Sequence; identical to SEQ ID NO: 144451
  Description of Artificial Sequence: Synthetic coding sequence

SEQ ID NO: 144458 - DNA, 237 bp, Artificial Sequence; identical to SEQ ID NO: 144452
  Description of Artificial Sequence: Synthetic coding sequence

SEQ ID NO: 144459 - DNA, 357 bp, Artificial Sequence; identical to SEQ ID NO: 144451
  Description of Artificial Sequence: Synthetic coding sequence

SEQ ID NO: 144460 - DNA, 237 bp, Artificial Sequence; identical to SEQ ID NO: 144452
  Description of Artificial Sequence: Synthetic coding sequence

SEQ ID NO: 144461 - DNA, 237 bp, Artificial Sequence; identical to SEQ ID NO: 144452
  Description of Artificial Sequence: Synthetic coding sequence

SEQ ID NO: 144462 - DNA, 357 bp, Artificial Sequence; identical to SEQ ID NO: 144451
  Description of Artificial Sequence: Synthetic coding sequence

SEQ ID NO: 144463 - DNA, 237 bp, Artificial Sequence; identical to SEQ ID NO: 144452
  Description of Artificial Sequence: Synthetic coding sequence

SEQ ID NO: 144464 - DNA, 357 bp, Artificial Sequence; identical to SEQ ID NO: 144451
  Description of Artificial Sequence: Synthetic coding sequence

SEQ ID NO: 144465 - DNA, 357 bp, Artificial Sequence; identical to SEQ ID NO: 144451
  Description of Artificial Sequence: Synthetic coding sequence

SEQ ID NO: 144466 - DNA, 234 bp, Artificial Sequence
  Description of Artificial Sequence: Synthetic coding sequence
atggaggtggagcagtacagaagagagcgggagcacgagttccagagcaagcagcaggccgccatgggcagccagggcaacctgtctgctgaggtggagcaggccacccggcggcaggtgcagggcatgcagagcagccagcagaggaaccgggagcgggtgctggcccagctgctgggcatggtgtgtgatgtgcggccccaggtgcaccccaactaccgcatcagcgcctag

SEQ ID NO: 144467 - DNA, 348 bp, Artificial Sequence
  Description of Artificial Sequence: Synthetic coding sequence
gtggagcccggcatccagcagctgctgcaggccgagaagagagctgctgagaaggtggctgatgccaggaagaggaaggcccggcggctgaagcaggccaaggaggaggcccagatggaggtggagcagtacagaagagagcgggagcacgagttccagagcaagcagcaggccgccatgggcagccagggcaacctgtctgctgaggtggagcaggccacccggcggcaggtgcagggcatgcagagcagccagcagaggaaccgggagcgggtgctggcccagctgctgggcatggtgtgtgatgtgcggccccaggtgcaccccaactaccgcatcagcgcctag

SEQ ID NO: 144468 - DNA, 468 bp, Artificial Sequence
  Description of Artificial Sequence: Synthetic coding sequence
atgtctgagagcaagagcggcccagaatatgccagcttctttgctgtgatgggcgccagcgctgccatggtgttcagcgccctgggcgccgcctacggcacagccaagtctggaactggaattgctgccatgtctgtgatgaggcctgagcagatcatgaagagcatcatccctgtggtgatggccggcatcatcgccatctacggcctggtggtggccgtgctgattgccaacagcctgaatgatgacatcagcctgtacaagagcttcctgcagctgggcgccggcctgtctgtgggcctgagcggcctggccgccggctttgccatcggcatcgtgggagatgctggggtgcggggcacagcccagcagccccggctgtttgtgggcatgatcctgatcctgatctttgctgaggtgctgggcctgtatggcctgattgtggccctgatcctgagcaccaagtag

SEQ ID NO: 144469 - DNA, 477 bp, Artificial Sequence
  Description of Artificial Sequence: Synthetic coding sequence
atgtggagcaacctgggcatcggcctggccatcagcctgtctgtggtgggcgccgcctggggcatctacatcaccggcagcagcatcatcggcggcggcgtgaaggccccccgcatcaagaccaagaacctggtgtccatcatcttctgtgaggccgtggccatctacggcatcatcatggccatcgtcatcagcaacatggccgagcccttcagcgccacagaccccaaggccatcggccacaggaactaccacgccggctacagcatgtttggagctggcctgactgtgggcctgagcaacctcttctgtggggtgtgtgtgggcatcgtgggcagcggggccgccctggctgatgcccagaaccccagcctgtttgtgaagatcctgattgtggagatctttggaagtgccatcggcctgtttggagtgattgtggccatcctgcagaccagccgggtgaagatgggagactag

SEQ ID NO: 144470 - DNA, 129 bp, Artificial Sequence
  Description of Artificial Sequence: Synthetic coding sequence
gtgggcagcggggccgccctggctgatgcccagaaccccagcctgtttgtgaagatcctgattgtggagatcttcggcagcctggccagcctgggcagcagcagccagttcttccggcccccagagtag

SEQ ID NO: 144471 - DNA, 759 bp, Artificial Sequence
  Description of Artificial Sequence: Synthetic coding sequence
atgacaggcctggccctgctgtacagcggcgtgtttgtggccttctgggcctgtgccctggccgtgggggaggccggctcctggagggctggggccgccagccggcccagctggccaggaagaaattctgctgggaagtggccagctggcaacacaggccccccccgggccctgcacccccggctgtggggcctggccccagcccgggccagtgacagcgacaagggggaccctgacttccagctgctggaggagggcttcctgacagagaccagccccttcatgtggagcaacctgggcatcggcctggccatcagcctgtctgtggtgggcgccgcctggggcatctacatcaccggcagcagcatcatcggcggcggcgtgaaggccccccgcatcaagaccaagaacctggtgtccatcatcttctgtgaggccgtggccatctacggcatcatcatggccatcgtcatcagcaacatggccgagcccttcagcgccacagaccccaaggccatcggccacaggaactaccacgccggctacagcatgtttggagctggcctgactgtgggcctgagcaacctcttctgtggggtgtgtgtgggcatcgtgggcagcggggccgccctggctgatgcccagaaccccagcctgtttgtgaagatcctgattgtggagatctttggaagtgccatcggcctgtttggagtgattgtggccatcctgcagaccagccgggtgaagatgggagactag

SEQ ID NO: 144472 - DNA, 618 bp, Artificial Sequence
  Description of Artificial Sequence: Synthetic coding sequence
atgacaggcctggccctgctgtacagcggcgtgtttgtggccttctgggcctgtgccctggccgtgggcgtgtgctacaccatctttgacctgggcttccgctttgatgtggcctggttcctgacagagaccagccccttcatgtggagcaacctgggcatcggcctggccatcagcctgtctgtggtgggcgccgcctggggcatctacatcaccggcagcagcatcattggaggcggcgtgaaggccccccgcatcaagaccaagaacctggtgtccatcatcttctgtgaggccgtggccatctacggcatcatcatggccatcgtcatcagcaacatggccgagcccttcagcgccacagaccccaaggccatcggccacaggaactaccacgccggctacagcatgtttggagctggcctgactgtgggcctgagcaacctcttctgtggggtgtgtgtgggcatcgtgggcagcggggccgccctggctgatgcccagaaccccagcctgtttgtgaagatcctgattgtggagatcttcggcagcgccatcggcctgtttggagtcatcgtggccatcctgcagaccagccgggtgaagatgggagactag

SEQ ID NO: 144473 - DNA, 261 bp, Artificial Sequence
  Description of Artificial Sequence: Synthetic coding sequence
atgtggagcaacctgggcatcggcctggccatcagcctgtctgtggtgggcgccgcctggggcatctacatcaccggcagcagcatcatcggcggcggcgtgaaggccccccgcatcaagaccaagaacctggtgtccatcatcttctgtgaggccgtggccatctacggcatcatcatggccatcgtcatcagcaacatggccgagcccttcagcgccacagaccccaaggccatcggccacaggaactaccacgcctag

SEQ ID NO: 144474 - DNA, 477 bp, Artificial Sequence; identical to SEQ ID NO: 144469
  Description of Artificial Sequence: Synthetic coding sequence

SEQ ID NO: 144475 - DNA, 786 bp, Artificial Sequence
  Description of Artificial Sequence: Synthetic coding sequence
atgacaggcctggccctgctgtacagcggcgtgtttgtggccttctgggcctgtgccctggccgtgggcgtgtgctacaccatctttgacctgggcttccgctttgatgtggcctggttcctgacagagaccagccccttcatgtggagcaacctgggcatcggcctggccatcagcctgtctgtggtgggcgccgcctggggcatctacatcaccggcagcagcatcattggaggcggcgtgaaggccccccgcatcaagaccaagaacctggtgtccatcatcttctgtgaggccgtggccatctacggcatcatcatggccatcgtcatcagcaacatggccgagcccttcagcgccacagaccccaaggccatcggccacaggaactaccacgccggctacagcatgtttggagctggcctgactgtgggcctgagcaacctcttctgtggggtgtgtgtgggcatcgtgggcagcggggccgccctggctgatgcccagaaccccagcctgtttgtgaagatcctgattgtggagatcttcggcagcgccatcggcctgtttggagtcatcgtggccatcctgcaggtgatgaaccccctgggcaagcccctgtgcccctgcccccagcccagcctgaccctgctgctggagaagctgaagtgcagccccagcctgcccatcaccatcgacagccccaagcagctgcccccaccccacttccacctgctggtgttctcctaccggggcagcctcttcctgagcctcatctggtgccactag

SEQ ID NO: 144476 - DNA, 681 bp, Artificial Sequence
  Description of Artificial Sequence: Synthetic coding sequence
atggccctgagtgatgctgatgtgcagaagcagatcaagcacatgatggccttcatcgagcaggaggccaatgagaaggccgaggagattgatgccaaggccgaggaggagttcaacatcgagaagggccgcctggtgcagacccagaggctgaagatcatggagtactatgagaagaaggagaagcagatcgagcagcagaagaagatccagatgagcaacctgatgaaccaggcccggctgaaggtgctgcgggccagagatgacctgatcacagacctgctgaatgaggccaagcagaggctgagcaaggtggtgaaggacaccacccgctaccaggtgctgctggatggcctggtgctgcagggcctgtaccagctgctggagcccaggatgattgtgcgctgcaggaagcaggacttccccctggtgaaggctgctgtgcagaaggccatccccatgtacaagatcgccaccaagaatgatgtggatgtgcagattgaccaggagagctacctgcctgaagatattgctgggggcgtggagatctacaatggagacaggaagatcaaggtgagcaacaccctggagagccggctggacctgattgcccagcagatgatgcctgaggtgcggggggccctgtttggagccaatgccaacaggaagttcctggactag

SEQ ID NO: 144477 - DNA, 591 bp, Artificial Sequence
  Description of Artificial Sequence: Synthetic coding sequence
atggccctgagtgatgctgatgtgcagaagcagatcaagcacatgatggccttcatcgagcaggaggccaatgagaaggccgaggagattgatgccaaggccgaggaggagttcaacatcgagaagggccgcctggtgcagacccagaggctgaagatcatggagtactatgagaagaaggagaagcagatcgagcagcagaagaagatccagatgagcaacctgatgaaccaggcccggctgaaggtgctgcgggccagagatgacctgatcaccggcctgtaccagctgctggagcccaggatgattgtgcgctgcaggaagcaggacttccccctggtgaaggctgctgtgcagaaggccatccccatgtacaagatcgccaccaagaatgatgtggatgtgcagattgaccaggagagctacctgcctgaagatattgctgggggcgtggagatctacaatggagacaggaagatcaaggtgagcaacaccctggagagccggctggacctgattgcccagcagatgatgcctgaggtgcggggggccctgtttggagccaatgccaacaggaagttcctggactag

SEQ ID NO: 144478 - DNA, 615 bp, Artificial Sequence
  Description of Artificial Sequence: Synthetic coding sequence
atggccctgagtgatgctgatgtgcagaagcaggccgaggaggagttcaacatcgagaagggccgcctggtgcagacccagaggctgaagatcatggagtactatgagaagaaggagaagcagatcgagcagcagaagaagatccagatgagcaacctgatgaaccaggcccggctgaaggtgctgcgggccagagatgacctgatcacagacctgctgaatgaggccaagcagaggctgagcaaggtggtgaaggacaccacccgctaccaggtgctgctggatggcctggtgctgcagggcctgtaccagctgctggagcccaggatgattgtgcgctgcaggaagcaggacttccccctggtgaaggctgctgtgcagaaggccatccccatgtacaagatcgccaccaagaatgatgtggatgtgcagattgaccaggagagctacctgcctgaagatattgctgggggcgtggagatctacaatggagacaggaagatcaaggtgagcaacaccctggagagccggctggacctgattgcccagcagatgatgcctgaggtgcggggggccctgtttggagccaatgccaacaggaagttcctggactag

SEQ ID NO: 144479 - DNA, 1056 bp, Artificial Sequence
  Description of Artificial Sequence: Synthetic coding sequence
atgtccttcttccctgagctgtacttcaacgtggacaatggctacctggagggcctggtgcggggcctgaaggccggcgtgctgagccaggccgactacctgaacctggtgcagtgtgagaccctggaggacctgaagctgcacctgcagagcacagattatggcaacttcctggccaatgaggccagccccctgactgtgtctgtgattgatgaccggctgaaggagaagatggtggtggagttccgccacatgaggaaccacgcctatgagcccctggccagcttcctggacttcatcacctacagctacatgattgacaacgtcatcctgctgatcaccggcaccctgcaccagaggagcattgctgagctggtgcccaagtgccaccccctgggcagctttgagcagatggaggccgtgaacatcgcccagaccccagctgagctgtacaatgccatcctggtggacacccccctggccgccttcttccaggactgcatcagcgagcaggacctggatgagatgaacatcgagatcatccggaacaccctgtacaaggcctacctggagagcttctacaagttctgcaccctgctgggcggcaccacagcagatgccatgtgccccatcctggagtttgaggccgaccggcgggccttcatcatcaccatcaacagctttggaacagagctgagcaaagaagatcgggccaagctgttcccccactgcggccgcctgtacccagagggcctggcccagctggcccgggcagatgattatgagcaggtgaagaatgtggccgactactacccagagtacaagctgctgtttgagggcgccggcagcaaccctggggacaagaccctggaggaccgcttctttgaacatgaggtgaagctgaacaagctggccttcctgaaccagttccactttggagtcttctacgcctttgtgaagctgaaggagcaggagtgcagaaatattgtgtggattgctgagtgcatcgcccagaggcaccgggccaagattgacaactacatccccatcttctag

SEQ ID NO: 144480 - DNA, 825 bp, Artificial Sequence
  Description of Artificial Sequence: Synthetic coding sequence
atggtggtggagttccgccacatgagaaatcatgcctatgagcccctggccagcttcctggacttcatcacctacagctacatgattgacaacgtcatcctgctgatcaccggcaccctgcaccagaggagcattgctgagctggtgcccaagtgccaccccctgggcagctttgagcagatggaggccgtgaacatcgcccagaccccagctgagctgtacaatgccatcctggtggacacccccctggccgccttcttccaggactgcatcagcgagcaggacctggatgagatgaacatcgagatcatccggaacaccctgtacaaggcctacctggagagcttctacaagttctgcaccctgctgggcggcaccacagcagatgccatgtgccccatcctggagtttgaagctgacagaagagccttcatcatcaccatcaacagctttggaacagagctgagcaaggaggaccgggccaagctgttcccccactgcggccgcctgtacccagagggcctggcccagctggcccgggcagatgattatgagcaggtgaagaatgtggccgactactacccagagtacaagctgctgtttgaaggagctggcagcaaccctggggacaagaccctggaggaccgcttctttgagcacgaggtgaagctgaacaagctggccttcctgaaccagttccactttggagtcttctacgcctttgtgaagctgaaggagcaggagtgcaggaacatcgtgtggattgctgaatgtattgcccagaggcaccgggccaagattgacaactacatccccatcttctag

SEQ ID NO: 144481 - DNA, 1179 bp, Artificial Sequence
  Description of Artificial Sequence: Synthetic coding sequence
atgtccttcttccctgagctgtacttcaacgtggacaatggctacctggagggcctggtgcggggcctgaaggccggcgtgctgagccaggccgactacctgaacctggtgcagtgtgagaccctggaggacctgaagctgcacctgcagagcacagattatggcaacttcctggccaatgaggccagccccctgactgtgtctgtgattgatgaccggctgaaggagaagatggtggtggagttccgccacatgaggaaccacgcctatgagcccctggccagcttcctggacttcatcacccaggagagcgaggccggcaccccagagggccctggcaacatgcccaagctgggcagccggcccagccctggccaccggccccccttcctgcgggtgtccctgctgccctggccacccagcagctacagctacatgattgacaacgtcatcctgctgatcaccggcaccctgcaccagaggagcattgctgagctggtgcccaagtgccaccccctgggcagctttgagcagatggaggccgtgaacatcgcccagaccccagctgagctgtacaatgccatcctggtggacacccccctggccgccttcttccaggactgcatcagcgagcaggacctggatgagatgaacatcgagatcatccggaacaccctgtacaaggcctacctggagagcttctacaagttctgcaccctgctgggcggcaccacagcagatgccatgtgccccatcctggagtttgaagctgacagaagagccttcatcatcaccatcaacagctttggaacagagctgagcaaggaggaccgggccaagctgttcccccactgcggccgcctgtacccagagggcctggcccagctggcccgggcagatgattatgagcaggtgaagaatgtggccgactactacccagagtacaagctgctgtttgaaggagctggcagcaaccctggggacaagaccctggaggaccgcttctttgagcacgaggtgaagctgaacaagctggccttcctgaaccagttccactttggagtcttctacgcctttgtgaagctgaaggagcaggagtgcaggaacatcgtgtggattgctgaatgtattgcccagaggcaccgggccaagattgacaactacatccccatcttctag

SEQ ID NO: 144482 - DNA, 1149 bp, Artificial Sequence
  Description of Artificial Sequence: Synthetic coding sequence
atgacagagttctggctgatcagcgcccctggagagaagacctgccagcagacctgggagaagctgcacgccgccaccagcaagaacaacaacctggccgtgaccagcaagttcaacatcccagacctgaaggtgggcaccctggatgtgctggtgggcctgagtgatgagctggccaagctggatgcctttgtggagggcgtggtgaagaaggtggcccagtacatggctgatgtgctggaggacagcaaggacaaggtgcaggagaacctgctggccaacggggtggacctggtgacctacatcacccgcttccagtgggacatggccaagtaccccatcaagcagagcctgaagaacatcagcgagatcatcgccaagggcgtgacccagattgacaatgacctgaagagccgggccagcgcctacaacaacctgaagggcaacctgcagaacctggagaggaagaatgccggcagcctgctgaccaggagcctggccgagatcgtgaagaaggatgactttgtgctggacagcgagtacctggtgaccctgctggtggtggtgcccaagctgaaccacaatgactggatcaagcagtatgagaccctggccgagatggtggtgcccaggagcagcaatgtgctgtctgaggaccaggacagctacctgtgcaatgtgaccctcttcaggaaggctgtggatgacttccgccacaaggcccgggagaacaagttcatcgtgcgggacttccagtacaatgaggaggagatgaaggctgacaaggaggagatgaaccggctgagcacagacaagaagaagcagtttggccccctggtgcgctggctgaaggtgaacttcagcgaggccttcatcgcctggatccacgtgaaggccctgcgggtgtttgtggagagcgtgctgcgctatggcctgcctgtgaacttccaggccatgctgctgcagcccaacaagaagaccctgaagaagctgcgggaggtgctgcacgagctgtacaagcacctggacagcagcgctgctgccatcattgatgcccccatggacatccctggcctgaacctgagccagcaggagtactacccctacgtgtactacaagattgactgcaacctgctggagttcaagtag

SEQ ID NO: 144483 - DNA, 1149 bp, Artificial Sequence; identical to SEQ ID NO: 144482
  Description of Artificial Sequence: Synthetic coding sequence

SEQ ID NO: 144484 - DNA, 1053 bp, Artificial Sequence
  Description of Artificial Sequence: Synthetic coding sequence
atggctgtgtttgtggtgctgctggccctggtggccggcgtgctgggcaatgagttcagcatcctgaagagccctggctctgtggtgttcagaaatggaaactggcccatccctggagagcgcatcccagatgtggccgccctgtccatgggcttctctgtgaaggaggacctgtcctggccaggcctggccgtgggcaacctcttccaccggccccgggccaccgtgatggtgatggtgaagggcgtgaacaagctggccctgcccccaggcagcgtcatctcctaccccctggagaatgctgtgcccttcagcctggacagcgtggccaacagcatccacagcctcttcagcgaggagacccctgtggtgctgcagctggcccccagcgaggagcgggtgtacatggtgggcaaggccaacagcgtgtttgaggacctgtctgtgaccctgcggcagctgaggaacagactcttccaggagaacagcgtgctgagcagcctgcccctgaacagcctgagcagaaataatgaggtggacctgctcttcctgtctgagctgcaggtgctgcatgacatcagcagcctgctgagccgccacaagcacctggccaaggaccacagcccagacctgtacagcctggagctggccggcctggatgagatcggcaagcgctacggggaggacagcgagcagttcagagatgccagcaagatcctggtggatgccctgcagaagtttgctgatgacatgtacagcctgtatggaggaaatgctgtggtggagctggtgacagtgaagagctttgacaccagcctcatcaggaagaccaggaccatcctggaggccaagcaggccaagaacccagccagcccctacaacctggcctacaagtacaactttgagtacagcgtggtgttcaacatggtgctgtggatcatgattgccctggccctggccgtcatcatcaccagctacaacatctggaacatggaccccggctatgacagcatcatctacaggatgaccaaccagaagatccgcatggactag

SEQ ID NO: 144485 - DNA, 732 bp, Artificial Sequence
  Description of Artificial Sequence: Synthetic coding sequence
tgatgcccagctggccccttccgggtggccccccagtgctgcggccggcggggcaccatggctgtgtttgtggtgctgctggccctggtggccggcgtgctgggcaatgagttcagcatcctgaagagccctggctctgtggtgttcagaaatggaaactggcccatccctggagagcgcatcccagatgtggccgccctgtccatgggcttctctgtgaaggaggacctgtcctggccaggcctggccgtgggcaacctcttccaccggccccgggccaccgtgatggtgatggtgaagggcgtgaacaagctggccctgcccccaggcagcgtcatctcctaccccctggagaatgtggacctgctcttcctgtctgagctgcaggtgctgcatgacatcagcagcctgctgagccgccacaagcacctggccaaggaccacagcccagacctgtacagcctggagctggccggcctggatgaaattggcaagagatatggagaagattctgagcagttcagagatgccagcaagatcctggtggatgccctgcagaagtttgctgatgacatgtacagcctgtatggaggaaatgctgtggtggagctggtgacagtgaagagctttgacaccagcctcatcaggaagaccaggaccatcctggaggccaagcaggccaagaacccagccagcccctacaacctggcctacaagtacaactttgaatag

SEQ ID NO: 144486 - DNA, 612 bp, Artificial Sequence
  Description of Artificial Sequence: Synthetic coding sequence
gagagcgagcgggtgaccagcagccgctgtggctgccggccctgcccagctggccccttccgggtggccccccagtgctgcggcagaagaggcaccatggctgtgtttgtggtgctgctggccctggtggccggcgtgctgggcaatgagttcagcatcctgaagagccctggctctgtggtgttcagaaatggaaactggcccatccctggagagcgcatcccagatgtggccgccctgtccatgggcttctctgtgaaggaggacctgtcctggccaggcctggccgtgggcaacctcttccaccggccccgggccaccgtgatggtgatggtgaagggcgtgaacaagctggccctgcccccaggcagcgtcatctcctaccccctggagaacagagtgtacatggtgggcaaggccaacagcgtgtttgaggacctgtctgtgaccctgcggcagctgaggaacagactcttccaggagaacagcgtgctgagcagcctgcccctgaacagcctgagcagaaataatgaggtggacctgctcttcctgtctgagctgcaggtgctgcatgacatcagcagcctgctgagccgccacaagcacctgtag

SEQ ID NO: 144487 - DNA, 780 bp, Artificial Sequence
  Description of Artificial Sequence: Synthetic coding sequence
tgagtgcccccagcccggtctgtgagccccaggtctgctgctgctgctgctgccccctggctgtgcctgagctgctcctggcgctggtggagggacctgtcctggccaggcctggccgtgggcaacctcttccaccggccccgggccaccgtgatggtgatggtgaagggcgtgaacaagctggccctgcccccaggcagcgtcatctcctaccccctggagaatgctgtgcccttcagcctggacagcgtggccaacagcatccacagcctcttcagcgaggagacccctgtggtgctgcagctggcccccagcgaggagcgggtgtacatggtgggcaaggccaacagcgtgtttgaggacctgtctgtgaccctgcggcagctgaggaacagactcttccaggagaacagcgtgctgagcagcctgcccctgaacagcctgagcaggaacaatgaggtggacctgctcttcctgtctgagctgcaggtgctgcatgacatcagcagcctgctgagccgccacaagcacctggccaaggaccacagcccagacctgtacagcctggagctggccggcctggatgaaattggcaagagatatggagaagattctgagcagttcagagatgccagcaagatcctggtggatgccctgcagaagtttgctgatgacatgtacagcctgtatggaggaaatgctgtggtggagctggtgacagtgaagagctttgacaccagcctcatcaggaagaccaggaccatcctggaggccaagtag

SEQ ID NO: 144488 - DNA, 957 bp, Artificial Sequence
  Description of Artificial Sequence: Synthetic coding sequence
atggctgtgtttgtggtgctgctggccctggtggccggcgtgctgggcaatgagttcagcatcctgaagagccctggctctgtggtgttcagaaatggaaactggcccatccctggagagcgcatcccagatgtggccgccctgtccatgggcttctctgtgaaggaggacctgtcctggccaggcctggccgtgggcaacctcttccaccggccccgggccaccgtgatggtgatggtgaagggcgtgaacaagctggccctgcccccaggcagcgtcatctcctaccccctggagaacagagtgtacatggtgggcaaggccaacagcgtgtttgaggacctgtctgtgaccctgcggcagctgaggaacagactcttccaggagaacagcgtgctgagcagcctgcccctgaacagcctgagcagaaataatgaggtggacctgctcttcctgtctgagctgcaggtgctgcatgacatcagcagcctgctgagccgccacaagcacctggccaaggaccacagcccagacctgtacagcctggagctggccggcctggatgagatcggcaagcgctacggggaggacagcgagcagttcagagatgccagcaagatcctggtggatgccctgcagaagtttgctgatgacatgtacagcctgtatggaggaaatgctgtggtggagctggtgacagtgaagagctttgacaccagcctcatcaggaagaccaggaccatcctggaggccaagcaggccaagaacccagccagcccctacaacctggcctacaagtacaactttgagtacagcgtggtgttcaacatggtgctgtggatcatgattgccctggccctggccgtcatcatcaccagctacaacatctggaacatggaccccggctatgacagcatcatctacaggatgaccaaccagaagatccgcatggactag

SEQ ID NO: 144489 - DNA, 819 bp, Artificial Sequence
  Description of Artificial Sequence: Synthetic coding sequence
atggctgtgtttgtggtgctgctggccctggtggccggcgtgctgggcaatgagttcagcatcctgaagagccctggctctgtggtgttcagaaatggaaactggcccatccctggagagcgcatcccagatgtggccgccctgtccatgggcttctctgtgaaggaggacctgtcctggccaggcctggccgtgggcaacctcttccaccggccccgggccaccgtgatggtgatggtgaagggcgtgaacaagctggccctgcccccaggcagcgtcatctcctaccccctggagaatgtggacctgctcttcctgtctgagctgcaggtgctgcatgacatcagcagcctgctgagccgccacaagcacctggccaaggaccacagcccagacctgtacagcctggagctggccggcctggatgagatcggcaagcgctacggggaggacagcgagcagttcagagatgccagcaagatcctggtggatgccctgcagaagtttgctgatgacatgtacagcctgtatggaggaaatgctgtggtggagctggtgacagtgaagagctttgacaccagcctcatcaggaagaccaggaccatcctggaggccaagcaggccaagaacccagccagcccctacaacctggcctacaagtacaactttgagtacagcgtggtgttcaacatggtgctgtggatcatgattgccctggccctggccgtcatcatcaccagctacaacatctggaacatggaccccggctatgacagcatcatctacaggatgaccaaccagaagatccgcatggactag

SEQ ID NO: 144490 - DNA, 498 bp, Artificial Sequence
  Description of Artificial Sequence: Synthetic coding sequence
atggctgtgtttgtggtgctgctggccctggtggccggcgtgctgggcaatgagttcagcatcctgaagagccctggctctgtggtgttcagaaatggaaactggcccatccctggagagcgcatcccagatgtggccgccctgtccatgggcttctctgtgaaggaggacctgtcctggccaggcctggccgtgggcaacctcttccaccggccccgggccaccgtgatggtgatggtgaagggcgtgaacaagctggccctgcccccaggcagcgtcatctcctaccccctggagaatgctgtgcccttcagcctggacagcgtggccaacagcatccacagcctcttcagcgaggagacccctgtggtgctgcagctggcccccagcgaggagcgggtgtacatggtgggcaccatgaagctgacctgcagcttcttcctgaactgcaagtgctacatgatcttccaggcctgctgcctggtgatcagcatctag

SEQ ID NO: 144491 - DNA, 825 bp, Artificial Sequence
  Description of Artificial Sequence: Synthetic coding sequence
atggtgatggtgaagggcgtgaacaagctggccctgcccccaggcagcgtcatctcctaccccctggagaatgctgtgcccttcagcctggacagcgtggccaacagcatccacagcctcttcagcgaggagacccctgtggtgctgcagctggcccccagcgaggagcgggtgtacatggtgggcaaggccaacagcgtgtttgaggacctgtctgtgaccctgcggcagctgaggaacagactcttccaggagaacagcgtgctgagcagcctgcccctgaacagcctgagcagaaataatgaggtggacctgctcttcctgtctgagctgcaggtgctgcatgacatcagcagcctgctgagccgccacaagcacctggccaaggaccacagcccagacctgtacagcctggagctggccggcctggatgagatcggcaagcgctacggggaggacagcgagcagttcagagatgccagcaagatcctggtggatgccctgcagaagtttgctgatgacatgtacagcctgtatggaggaaatgctgtggtggagctggtgacagtgaagagctttgacaccagcctcatcaggaagaccaggaccatcctggaggccaagcaggccaagaacccagccagcccctacaacctggcctacaagtacaactttgagtacagcgtggtgttcaacatggtgctgtggatcatgattgccctggccctggccgtcatcatcaccagctacaacatctggaacatggaccccggctatgacagcatcatctacaggatgaccaaccagaagatccgcatggactag

SEQ ID NO: 144492 - DNA, 2517 bp, Artificial Sequence
  Description of Artificial Sequence: Synthetic coding sequence
atgggagagctgttccgctctgaggagatgaccctggcccagctgttcctgcagagcgaggccgcctactgctgcgtgtctgagctgggggagctgggcaaggtgcagttccgggacctgaacccagatgtgaatgtgttccagaggaagtttgtgaatgaggtgcggcgctgtgaggagatggacaggaagctgcgctttgtggagaaggagatcaggaaggccaacatccccatcatggacaccggggagaaccctgaggtgcccttcccccgggacatgattgacctggaggccaactttgagaagattgaaaatgagctgaaggagatcaacaccaaccaggaggccctgaagaggaacttcctggagctgacagagctgaagttcatcctgaggaagacccagcagttctttgatgaggccgagctgcaccaccagcagatggctgaccctgacctgctggaggagagcagcagcctgctggagcccagcgagatgggccggggcacccccctgcggctgggctttgtggccggggtcatcaaccgggagcgcatccccacctttgagaggatgctgtggagggtgtgcagaggaaatgtgttcctgcggcaggccgagattgagaaccccctggaggaccctgtgactggagactatgtgcacaagtctgtgttcatcatcttcttccagggcgaccagctgaagaacagagtgaagaagatctgtgagggcttccgggccagcctgtacccctgcccagagaccccccaggagaggaaggagatggccagcggcgtgaacaccagaattgatgacctgcagatggtgctgaaccagacagaggaccaccggcagagggtgctgcaggccgccgccaagaacatccgggtgtggttcatcaaggtgaggaagatgaaggccatctaccacaccctgaacctgtgcaacattgatgtgacccagaagtgcctgattgctgaggtgtggtgccctgtgacagacctggacagcatccagtttgccctgcggcggggcacagagcacagcggcagcacagtgcccagcatcctgaacaggatgcagaccaaccagaccccacccacctacaacaagaccaacaagttcacctacggcttccagaacatcgtggatgcctacggcatcggcacctaccgggagatcaacccagccccctacaccatcatcaccttccccttcctgtttgctgtgatgtttggagactttggacatggcatcctgatgaccctgtttgctgtgtggatggtgctgcgggagagccgcatcctgagccagaagaatgaaaatgagatgttcagcacagtgttcagcggccgctacatcatcctgctgatgggcgtcttctccatgtacacaggcctcatctacaatgactgcttcagcaagagcctgaacatcttcggcagctcctggagcgtgcggcccatgttcacctacaactggacagaggagaccctgcggggcaaccctgtgctgcagctgaacccagccctgcccggggtgtttggaggcccctacccctttggaattgaccccatctggaacatcgccaccaacaagctgaccttcctgaacagcttcaagatgaagatgtctgtcatcctgggcatcatccacatgctgtttggagtgtccctgagcctcttcaaccacatctacttcaagaagcccctgaacatctacttcggcttcatccctgagatcatcttcatgaccagcctgtttggctacctggtgatcctgatcttctacaagtggacagcctatgatgcccacaccagtgaaaatgcccccagcctgctgatccacttcatcaacatgttcctgttctcctacccagagagcggctacagcatgctgtacagcggccagaagggcatccagtgcttcctggtggtggtggccctgctgtgtgtgccctggatgctgctcttcaagcccctggtgctgcggcggcagtacctgcggaggaagcacctgggcaccctgaactttggaggcatccgggtgggcaatggccccacagaggaggatgctgagatcatccagcacgaccagctgagcacccacagtgaagatgctgatgaatttgattttggagacaccatggtgcaccaggccatccacaccatcgagtactgcctgggctgcatcagcaacacagccagctacctgcggctgtgggccctgagcctggcccacgcccagctgtctgaggtgctgtggaccatggtgatccacatcggcctgtctgtgaagagcctggccggcggcctggtgctcttcttcttcttcaccgcctttgccaccctgactgtggccatcctgctgatcatggagggcctgagcgccttcctgcacgccctgcggctgcactgggtggagttccagaacaagttctacagcggcaccggcttcaagttcctgcccttctcctttgagcacatccgggagggcaagtttgaggagtag

SEQ ID NO: 144493 - DNA, 2514 bp, Artificial Sequence
  Description of Artificial Sequence: Synthetic coding sequence
atgggagagctgttccgctctgaggagatgaccctggcccagctgttcctgcagagcgaggccgcctactgctgcgtgtctgagctgggggagctgggcaaggtgcagttccgggacctgaacccagatgtgaatgtgttccagaggaagtttgtgaatgaggtgcggcgctgtgaggagatggacaggaagctgcgctttgtggagaaggagatcaggaaggccaacatccccatcatggacaccggggagaaccctgaggtgcccttcccccgggacatgattgacctggaggccaactttgagaagattgaaaatgagctgaaggagatcaacaccaaccaggaggccctgaagaggaacttcctggagctgacagagctgaagttcatcctgaggaagacccagcagttctttgatgagatggctgaccctgacctgctggaggagagcagcagcctgctggagcccagcgagatgggccggggcacccccctgcggctgggctttgtggccggggtcatcaaccgggagcgcatccccacctttgagaggatgctgtggagggtgtgcagaggaaatgtgttcctgcggcaggccgagattgagaaccccctggaggaccctgtgactggagactatgtgcacaagagcgtcttcatcatcttcttccagggcgaccagctgaagaacagagtgaagaagatctgtgagggcttccgggccagcctgtacccctgcccagagaccccccaggagaggaaggagatggccagcggcgtgaacaccagaattgatgacctgcagatggtgctgaaccagacagaggaccaccggcagagggtgctgcaggccgccgccaagaacatccgggtgtggttcatcaaggtgaggaagatgaaggccatctaccacaccctgaacctgtgcaacattgatgtgacccagaagtgcctgattgctgaggtgtggtgccctgtgacagacctggacagcatccagtttgccctgcggcggggcacagagcacagcggcagcacagtgcccagcatcctgaacaggatgcagaccaaccagaccccacccacctacaacaagaccaacaagttcacctacggcttccagaacatcgtggatgcctatggaattggcacctaccgggagatcaacccagccccctacaccatcatcaccttccccttcctgtttgctgtgatgtttggagactttggccacggcatcctgatgaccctgtttgctgtgtggatggtgctgcgggagagccgcatcctgagccagaagaatgaaaatgagatgttcagcaccgtcttcagcggccgctacatcatcctgctgatgggcgtcttctccatgtacacaggcctcatctacaatgactgcttcagcaagagcctgaacatcttcggcagctcctggagcgtgcggcccatgttcacctacaactggacagaggagaccctgcggggcaaccctgtgctgcagctgaacccagccctgcccggggtgtttggaggcccctaccccttcggcatcgaccccatctggaacatcgccaccaacaagctgaccttcctgaacagcttcaagatgaagatgtctgtcatcctgggcatcatccacatgctgtttggagtgtccctgagcctcttcaaccacatctacttcaagaagcccctgaacatctacttcggcttcatccctgagatcatcttcatgaccagcctgtttggctacctggtgatcctgatcttctacaagtggacagcctatgatgcccacaccagtgaaaatgcccccagcctgctgatccacttcatcaacatgttcctgttctcctacccagagagcggctacagcatgctgtacagcggccagaagggcatccagtgcttcctggtggtggtggccctgctgtgtgtgccctggatgctgctcttcaagcccctggtgctgcggcggcagtacctgcggaggaagcacctgggcaccctgaactttggaggcatccgggtgggcaatggccccacagaagaagatgctgagatcatccagcacgaccagctgagcacccacagtgaagatgctgatgagcccagtgaagatgaggtgtttgattttggagacaccatggtgcaccaggccatccacaccatcgagtactgcctgggctgcatcagcaacacagccagctacctgcggctgtgggccctgagcctggcccacgcccagctgtctgaggtgctgtggaccatggtgatccacatcggcctgtctgtgaagagcctggccggcggcctggtgctcttcttcttcttcaccgcctttgccaccctgactgtggccatcctgctgatcatggagggcctgagcgccttcctgcacgccctgcggctgcactgggtggagttccagaacaagttctacagcggcaccggcttcaagttcctgcccttctcctttgagcacatccgggagggcaagtttgaggagtag

SEQ ID NO: 144494 - DNA, 2496 bp, Artificial Sequence
  Description of Artificial Sequence: Synthetic coding sequence
atgggagagctgttccgctctgaggagatgaccctggcccagctgttcctgcagagcgaggccgcctactgctgcgtgtctgagctgggggagctgggcaaggtgcagttccgggacctgaacccagatgtgaatgtgttccagaggaagtttgtgaatgaggtgcggcgctgtgaggagatggacaggaagctgcgctttgtggagaaggagatcaggaaggccaacatccccatcatggacaccggggagaaccctgaggtgcccttcccccgggacatgattgacctggaggccaactttgagaagattgaaaatgagctgaaggagatcaacaccaaccaggaggccctgaagaggaacttcctggagctgacagagctgaagttcatcctgaggaagacccagcagttctttgatgagatggctgaccctgacctgctggaggagagcagcagcctgctggagcccagcgagatgggccggggcacccccctgcggctgggctttgtggccggggtcatcaaccgggagcgcatccccacctttgagaggatgctgtggagggtgtgcagaggaaatgtgttcctgcggcaggccgagattgagaaccccctggaggaccctgtgactggagactatgtgcacaagagcgtcttcatcatcttcttccagggcgaccagctgaagaacagagtgaagaagatctgtgagggcttccgggccagcctgtacccctgcccagagaccccccaggagaggaaggagatggccagcggcgtgaacaccagaattgatgacctgcagatggtgctgaaccagacagaggaccaccggcagagggtgctgcaggccgccgccaagaacatccgggtgtggttcatcaaggtgaggaagatgaaggccatctaccacaccctgaacctgtgcaacattgatgtgacccagaagtgcctgattgctgaggtgtggtgccctgtgacagacctggacagcatccagtttgccctgcggcggggcacagagcacagcggcagcacagtgcccagcatcctgaacaggatgcagaccaaccagaccccacccacctacaacaagaccaacaagttcacctacggcttccagaacatcgtggatgcctatggaattggcacctaccgggagatcaacccagccccctacaccatcatcaccttccccttcctgtttgctgtgatgtttggagactttggccacggcatcctgatgaccctgtttgctgtgtggatggtgctgcgggagagccgcatcctgagccagaagaatgaaaatgagatgttcagcaccgtcttcagcggccgctacatcatcctgctgatgggcgtcttctccatgtacacaggcctcatctacaatgactgcttcagcaagagcctgaacatcttcggcagctcctggagcgtgcggcccatgttcacctacaactggacagaggagaccctgcggggcaaccctgtgctgcagctgaacccagccctgcccggggtgtttggaggcccctaccccttcggcatcgaccccatctggaacatcgccaccaacaagctgaccttcctgaacagcttcaagatgaagatgtctgtcatcctgggcatcatccacatgctgtttggagtgtccctgagcctcttcaaccacatctacttcaagaagcccctgaacatctacttcggcttcatccctgagatcatcttcatgaccagcctgtttggctacctggtgatcctgatcttctacaagtggacagcctatgatgcccacaccagtgaaaatgcccccagcctgctgatccacttcatcaacatgttcctgttctcctacccagagagcggctacagcatgctgtacagcggccagaagggcatccagtgcttcctggtggtggtggccctgctgtgtgtgccctggatgctgctcttcaagcccctggtgctgcggcggcagtacctgcggaggaagcacctgggcaccctgaactttggaggcatccgggtgggcaatggccccacagaagaagatgctgagatcatccagcacgaccagctgagcacccacagtgaagatgctgatgaatttgattttggagacaccatggtgcaccaggccatccacaccatcgagtactgcctgggctgcatcagcaacacagccagctacctgcggctgtgggccctgagcctggcccacgcccagctgtctgaggtgctgtggaccatggtgatccacatcggcctgtctgtgaagagcctggccggcggcctggtgctcttcttcttcttcaccgcctttgccaccctgactgtggccatcctgctgatcatggagggcctgagcgccttcctgcacgccctgcggctgcactgggtggagttccagaacaagttctacagcggcaccggcttcaagttcctgcccttctcctttgagcacatccgggagggcaagtttgaggagtag

SEQ ID NO: 144495 - DNA, 2367 bp, Artificial Sequence
  Description of Artificial Sequence: Synthetic coding sequence
atgggagagctgttccgctctgaggagatgaccctggcccagctgttcctgcagagcgaggccgcctactgctgcgtgtctgagctgggggagctgggcaaggtgcagttccgggacctgaacccagatgtgaatgtgttccagaggaagtttgtgaatgaggtgcggcgctgtgaggagatggacaggaagctgcgctttgtggagaaggagatcaggaaggccaacatccccatcatggacaccggggagaaccctgaggtgcccttcccccgggacatgattgacctggagatggctgaccctgacctgctggaggagagcagcagcctgctggagcccagcgagatgggccggggcacccccctgcggctgggctttgtggccggggtcatcaaccgggagcgcatccccacctttgagaggatgctgtggagggtgtgcagaggaaatgtgttcctgcggcaggccgagattgagaaccccctggaggaccctgtgactggagactatgtgcacaagtctgtgttcatcatcttcttccagggcgaccagctgaagaacagagtgaagaagatctgtgagggcttccgggccagcctgtacccctgcccagagaccccccaggagaggaaggagatggccagcggcgtgaacaccagaattgatgacctgcagatggtgctgaaccagacagaggaccaccggcagagggtgctgcaggccgccgccaagaacatccgggtgtggttcatcaaggtgaggaagatgaaggccatctaccacaccctgaacctgtgcaacattgatgtgacccagaagtgcctgattgctgaggtgtggtgccctgtgacagacctggacagcatccagtttgccctgcggcggggcacagagcacagcggcagcacagtgcccagcatcctgaacaggatgcagaccaaccagaccccacccacctacaacaagaccaacaagttcacctacggcttccagaacatcgtggatgcctacggcatcggcacctaccgggagatcaacccagccccctacaccatcatcaccttccccttcctgtttgctgtgatgtttggagactttggacatggcatcctgatgaccctgtttgctgtgtggatggtgctgcgggagagccgcatcctgagccagaagaatgaaaatgagatgttcagcacagtgttcagcggccgctacatcatcctgctgatgggcgtcttctccatgtacacaggcctcatctacaatgactgcttcagcaagagcctgaacatcttcggcagctcctggagcgtgcggcccatgttcacctacaactggacagaggagaccctgcggggcaaccctgtgctgcagctgaacccagccctgcccggggtgtttggaggcccctacccctttggaattgaccccatctggaacatcgccaccaacaagctgaccttcctgaacagcttcaagatgaagatgtctgtcatcctgggcatcatccacatgctgtttggagtgtccctgagcctcttcaaccacatctacttcaagaagcccctgaacatctacttcggcttcatccctgagatcatcttcatgaccagcctgtttggctacctggtgatcctgatcttctacaagtggacagcctatgatgcccacaccagtgaaaatgcccccagcctgctgatccacttcatcaacatgttcctgttctcctacccagagagcggctacagcatgctgtacagcggccagaagggcatccagtgcttcctggtggtggtggccctgctgtgtgtgccctggatgctgctcttcaagcccctggtgctgcggcggcagtacctgcggaggaagcacctgggcaccctgaactttggaggcatccgggtgggcaatggccccacagaggaggatgctgagatcatccagcacgaccagctgagcacccacagtgaagatgctgatgaatttgattttggagacaccatggtgcaccaggccatccacaccatcgagtactgcctgggctgcatcagcaacacagccagctacctgcggctgtgggccctgagcctggcccacgcccagctgtctgaggtgctgtggaccatggtgatccacatcggcctgtctgtgaagagcctggccggcggcctggtgctcttcttcttcttcaccgcctttgccaccctgactgtggccatcctgctgatcatggagggcctgagcgccttcctgcacgccctgcggctgcactgggtggagttccagaacaagttctacagcggcaccggcttcaagttcctgcccttctcctttgagcacatccgggagggcaagtttgaggagtag

SEQ ID NO: 144496 - DNA, 1452 bp, Artificial Sequence
  Description of Artificial Sequence: Synthetic coding sequence
atgcagaccaaccagaccccacccacctacaacaagaccaacaagttcacctacggcttccagaacatcgtggatgcctatggaattggcacctaccgggagatcaacccagccccctacaccatcatcaccttccccttcctgtttgctgtgatgtttggagactttggccacggcatcctgatgaccctgtttgctgtgtggatggtgctgcgggagagccgcatcctgagccagaagaatgaaaatgagatgttcagcaccgtcttcagcggccgctacatcatcctgctgatgggcgtcttctccatgtacacaggcctcatctacaatgactgcttcagcaagagcctgaacatcttcggcagctcctggagcgtgcggcccatgttcacctacaactggacagaggagaccctgcggggcaaccctgtgctgcagctgaacccagccctgcccggggtgtttggaggcccctaccccttcggcatcgaccccatctggaacatcgccaccaacaagctgaccttcctgaacagcttcaagatgaagatgtctgtcatcctgggcatcatccacatgctgtttggagtgtccctgagcctcttcaaccacatctacttcaagaagcccctgaacatctacttcggcttcatccctgagatcatcttcatgaccagcctgtttggctacctggtgatcctgatcttctacaagtggacagcctatgatgcccacaccagtgaaaatgcccccagcctgctgatccacttcatcaacatgttcctgttctcctacccagagagcggctacagcatgctgtacagcggccagaagggcatccagtgcttcctggtggtggtggccctgctgtgtgtgccctggatgctgctcttcaagcccctggtgctgcggcggcagtacctgcggaggaagcacctgggcaccctgaactttggaggcatccgggtgggcaatggccccacagaagaagatgctgagatcatccagcacgaccagctgagcacccacagtgaagatgctgatgagcccagtgaagatgaggtgtttgattttggagacaccatggtgcaccaggccatccacaccatcgagtactgcctgggctgcatcagcaacacagccagctacctgcggctgtgggccctgagcctggcccacgcccagctgtctgaggtgctgtggaccatggtgatccacatcggcctgtctgtgaagagcctggccggcggcctggtgctcttcttcttcttcaccgcctttgccaccctgactgtggccatcctgctgatcatggagggcctgagcgccttcctgcacgccctgcggctgcactgggtggagttccagaacaagttctacagcggcaccggcttcaagttcctgcccttctcctttgagcacatccgggagggcaagtttgaggagtag

SEQ ID NO: 144497 - DNA, 2514 bp, Artificial Sequence
  Description of Artificial Sequence: Synthetic coding sequence
atgggagagctgttccgctctgaggagatgaccctggcccagctgttcctgcagagcgaggccgcctactgctgcgtgtctgagctgggggagctgggcaaggtgcagttccgggacctgaacccagatgtgaatgtgttccagaggaagtttgtgaatgaggtgcggcgctgtgaggagatggacaggaagctgcgctttgtggagaaggagatcaggaaggccaacatccccatcatggacaccggggagaaccctgaggtgcccttcccccgggacatgattgacctggaggccaactttgagaagattgaaaatgagctgaaggagatcaacaccaaccaggaggccctgaagaggaacttcctggagctgacagagctgaagttcatcctgaggaagacccagcagttctttgatgagatggctgaccctgacctgctggaggagagcagcagcctgctggagcccagcgagatgggccggggcacccccctgcggctgggctttgtggccggggtcatcaaccgggagcgcatccccacctttgagaggatgctgtggagggtgtgcagaggaaatgtgttcctgcggcaggccgagattgagaaccccctggaggaccctgtgactggagactatgtgcacaagagcgtcttcatcatcttcttccagggcgaccagctgaagaacagagtgaagaagatctgtgagggcttccgggccagcctgtacccctgcccagagaccccccaggagaggaaggagatggccagcggcgtgaacaccagaattgatgacctgcagatggtgctgaaccagacagaggaccaccggcagagggtgctgcaggccgccgccaagaacatccgggtgtggttcatcaaggtgaggaagatgaaggccatctaccacaccctgaacctgtgcaacattgatgtgacccagaagtgcctgattgctgaggtgtggtgccctgtgacagacctggacagcatccagtttgccctgcggcggggcacagagcacagcggcagcacagtgcccagcatcctgaacaggatgcagaccaaccagaccccacccacctacaacaagaccaacaagttcacctacggcttccagaacatcgtggatgcctatggaattggcacctaccgggagatcaacccagccccctacaccatcatcaccttccccttcctgtttgctgtgatgtttggagactttggccacggcatcctgatgaccctgtttgctgtgtggatggtgctgcgggagagccgcatcctgagccagaagaatgaaaatgagatgttcagcaccgtcttcagcggccgctacatcatcctgctgatgggcgtcttctccatgtacacaggcctcatctacaatgactgcttcagcaagagcctgaacatcttcggcagctcctggagcgtgcggcccatgttcacctacaactggacagaggagaccctgcggggcaaccctgtgctgcagctgaacccagccctgcccggggtgtttggaggcccctaccccttcggcatcgaccccatctggaacatcgccaccaacaagctgaccttcctgaacagcttcaagatgaagatgtctgtcatcctgggcatcatccacatgctgtttggagtgtccctgagcctcttcaaccacatctacttcaagaagcccctgaacatctacttcggcttcatccctgagatcatcttcatgaccagcctgtttggctacctggtgatcctgatcttctacaagtggacagcctatgatgcccacaccagtgaaaatgcccccagcctgctgatccacttcatcaacatgttcctgttctcctacccagagagcggctacagcatgctgtacagcggccagaagggcatccagtgcttcctggtggtggtggccctgctgtgtgtgccctggatgctgctcttcaagcccctggtgctgcggcggcagtacctgcggaggaagcacctgggcaccctgaactttggaggcatccgggtgggcaatggccccacagaagaagatgctgagatcatccagcacgaccagctgagcacccacagtgaagatgctgatgagcccagcaccagcggccagtttgattttggagacaccatggtgcaccaggccatccacaccatcgagtactgcctgggctgcatcagcaacacagccagctacctgcggctgtgggccctgagcctggcccacgcccagctgtctgaggtgctgtggaccatggtgatccacatcggcctgtctgtgaagagcctggccggcggcctggtgctcttcttcttcttcaccgcctttgccaccctgactgtggccatcctgctgatcatggagggcctgagcgccttcctgcacgccctgcggctgcactgggtggagttccagaacaagttctacagcggcaccggcttcaagttcctgcccttctcctttgagcacatccgggagggcaagtttgaggagtag

SEQ ID NO: 144498 - DNA, 2571 bp, Artificial Sequence
  Description of Artificial Sequence: Synthetic coding sequence
atgggcagcctcttccgctctgagaccatgtgcctggcccagctgttcctgcagagcggcacagcctatgagtgcctgagcgccctgggggagaagggcctggtgcagttccgggacctgaaccagaatgtgagcagcttccagaggaagtttgtgggggaggtgaagagatgtgaggagctggagcgcatcctggtgtacctggtgcaggagatcaacagagctgacatccccctgcctgagggggaggccagccccccagccccacccctgaagcaggtgctggagatgcaggagcagctgcagaagctggaggtggagctgcgggaggtgaccaagaacaaggagaagctgaggaagaacctgctggagctgattgagtacacccacatgctgcgggtgaccaagacctttgtgaagagaaatgtggagtttgagcccacctatgaggagttccccagcctggagagtgacagcctgctggactacagctgcatgcagaggctgggcgccaagctgggctttgtgtctggcctcatcaaccagggcaaggtggaggcctttgagaagatgctgtggagggtgtgcaagggctacaccatcgtgtcctatgcagagctggatgagagcctggaggaccctgagaccggggaggtgatcaagtggtacgtgttcctgatctccttctggggcgagcagatcggccacaaggtgaagaagatctgtgactgctaccactgccacgtgtacccctaccccaacacagctgaggagcggcgggagatccaggagggcctgaacacccgcatccaggacctgtacacagtgctgcacaagacagaggactacctgcggcaggtgctgtgcaaggctgctgagagcgtgtacagcagggtcatccaggtgaagaagatgaaggccatctaccacatgctgaacatgtgcagctttgatgtgaccaacaagtgcctgattgctgaggtgtggtgcccagaggccgacctgcaggacctgcggcgggccctggaggagggcagccgggagagcggggccaccatccccagcttcatgaacatcatccccaccaaggagaccccacccacccgcatccgcaccaacaagttcacagagggcttccagaacatcgtggatgcctacggcgtgggcagctaccgggaggtgaacccagccctcttcaccatcatcaccttccccttcctgtttgctgtgatgtttggagactttggacatggctttgtgatgttcctgtttgccctgctgctggtgctgaatgaaaaccacccccggctgaaccagagccaggagatcatgaggatgttcttcaacggccgctacatcctgctgctgatgggcctcttctctgtgtacacaggcctcatctacaatgactgcttcagcaagtctgtgaacctgtttggaagtggctggaatgtgtctgccatgtacagcagcagccaccccccagctgagcacaagaagatggtgctgtggaatgattctgtggtgcgccacaacagcatcctgcagctggaccccagcatccctggggtcttccggggcccctaccccctgggcatcgaccccatctggaacctggccaccaaccggctgaccttcctgaacagcttcaagatgaagatgtctgtcatcctgggcatcatccacatgacctttggagtcatcctgggcatcttcaaccacctgcacttcaggaagaagttcaacatctacctggtgtccatccctgagctgctcttcatgctgtgcatcttcggctacctgatcttcatgatcttctacaagtggctggtgttttctgctgagaccagccgggtggcccccagcatcctgattgagttcatcaacatgttcctgtttcctgccagcaagaccagcggcctgtacacaggccaggagtatgtgcagagggtgctgctggtggtgacagccctgtctgtgcctgtgctcttcctgggcaagcccctcttcctgctgtggctgcacaacggccgcagctgctttggagtgaacagaagtggctacaccctcatcaggaaggacagcgaggaggaggtgtccctgctgggcagccaggacatcgaggagggcaaccaccaggtggaggatggctgccgggagatggcctgtgaggagttcaactttggagagatcctgatgacccaggtgatccacagcattgagtactgcctgggctgcatcagcaacacagccagctacctgcggctgtgggccctgagcctggcccacgcccagctgagtgatgtgctgtgggccatgctgatgagggtgggcctgcgggtggacaccacctatggagtgctgctgctgctgcccgtcatcgccctgtttgctgtgctgaccatcttcatcctgctgatcatggagggcctgagcgccttcctgcacgccatccggctgcactgggtggagttccagaacaagttctacgtgggcgccggcaccaagtttgtgcccttctccttcagcctgctgagcagcaagttcaacaatgatgacagcgtggcctag

SEQ ID NO: 144499 - DNA, 1119 bp, Artificial Sequence
  Description of Artificial Sequence: Synthetic coding sequence
atgggcagcctcttccgctctgagaccatgtgcctggcccagctgttcctgcagagcggcacagcctatgagtgcctgagcgccctgggggagaagggcctggtgcagttccgggacctgaaccagaatgtgagcagcttccagaggaagtttgtgggggaggtgaagagatgtgaggagctggagcgcatcctggtgtacctggtgcaggagatcaacagagctgacatccccctgcctgagggggaggccagccccccagccccacccctgaagcaggtgctggagatgcaggagcagctgcagaagctggaggtggagctgcgggaggtgaccaagaacaaggagaagctgaggaagaacctgctggagctgattgagtacacccacatgctgcgggtgaccaagacctttgtgaagagaaatgtggagtttgagcccacctatgaggagttccccagcctggagagtgacagcctgctggactacagctgcatgcagaggctgggcgccaagctgggctttgtgtctggcctcatcaaccagggcaaggtggaggcctttgagaagatgctgtggagggtgtgcaagggctacaccatcgtgtcctatgcagagctggatgagagcctggaggaccctgagaccggggaggtgatcaagtggtacgtgttcctgatctccttctggggcgagcagatcggccacaaggtgaagaagatctgtgactgctaccactgccacgtgtacccctaccccaacacagctgaggagcggcgggagatccaggagggcctgaacacccgcatccaggacctgtacacagtgctgcacaagacagaggactacctgcggcaggtgctgtgcaaggctgctgagagcgtgtacagcagggtcatccaggtgaagaagatgaaggccatctaccacatgctgaacatgtgcagctttgatgtgaccaacaagtgcctgattgctgaggtgtggtgcccagaggccgacctgcaggacctgcggcgggccctggaggagggctctgtgcggctgcccagcagccccctgcctggaacagaggagcggctgatggagctgatcaacagcgagaagaagaggaagtag

SEQ ID NO: 144500 - DNA, 2523 bp, Artificial Sequence
  Description of Artificial Sequence: Synthetic coding sequence
atggtgtctgtgttccgctctgaggagatgtgcctgagccagctgttcctgcaggtggaggccgcctactgctgcgtggccgagctgggggagctgggcctggtgcagttcaaggacctgaacatgaatgtgaacagcttccagaggaagtttgtgaatgaggtgcggcgctgtgagagcctggagcgcatcctgcgcttcctggaggatgagatgcagaatgagatcgtggtgcagctgctggagaagagccccctgacccccctgccccgggagatgatcaccctggagaccgtgctggagaagctggagggggagctgcaggaggccaaccagaaccagcaggccctgaagcagagcttcctggagctgacagagctgaagtacctgctgaagaagacccaggacttctttgaaacagagaccaacctggctgatgacttcttcacagaggacaccagcggcctgctggagctgaaggctgtgcctgcctacatgaccgggaagctgggcttcatcgccggggtcatcaaccgggagaggatggccagctttgagcggctgctgtggaggatctgcagaggaaatgtgtacctgaagttcagcgagatggatgcccccctggaggaccctgtgaccaaggaggagatccagaagaacatcttcatcatcttctaccagggcgagcagctgcggcagaagatcaagaagatctgtgatggcttccgggccaccgtgtacccctgcccagagcctgctgtggagcggcgggagatgctggagagcgtgaatgtgcggctggaggacctgatcaccgtcatcacccagacagagagccaccggcagaggctgctgcaggaggccgccgccaactggcacagctggctgatcaaggtgcagaagatgaaggctgtgtaccacatcctgaacatgtgcaacattgatgtgacccagcagtgtgtgattgctgagatctggttccctgtggctgatgccacccgcatcaagagggccctggagcagggcatggagctgagcggcagctccatggcccccatcatgaccaccgtgcagagcaagacagccccacccaccttcaacagaaccaacaagttcaccgctggcttccagaacatcgtggatgcctatggagtgggcagctaccgggagatcaacccagccccctacaccatcatcaccttccccttcctgtttgctgtgatgtttggagactgtggccacggcaccgtgatgctgctggccgccctgtggatgatcctgaatgaaagaaggctgctgagccagaagacagacaatgagatctggaacaccttcttccacggccgctacctgatcctgctgatgggcatcttcagcatctacacaggcctcatctacaatgactgcttcagcaagagcctgaacatcttcggcagctcctggagcgtgcagcccatgttcagaaatggcacctggaacacccacgtgatggaggagagcctgtacctgcagctggaccctgccatccctggggtgtacttcggcaacccctaccccttcggcatcgaccccatctggaacctggccagcaacaagctgaccttcctgaacagctacaagatgaagatgtctgtcatcctgggcatcgtgcagatggtgtttggagtcatcctgagcctcttcaaccacatctacttccggaggaccctgaacatcatcctgcagttcatccctgagatgatcttcatcctgtgcctgtttggctacctggtgttcatgatcatcttcaagtggtgctgctttgatgtgcacgtgtcccagcacgcccccagcatcctgatccacttcatcaacatgttcctgttcaactacagcgacagcagcaatgcccccctgtacaagcaccagcaggaggtgcagagcttctttgtggtgatggccctgatctctgtgccctggatgctgctgatcaagcccttcatcctgcgggccagccacaggaagagccagctgcaggccagccgcatccaggaggatgccacagagaacatcgagggggacagcagcagccccagcagccgcagcggccagaggaccagcgctgacacccacggggccctggatgaccacggggaggagttcaactttggagatgtgtttgtgcaccaggccatccacaccatcgagtactgcctgggctgcatcagcaacacagccagctacctgcggctgtgggccctgagcctggcccacgcccagctgtctgaggtgctgtggaccatggtgatgaacagcggcctgcagacccggggctggggcggcatcgtgggcgtcttcatcatctttgctgtgtttgctgtgctgactgtggccatcctgctgatcatggagggcctgagcgccttcctgcacgccctgcggctgcactgggtggagttccagaacaagttctacgtgggagatggctacaagttcagccccttctccttcaagcacatcctggatggaacagctgaggagtag

SEQ ID NO: 144501 - DNA, 2523 bp, Artificial Sequence; identical to SEQ ID NO: 144500
  Description of Artificial Sequence: Synthetic coding sequence

SEQ ID NO: 144502 - DNA, 2523 bp, Artificial Sequence; identical to SEQ ID NO: 144500
  Description of Artificial Sequence: Synthetic coding sequence

SEQ ID NO: 144503 - DNA, 3108 bp, Artificial Sequence
  Description of Artificial Sequence: Synthetic coding sequence
atgggcaaggcagaaaattatgagctgtacagcgtggagctgggccctggccctggaggagacatggccgccaagatgagcaagaagaagaaggccggcggcggcggcggcaagaggaaggagaagctggagaacatgaagaaggagatggagatcaatgaccaccagctgtctgtggccgagctggagcagaagtaccagaccagcgccaccaagggcctgagcgccagcctggccgctgagctgctgctgagagatggccccaatgccctgcggcccccccggggcaccccagaatatgtgaagtttgcccggcagctggccggcggcctgcagtgcctgatgtgggtggccgccgccatctgcctgattgcctttgccatccaggccagcgagggggacctgaccacagatgacaacctgtacctggccatcgccctgattgctgtggtggtggtgacaggctgcttcggctactaccaggagttcaagagcaccaacatcatcgccagcttcaagaacctggtgccccagcaggccaccgtcatcagagatggagacaagttccagatcaatgctgaccagctggtggtgggggacctggtggagatgaagggcggggacagagtgcctgctgacatccgcatcctggccgcccagggctgcaaggtggacaacagcagcctgaccggggagagcgagccccagaccaggagcccagaatgtacccatgagagccccctggagaccagaaatattgccttcttcagcaccatgtgcctggagggcaccgtgcagggcctggtggtgaacacaggagacaggaccatcatcggcagaattgccagcctggccagcggcgtggagaatgagaagacccccatcgccattgaaattgagcactttgtggacatcatcgccggcctggccatcctgtttggagccaccttcttcatcgtggccatgtgcatcggctacaccttcctgcgggccatggtgttcttcatggccatcgtggtggcctacgtgcctgagggcctgctggccaccgtgacagtgtgcctgagcctgacagccaagaggctggccagcaagaactgtgtggtgaagaacctggaggccgtggagaccctgggcagcaccagcgtcatctgcagcgacaagacaggcaccctgacccagaacaggatgacagtgagccacctgtggtttgacaaccacatccacacagctgacaccacagaggaccagagcggccagacctttgaccagagcagcgagacctggagggccctgtgccgggtgctgaccctgtgcaacagagctgccttcaagagcggccaggatgctgtgcctgtgcccaagagaattgtgattggagatgccagcgagacagccctgctgaagttcagcgagctgaccctgggcaatgccatgggctacagagaccgcttccccaaggtgtgtgagatccccttcaacagcaccaacaagttccagctgagcatccacaccctggaggacccccgggaccccaggcacctgctggtgatgaagggggcccctgagcgggtgctggagcgctgcagcagcatcctgatcaagggccaggagctgcccctggatgagcagtggagggaggccttccagacagcctacctgagcctgggcggcctgggggagcgggtgctgggcttctgccagctgtacctgaatgagaaggactacccacctggctacgcctttgatgtggaggccatgaacttccccagcagcggcctgtgctttgctggcctggtgtccatgattgatcctccccgggccaccgtgcctgatgctgtgctgaagtgcaggacagctggcatccgggtcatcatggtgactggagaccaccccatcacagccaaggccatcgccgcctctgtgggcatcatcagcgagggcagcgagaccgtggaggacattgctgcccggctgcgggtgcctgtggaccaggtgaacaggaaggatgcccgggcctgcgtcatcaatggcatgcagctgaaggacatggaccccagcgagctggtggaggccctgcggacccaccctgagatggtgtttgcccggaccagcccccagcagaagctggtgattgtggagagctgccagaggctgggcgccatcgtggccgtgactggagatggagtgaatgacagccctgccctgaagaaggctgacattggagtggccatgggcattgctggcagtgatgctgccaagaatgctgctgacatgatcctgctggatgacaactttgccagcatcgtgactggagtggagcagggccgcctcatctttgacaacctgaagaagagcatcgcctacaccctgaccaagaacatccctgagctgaccccctacctgatctacatcaccgtgtctgtgcccctgcccctgggctgcatcaccatcctcttcatcgagctgtgcacagacatcttccccagcgtgtccctggcctatgagaaggccgagagtgacatcatgcacctgcggcccaggaaccccaagagggaccggctggtgaatgagcccctggccgcctacagctacttccagatcggggccatccagagctttgctggcttcacagactacttcaccgccatggcccaggagggctggttccccctgctgtgtgtgggcctgcgggcccagtgggaggaccaccacctgcaggacctgcaggacagctatggccaggagtggaccttcggccagaggctgtaccagcagtacacctgctacacagtgttcttcatcagcattgaggtgtgccagattgctgatgtgctgatcaggaagacccggcggctgagcgccttccagcagggcttcttcaggaacaagatcctggtgattgccatcgtgttccaggtgtgcatcggctgcttcctgtgctactgccccggcatgcccaacatcttcaacttcatgcccatccgcttccagtggtggctggtgcccctgccctacggcatcctgatctttgtgtatgatgagatcaggaagctgggcgtgcgctgctgccccggctcctggtgggaccaggagctgtactactag

SEQ ID NO: 144504 - DNA, 876 bp, Artificial Sequence
  Description of Artificial Sequence: Synthetic coding sequence
atggccgccctgcaggagaagaagacctgtggccagaggatggaggagttccagcgctactgctggaacccagacaccggccagatgctgggccgcaccctgagccgctgggtgtggatcagcctgtactacgtggccttctacgtggtgatgacaggcctgtttgccctgtgcctgtatgtgctgatgcagacagtggacccctacaccccagactaccaggaccagctgcggagccctggggtgaccctgcggccagatgtgtatggagagaagggcctggagatcgtgtacaacgtgtctgacaacagaacctgggccgacctgacccagaccctgcacgccttcctggccggctacagccctgctgcccaggaggacagcatcaactgcaccagcgagcagtacttcttccaggagagcttccgggcccccaaccacaccaagttcagctgcaagttcaccgctgacatgctgcagaactgcagcggcctggccgaccccaactttggatttgaggagggcaagccctgcttcatcatcaagatgaaccgcatcgtgaagttcctgcccagcaatggaagtgccccccgggtggactgtgccttcctggaccagccccgggagctgggccagcccctgcaggtgaagtactacccacccaacggcaccttcagcctgcactacttcccctactacggcaagaaggcccagccccactacagcaaccccctggtggccgccaagctgctgaacatccccagaaatgctgaggtggccatcgtgtgcaaggtgatggccgagcacgtgaccttcaacaacccccatgacccctatgagggcaaggtggagttcaagctgaagattgagaagtag

SEQ ID NO: 144505 - DNA, 1290 bp, Artificial Sequence
  Description of Artificial Sequence: Synthetic coding sequence
atgcagctgaggaaccctgagctgcacctgggctgtgccctggccctgcgcttcctggccctggtgtcctgggacatccctggggcccgggccctggacaatggcctggcccggacccccaccatgggctggctgcactgggagcgcttcatgtgcaacctggactgccaggaggagccagacagctgcatcagcgagaagctgttcatggagatggccgagctgatggtgtctgagggctggaaggatgctggctatgagtacctgtgcattgatgactgctggatggccccccagagggacagcgagggccgcctgcaggccgacccccagcgcttcccccacggcatccggcagctggccaactacgtgcacagcaagggcctgaagctgggcatctatgcagatgtgggcaacaagacctgtgccggcttccctggcagctttggctactatgacattgatgcccagacctttgctgactggggcgtggacctgctgaagtttgatggctgctactgtgacagcctggagaacctggctgatggctacaagcacatgagcctggccctgaacagaacaggccgcagcatcgtgtacagctgtgagtggcccctgtacatgtggcccttccagaagcccaactacacagagatccggcagtactgcaaccactggaggaactttgctgacattgatgacagctggaagagcatcaagagcatcctggactggaccagcttcaaccaggagagaattgtggatgtggccggccctgggggctggaatgaccctgacatgctggtgattggcaactttggcctgtcctggaaccagcaggtgacccagatggccctgtgggccatcatggccgcccccctcttcatgagcaatgacctgcggcacatcagcccccaggccaaggccctgctgcaggacaaggatgtgattgccatcaaccaggaccccctgggcaagcagggctaccagctgcggcagggcgacaactttgaggtgtgggagcggcccctgagcggcctggcctgggccgtggccatgatcaaccggcaggagattggaggccccaggagctacaccatcgctgtggccagcctgggcaagggcgtggcctgcaacccagcctgcttcatcacccagctgctgcctgtgaagaggaagctgggcttctatgagtggaccagccggctgcggagccacatcaaccccaccggcaccgtgctgctgcagctggagaacaccatgcagatgagcctgaaggacctgctgtag

SEQ ID NO: 144506 - DNA, 3120 bp, Artificial Sequence
  Description of Artificial Sequence: Synthetic coding sequence
atgcaccagaagaccccagagatctacagcgtggagctgagcggcaccaaggacatcgtgaagacagacaagggagatggcaaggagaagtaccggggcctgaagaacaactgcctggagctgaagaagaagaaccacaaggaggagttccagaaggagctgcacctggatgaccacaagctgagcaaccgggagctggaggagaagtatggaacagacatcatcatgggcctgagcagcaccagggctgctgagctgctggccagagatggccccaacagcctgaccccacccaagcagaccccagagatcgtgaagttcctgaagcagatggtgggcggcttcagcatcctgctgtgggtgggcgccttcctgtgctggatcgcctacggcatccagtacagcagtgacaagagcgccagcctgaacaacgtgtacctgggctgtgtgctgggcctggtggtgatcctgaccggcatctttgcctactaccaggaggccaagagcaccaacatcatgagcagcttcaacaagatgatcccccagcaggccctggtgatccgggacagcgagaagaagaccatccccagcgagcagctggtggtgggggacatcgtggaggtgaagggcggggaccagatcccagctgacatccgggtgctgagcagccagggctgccgggtggacaacagcagcctgaccggggagagcgagccccagcccaggagcagcgagttcacccatgagaaccccctggagaccaagaacatctgcttctacagcaccacctgcctggagggcaccgtgacaggcatggtgatcaacacaggagacaggaccatcatcggccacatcgccagcctggccagcggcgtgggcaatgagaagacccccatcgccattgaaattgagcactttgtgcacatcgtggccggcgtggccgtgtccatcggcatcctcttcttcatcatcgctgtgtccctgaagtaccaggtgctggacagcatcatcttcctgattggcatcatcgtggccaacgtgcctgagggcctgctggccaccgtgacagtgaccctgagcctgacagccaagaggatggccaagaagaactgcctggtgaagaacctggaggccgtggagaccctgggcagcaccagcatcatctgcagcgacaagacaggcaccctgacccagaacaggatgacagtggcccacctgtggtttgacaaccagatctttgtggccgacaccagcgaggaccacagcaaccaggtgtttgaccagagcagcaggacctgggccagcctgagcaagatcatcaccctgtgcaacagagctgagttcaagccaggccaggagaatgtgcccatcatgaagaaggctgtgattggagatgccagcgagacagccctgctgaagttcagcgaggtgatcctgggagatgtgatggagatcaggaagaggaacaggaaggtggccgagatccccttcaacagcaccaacaagttccagctgagcatccacgagatggatgacccccacggcaagcgcttcctgatggtgatgaagggggcccctgagcgcatcctggagaagtgcagcaccatcatgatcaatggagaggagcaccccctggacaagagcacagccaagaccttccacacagcctacatggagctgggcggcctgggggagcgggtgctgggcttctgccacctgtacctgcctgcagatgagttccctgagacctacagctttgatattgatgccatgaacttccccaccagcaacctgtgctttgtgggcctgctgtccatgattgatcctcccaggagcacagtgcctgatgctgtgaccaagtgccgctctgctggcatcaaggtgatcatggtgactggagaccaccccatcacagccaaggccatcgccaagtctgtgggcatcatcagcgccaacagcgagaccgtggaggacatcgcccaccggctgaacattgctgtggagcaggtgaacaagagagatgccaaggctgctgtggtgacaggcatggagctgaaggacatgagcagcgagcagctggatgagatcctggccaactaccaggagatcgtgtttgcccggaccagcccccagcagaagctgatcatcgtggagggctgccagaggcaggatgctgtggtggccgtgactggagatggagtgaatgacagccctgccctgaagaaggctgacattggaattgccatgggcattgctggcagtgatgctgccaagaatgctgctgacatggtgctgctggatgacaactttgccagcatcgtgactggagtggaggagggccgcctcatctttgacaacctgaagaagaccatcgcctacagcctgaccaagaacattgctgagctgtgccccttcctgatctacatcatcgtgggcctgcccctgcccatcggcaccatcaccatcctcttcatcgacctgggcacagacatcatccccagcatcgccctggcctatgagaaggccgagagtgacatcatgaacaggaagcccaggcacaagaacaaggaccggctggtgaaccagcccctggccgtgtacagctacctgcacatcggcctgatgcaggccctgggcgccttcctggtgtacttcaccgtgtatgcccaggagggcttcctgcccaggaccctcatcaacctgcgggtggagtgggagaaggactatgtgaatgacctgaaggacagctatggccaggagtggacccgctaccagcgggagtacctggagtggacaggctacacagccttctttgtgggcatcctggtgcagcagattgctgacctgatcatcaggaagaccaggaggaacagcatcttccagcagggcctcttcaggaacaaggtgatctgggtgggcatcaccagccagatcatcatcggcctcatcctgtcctatggcctgggctctgtgacagccctgtccttcaccatgctgcgggcccagtactggtttgtggccgtgccccacgccatcctgatctgggtgtatgatgaggtgaggaagctgttcatccggctgtacccaggctcctggtgggacaagaacatgtactactag

SEQ ID NO: 144507 - DNA, 3072 bp, Artificial Sequence
  Description of Artificial Sequence: Synthetic coding sequence
atgggcaaaggagtgggccgggacaagtatgagcctgctgctgtgtctgagcagggcgacaagaagggcaagaagggcaagaaggaccgggacatggatgagctgaagaaggaggtgtccatggatgaccacaagctgagcctggatgagctgcacaggaaatatggaacagacctgagccggggcctgaccagcgcccgggctgctgagatcctggccagagatggccccaatgccctgaccccaccacccaccaccccagagtggatcaagttctgccggcagctgtttggaggcttctccatgctgctgtggattggagccatcctgtgcttcctggcctacagcatccaggccgccacagaggaggagccccagaatgacaacctgtacctgggcgtggtgctgtctgctgtggtgatcatcaccggctgcttctcctactaccaggaggccaagagcagcaagatcatggagagcttcaagaacatggtgccccagcaggccctggtgatcagaaatggagagaagatgagcatcaatgctgaggaggtggtggtgggggacctggtggaggtgaagggcggggaccgcatcccagctgacctgcgcatcatcagcgccaacggctgcaaggtggacaacagcagcctgactggagagagcgagccccagaccaggagcccagacttcaccaatgaaaaccccctggagaccaggaacatcgccttcttcagcaccaactgtgtggagggcacagcccggggcatcgtggtgtacacaggagacagaacagtgatgggccgcatcgccaccctggccagcggcctggagggcggccagacccccatcgctgctgagattgagcacttcatccacatcatcaccggggtggccgtgttcctgggcgtgtccttcttcatcctgagcctcatcctggagtacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagagaaccagagcggcgtgtcctttgacaagaccagcgccacctggctggccctgagcagaattgctggcctgtgcaacagagctgtgttccaggccaaccaggagaacctgcccatcctgaagagagctgtggccggagatgccagcgagagcgccctgctgaagtgcatcgagctgtgctgcggctctgtgaaggagatgagggagagatatgccaagatcgtggagatccccttcaacagcaccaacaagtaccagctgagcatccacaagaaccccaacaccagcgagccccagcacctgctggtgatgaagggggcccctgagcgcatcctggaccgctgcagcagcatcctgctgcacggcaaggagcagcccctggatgaggagctgaaggatgccttccagaatgcctacctggagctgggcggcctgggggagcgggtgctgggcttctgccacctgttcctgcctgatgagcagtttcctgagggcttccagtttgacacagatgatgtgaacttccccatcgacaacctgtgctttgtgggcctcatctccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccctgtgtcccaggtgaaccccagagatgccaaggcctgtgtggtgcacggcagtgacctgaaggacatgaccagcgagcagctggatgacatcctgaagtaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcgtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgatcttcatcatcgccaacatccccctgcccctgggcaccgtgaccatcctgtgcatcgacctgggcacagacatggtgcctgccatcagcctggcctatgagcaggccgagagtgacatcatgaagaggcagcccaggaaccccaagacagacaagctggtgaatgaaagactcatctccatggcctacggccagatcggcatgatccaggccctgggcggcttcttcacctacttcgtcatcctggctgaaaatggcttcctgcccatccacctgctgggcctgcgggtggactgggatgaccgctggatcaatgatgtggaggacagctatggccagcagtggacctatgagcagaggaagatcgtggagttcacctgccacacagccttctttgtgtccatcgtggtggtgcagtgggccgacctggtgatctgcaagaccaggagaaattctgtgttccagcagggcatgaagaacaagatcctgatcttcggcctgtttgaggagacagccctggccgccttcctgagctactgccccggcatgggcgtggccctgaggatgtaccccctgaagcccacctggtggttctgtgccttcccctacagcctgctgatctttgtgtatgatgaggtgaggaagctgatcatcagaagaagacctgggggctgggtggagaaggagacctactactag

SEQ ID NO: 144508 - DNA, 2043 bp, Artificial Sequence
  Description of Artificial Sequence: Synthetic coding sequence
gggaaggaggtgggccgggacaagtatgagcctgctgctgtgtctgagcagggcgacaagaagggcaagaagggcaagaaggaccgggacatggatgagctgaagaaggaggtgtccatggatgaccacaagctgagcctggatgagctgcacaggaaatatggaacagacctgagccggggcctgaccagcgcccgggctgctgagatcctggccagagatggccccaatgccctgaccccaccacccaccaccccagagtggatcaagttctgccggcagctgtttggaggcttctccatgctgctgtggattggagccatcctgtgcttcctggcctacagcatccaggccgccacagaggaggagccccagaatgacaacctgtacctgggcgtggtgctgtctgctgtggtgatcatcaccggctgcttctcctactaccaggaggccaagagcagcaagatcatggagagcttcaagaacatggtgccccagcaggccctggtgatcagaaatggagagaagatgagcatcaatgctgaggaggtggtggtgggggacctggtggaggtgaagggcggggaccgcatcccagctgacctgcgcatcatcagcgccaacggctgcaaggtggacaacagcagcctgaccggggagagcgagccccagaccaggagcccagacttcaccaatgaaaaccccctggagaccagaaatattgccttcttcagcaccaactgtgtggagggcacagcccggggcatcgtggtgtacaccggggacagaacagtgatgggcagaattgccaccctggccagcggcctggagggcggccagacccccatcgctgctgagattgagcacttcatccacatcatcactggagtggccgtgttcctgggcgtgtccttcttcatcctgagcctcatcctggagtacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagagaaccagagcggcgtgtcctttgacaagaccagcgccacctggctggccctgagcagaattgctggcctgtgcaacagagctgtgttccaggccaaccaggagaacctgcccatcctgaagagagctgtggccggagatgccagcgagagcgccctgctgaagtgcatcgagctgtgctgcggctctgtgaaggagatgagggagagatatgccaagatcgtggagatccccttcaacagcaccaacaagtaccagctgagcatccacaagaaccccaacaccagcgagccccagcacctgctggtgatgaagggggcccctgagcgcatcctggaccgctgcagcagcatcctgctgcacggcaaggagcagcccctggatgaggagctgaaggatgccttccagaatgcctacctggagctgggcggcctgggggagcgggtgctgggcttctgccacctgttcctgcctgatgagcagtttcctgagggcttccagtttgacacagatgatgtgaacttccccatcgacaacctgtgctttgtgggcctcatctccatgattgatcctcccagggctgctgtgcctgatgctgtgggcaagtgccgctctgctggcatcaaggtgatcatggtgactggagaccaccccatcacagccaaggccatcgccaagggcgtgggcatcatcagcgagggcaatgagcccatgagccggggcaagtcctggagcagccctgccacccagcccagcagctctgtgtcctggtggtgcagcggccccacctggagctctgtgcggcctgggggcatccgcagcagcagccggggctag

SEQ ID NO: 144509 - DNA, 435 bp, Artificial Sequence
  Description of Artificial Sequence: Synthetic coding sequence
atggatgagctgaagaaggaggtgtccatggatgaccacaagctgagcctggatgagctgcacaggaaatatggaacagacctgagccggggcctgaccagcgcccgggctgctgagatcctggccagagatggccccaatgccctgaccccaccacccaccaccccagagtggatcaagttctgccggcagctgtttggaggcttctccatgctgctgtggattggagccatcctgtgcttcctggcctacagcatccaggccgccacagaggaggagccccagaatgacaacctgtacctgggcgtggtgctgtctgctgtggtgatcatcaccggctgcttctcctactaccaggaggccaagagcagcaagatcatggagagcttcaagaacatggtgccccagcaggccctggtgatcagaaatggatag

SEQ ID NO: 144510 - DNA, 2979 bp, Artificial Sequence
  Description of Artificial Sequence: Synthetic coding sequence
atggatgagctgaagaaggaggtgtccatggatgaccacaagctgagcctggatgagctgcacaggaaatatggaacagacctgagccggggcctgaccagcgcccgggctgctgagatcctggccagagatggccccaatgccctgaccccaccacccaccaccccagagtggatcaagttctgccggcagctgtttggaggcttctccatgctgctgtggattggagccatcctgtgcttcctggcctacagcatccaggccgccacagaggaggagccccagaatgacaacctgtacctgggcgtggtgctgtctgctgtggtgatcatcaccggctgcttctcctactaccaggaggccaagagcagcaagatcatggagagcttcaagaacatggtgccccagcaggccctggtgatcagaaatggagagaagatgagcatcaatgctgaggaggtggtggtgggggacctggtggaggtgaagggcggggaccgcatcccagctgacctgcgcatcatcagcgccaacggctgcaaggtggacaacagcagcctgaccggggagagcgagccccagaccaggagcccagacttcaccaatgaaaaccccctggagaccagaaatattgccttcttcagcaccaactgtgtggagggcacagcccggggcatcgtggtgtacaccggggacagaacagtgatgggcagaattgccaccctggccagcggcctggagggcggccagacccccatcgctgctgagattgagcacttcatccacatcatcactggagtggccgtgttcctgggcgtgtccttcttcatcctgagcctcatcctggagtacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagagaaccagagcggcgtgtcctttgacaagaccagcgccacctggctggccctgagcagaattgctggcctgtgcaacagagctgtgttccaggccaaccaggagaacctgcccatcctgaagagagctgtggccggagatgccagcgagagcgccctgctgaagtgcatcgagctgtgctgcggctctgtgaaggagatgagggagagatatgccaagatcgtggagatccccttcaacagcaccaacaagtaccagctgagcatccacaagaaccccaacaccagcgagccccagcacctgctggtgatgaagggggcccctgagcgcatcctggaccgctgcagcagcatcctgctgcacggcaaggagcagcccctggatgaggagctgaaggatgccttccagaatgcctacctggagctgggcggcctgggggagcgggtgctgggcttctgccacctgttcctgcctgatgagcagtttcctgagggcttccagtttgacacagatgatgtgaacttccccatcgacaacctgtgctttgtgggcctcatctccatgattgatcctcccagggctgctgtgcctgatgctgtgggcaagtgccgctctgctggcatcaaggtgatcatggtgactggagaccaccccatcacagccaaggccatcgccaagggcgtgggcatcatcagcgagggcaatgaaacagtggaggacattgctgcccggctgaacatccctgtgtcccaggtgaaccccagagatgccaaggcctgtgtggtgcacggcagtgacctgaaggacatgaccagcgagcagctggatgacatcctgaagtaccacacagaaattgtgtttgcccggaccagcccccagcagaagctgatcatcgtggagggctgccagaggcagggcgccatcgtggccgtgactggagatggagtgaatgacagccctgccctgaagaaggctgacattggagtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgatcttcatcatcgccaacatccccctgcccctgggcaccgtgaccatcctgtgcatcgacctgggcacagacatggtgcctgccatcagcctggcctatgagcaggccgagagtgacatcatgaagaggcagcccaggaaccccaagacagacaagctggtgaatgaaagactcatctccatggcctacggccagatcggcatgatccaggccctgggcggcttcttcacctactttgtgatcctggccgagaatggcttcctgcccatccacctgctgggcctgcgggtggactgggatgaccgctggatcaatgatgtggaggacagctatggccagcagtggacctatgagcagaggaagatcgtggagttcacctgccacacagccttctttgtgtccatcgtggtggtgcagtgggccgacctggtgatctgcaagaccaggaggaacagcgtcttccagcagggcatgaagaacaagatcctgatcttcggcctgtttgaggagacagccctggccgccttcctgagctactgccccggcatgggcgtggccctgaggatgtaccccctgaagcccacctggtggttctgtgccttcccctacagcctgctgatctttgtgtatgatgaggtgaggaagctgatcatcagaagaagacctgggggctgggtggagaaggagacctactactag

SEQ ID NO: 144511 - DNA, 321 bp, Artificial Sequence
  Description of Artificial Sequence: Synthetic coding sequence
atggatgagctgaagaaggaggtgtccatggatgaccacaagctgagcctggatgagctgcacaggaaatatggaacagacctgagccggggcctgaccagcgcccgggctgctgagatcctggccagagatggccccaatgccctgaccccaccacccaccaccccagagtggatcaagttctgccggcagctgtttggaggcttctccatgctgctgtggattggagccatcctgtgcttcctggcctacagcatccaggccgccacagaggaggagccccagaatgacaacctgtacctgggcgtggtgctgtcctag

SEQ ID NO: 144512 - DNA, 474 bp, Artificial Sequence
  Description of Artificial Sequence: Synthetic coding sequence
cggcagcccaggaaccccaagacagacaagctggtgaatgaaagactcatctccatggcctacggccagatcggcatgatccaggccctgggcggcttcttcacctactttgtgatcctggccgagaatggcttcctgcccatccacctgctgggcctgcgggtggactgggatgaccgctggatcaatgatgtggaggacagctatggccagcagtggacctatgagcagaggaagatcgtggagttcacctgccacacagccttctttgtgtccatcgtggtggtgcagtgggccgacctggtgatctgcaagaccaggaggaacagcgtcttccagcagggcatgaagaacaagatcctgatcttcggcctgtttgaggagacagccctggccgccttcctgagctactgccccggcatgggcgtggccctgaggatgtaccccctgaagaccctgacccagtacagctag

SEQ ID NO: 144513 - DNA, 480 bp, Artificial Sequence
  Description of Artificial Sequence: Synthetic coding sequence
atgaagaggcagcccaggaaccccaagacagacaagctggtgaatgaaagactcatctccatggcctacggccagatcggcatgatccaggccctgggcggcttcttcacctactttgtgatcctggccgagaatggcttcctgcccatccacctgctgggcctgcgggtggactgggatgaccgctggatcaatgatgtggaggacagctatggccagcagtggacctatgagcagaggaagatcgtggagttcacctgccacacagccttctttgtgtccatcgtggtggtgcagtgggccgacctggtgatctgcaagaccaggaggaacagcgtcttccagcagggcatgaagaacaagatcctgatcttcggcctgtttgaggagacagccctggccgccttcctgagctactgccccggcatgggcgtggccctgaggatgtaccccctgaagaccctgacccagtacagctag

SEQ ID NO: 144514 - DNA, 3072 bp, Artificial Sequence
  Description of Artificial Sequence: Synthetic coding sequence
atggccttcaaggtgggccgggacaagtatgagcctgctgctgtgtctgagcagggcgacaagaagggcaagaagggcaagaaggaccgggacatggatgagctgaagaaggaggtgtccatggatgaccacaagctgagcctggatgagctgcacaggaaatatggaacagacctgagccggggcctgaccagcgcccgggctgctgagatcctggccagagatggccccaatgccctgaccccaccacccaccaccccagagtggatcaagttctgccggcagctgtttggaggcttctccatgctgctgtggattggagccatcctgtgcttcctggcctacagcatccaggccgccacagaggaggagccccagaatgacaacctgtacctgggcgtggtgctgtctgctgtggtgatcatcaccggctgcttctcctactaccaggaggccaagagcagcaagatcatggagagcttcaagaacatggtgccccagcaggccctggtgatcagaaatggagagaagatgagcatcaatgctgaggaggtggtggtgggggacctggtggaggtgaagggcggggaccgcatcccagctgacctgcgcatcatcagcgccaacggctgcaaggtggacaacagcagcctgactggagagagcgagccccagaccaggagcccagacttcaccaatgaaaaccccctggagaccaggaacatcgccttcttcagcaccaactgtgtggagggcacagcccggggcatcgtggtgtacacaggagacagaacagtgatgggccgcatcgccaccctggccagcggcctggagggcggccagacccccatcgctgctgagattgagcacttcatccacatcatcaccggggtggccgtgttcctgggcgtgtccttcttcatcctgagcctcatcctggagtacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagagaaccagagcggcgtgtcctttgacaagaccagcgccacctggctggccctgagcagaattgctggcctgtgcaacagagctgtgttccaggccaaccaggagaacctgcccatcctgaagagagctgtggccggagatgccagcgagagcgccctgctgaagtgcatcgagctgtgctgcggctctgtgaaggagatgagggagagatatgccaagatcgtggagatccccttcaacagcaccaacaagtaccagctgagcatccacaagaaccccaacaccagcgagccccagcacctgctggtgatgaagggggcccctgagcgcatcctggaccgctgcagcagcatcctgctgcacggcaaggagcagcccctggatgaggagctgaaggatgccttccagaatgcctacctggagctgggcggcctgggggagcgggtgctgggcttctgccacctgttcctgcctgatgagcagtttcctgagggcttccagtttgacacagatgatgtgaacttccccatcgacaacctgtgctttgtgggcctcatctccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccctgtgtcccaggtgaaccccagagatgccaaggcctgtgtggtgcacggcagtgacctgaaggacatgaccagcgagcagctggatgacatcctgaagtaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcgtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgatcttcatcatcgccaacatccccctgcccctgggcaccgtgaccatcctgtgcatcgacctgggcacagacatggtgcctgccatcagcctggcctatgagcaggccgagagtgacatcatgaagaggcagcccaggaaccccaagacagacaagctggtgaatgaaagactcatctccatggcctacggccagatcggcatgatccaggccctgggcggcttcttcacctacttcgtcatcctggctgaaaatggcttcctgcccatccacctgctgggcctgcgggtggactgggatgaccgctggatcaatgatgtggaggacagctatggccagcagtggacctatgagcagaggaagatcgtggagttcacctgccacacagccttctttgtgtccatcgtggtggtgcagtgggccgacctggtgatctgcaagaccaggagaaattctgtgttccagcagggcatgaagaacaagatcctgatcttcggcctgtttgaggagacagccctggccgccttcctgagctactgccccggcatgggcgtggccctgaggatgtaccccctgaagcccacctggtggttctgtgccttcccctacagcctgctgatctttgtgtatgatgaggtgaggaagctgatcatcagaagaagacctgggggctgggtggagaaggagacctactactag

SEQ ID NO: 144515 - DNA, 3063 bp, Artificial Sequence
  Description of Artificial Sequence: Synthetic coding sequence
atgggcagaggagctggccgggagtacagccctgctgccaccacagcagaaaatggaggcggcaagaagaagcagaaggagaaggagctggatgagctgaagaaggaggtggccatggatgaccacaagctgagcctggatgagctgggcaggaagtaccaggtggacctgagcaagggcctgaccaaccagagggcccaggatgtgctggccagagatggccccaatgccctgaccccaccacccaccaccccagagtgggtgaagttctgccggcagctgtttggaggcttcagcatcctgctgtggattggagccatcctgtgcttcctggcctacggcatccaggccgccatggaggatgagcccagcaatgacaacctgtacctgggcgtggtgctggccgctgtggtgattgtgacaggctgcttctcctactaccaggaggccaagagcagcaagatcatggacagcttcaagaacatggtgccccagcaggccctggtgatccgggagggggagaagatgcagatcaatgctgaggaggtggtggtgggggacctggtggaggtgaagggcggggacagagtgcctgctgacctgcgcatcatcagcagccacggctgcaaggtggacaacagcagcctgactggagagagcgagccccagaccaggagccctgagttcacccatgagaaccccctggagaccaggaacatctgcttcttcagcaccaactgtgtggagggcacagcccggggcatcgtgattgccactggagacagaacagtgatgggccgcatcgccaccctggccagcggcctggaggtgggccgcacccccatcgccatggagattgagcacttcatccagctgatcaccggggtggccgtgttcctgggcgtgtccttctttgtgctgagcctcatcctgggctacagctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagaggaccagagcggggccacctttgacaagaggagccccacctggacagccctgagcagaattgctggcctgtgcaacagagctgtgttcaaggccggccaggagaacatctctgtgtccaagagggacacagctggagatgccagcgagagcgccctgctgaagtgcatcgagctgagctgtggctctgtgaggaagatgagggacaggaaccccaaggtggccgagatccccttcaacagcaccaacaagtaccagctgagcatccacgagcgggaggacagcccccagagccacgtgctggtgatgaagggggcccctgagcgcatcctggaccgctgcagcaccatcctggtgcagggcaaggagatccccctggacaaggagatgcaggatgccttccagaatgcctacatggagctgggcggcctgggggagcgggtgctgggcttctgccagctgaacctgcccagcggcaagttcccccggggcttcaagtttgacacagatgagctgaacttccccacagagaagctgtgctttgtgggcctgatgtccatgattgatcctcccagggctgctgtgcctgatgctgtgggcaagtgccgctctgctggcatcaaggtgatcatggtgactggagaccaccccatcacagccaaggccatcgccaagggcgtgggcatcatcagcgagggcaatgaaacagtggaggacattgctgcccggctgaacatccccatgagccaggtgaacccccgggaggccaaggcctgtgtggtgcacggcagtgacctgaaggacatgaccagcgagcagctggatgagatcctgaagaaccacacagaaattgtgtttgcccggaccagcccccagcagaagctgatcatcgtggagggctgccagaggcagggcgccatcgtggccgtgactggagatggagtgaatgacagccctgccctgaagaaggctgacattggaattgccatgggcatcagcggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatcgccaacatccccctgcccctgggcaccgtgaccatcctgtgcatcgacctgggcacagacatggtgcctgccatcagcctggcctatgaagctgctgagagtgacatcatgaagaggcagcccaggaacagccagacagacaagctggtgaatgaaagactcatctccatggcctacggccagatcggcatgatccaggccctgggcggcttcttcacctactttgtgatcctggccgagaatggcttcctgcccagccggctgctgggcatccggctggactgggatgacaggaccatgaatgacctggaggacagctatggccaggagtggacctatgagcagaggaaggtggtggagttcacctgccacacagccttctttgccagcatcgtggtggtgcagtgggccgacctgatcatctgcaagaccaggaggaacagcgtcttccagcagggcatgaagaacaagatcctgatcttcggcctgctggaggagacagccctggccgccttcctgagctactgccccggcatgggcgtggccctgaggatgtaccccctgaaggtgacctggtggttctgtgccttcccctacagcctgctgatcttcatctatgatgaggtgaggaagctgatcctgcggcgctacccaggcggctgggtggagaaggagacctactactag

SEQ ID NO: 144516 - DNA, 3030 bp, Artificial Sequence
  Description of Artificial Sequence: Synthetic coding sequence
atgggcagaggagctggccgggagtacagccctgctgccaccacagcagaaaatggaggcggcaagaagaagcagaaggagaaggagctggatgagctgaagaaggaggtggccatggatgaccacaagctgagcctggatgagctgggcaggaagtaccaggtggacctgagcaagggcctgaccaaccagagggcccaggatgtgctggccagagatggccccaatgccctgaccccaccacccaccaccccagagtgggtgaagttctgccggcagctgtttggaggcttcagcatcctgctgtggattggagccatcctgtgcttcctggcctacggcatccaggccgccatggaggatgagcccagcaatgacaacctgtacctgggcgtggtgctggccgctgtggtgattgtgacaggctgcttctcctactaccaggaggccaagagcagcaagatcatggacagcttcaagaacatggtgccccagcaggccctggtgatccgggagggggagaagatgcagatcaatgctgaggaggtggtggtgggggacctggtggaggtgaagggcggggacagagtgcctgctgacctgcgcatcatcagcagccacggctgcaaggtggacaacagcagcctgactggagagagcgagccccagaccaggagccctgagttcacccatgagaaccccctggagaccaggaacatctgcttcttcagcaccaactgtgtggagggcacagcccggggcatcgtgattgccactggagacagaacagtgatgggccgcatcgccaccctggccagcggcctggaggtgggccgcacccccatcgccatggagattgagcacttcatccagctgatcaccggggtggccgtgttcctgggcgtgtccttctttgtgctgagcctcatcctgggctacagctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagaggaccagagcggggccacctttgacaagaggagccccacctggacagccctgagcagaattgctggcctgtgcaacagagctgtgttcaaggccggccaggagaacatctctgtgtccaagagggacacagctggagatgccagcgagagcgccctgctgaagtgcatcgagctgagctgtggctctgtgaggaagatgagggacaggaaccccaaggtggccgagatccccttcaacagcaccaacaagtaccagctgagcatccacgagcgggaggacagcccccagagccacgtgctggtgatgaagggggcccctgagcgcatcctggaccgctgcagcaccatcctggtgcagggcaaggagatccccctggacaaggagatgcaggatgccttccagaatgcctacatggagctgggcggcctgggggagcgggtgctgggcttctgccagctgaacctgcccagcggcaagttcccccggggcttcaagtttgacacagatgagctgaacttccccacagagaagctgtgctttgtgggcctgatgtccatgattgatcctcccagggctgctgtgcctgatgctgtgggcaagtgccgctctgctggcatcaaggtgatcatggtgactggagaccaccccatcacagccaaggccatcgccaagggcgtgggcatcatcagcgagggcaatgaaacagtggaggacattgctgcccggctgaacatccccatgagccaggtgaacccccgggaggccaaggcctgtgtggtgcacggcagtgacctgaaggacatgaccagcgagcagctggatgagatcctgaagaaccacacagaaattgtgtttgcccggaccagcccccagcagaagctgatcatcgtggagggctgccagaggcagggcgccatcgtggccgtgactggagatggagtgaatgacagccctgccctgaagaaggctgacattggaattgccatgggcatcagcggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatcgccaacatccccctgcccctgggcaccgtgaccatcctgtgcatcgacctgggcacagacatggtgcctgccatcagcctggcctatgaagctgctgagagtgacatcatgaagaggcagcccaggaacagccagacagacaagctggtgaatgaaagactcatctccatggcctacggccagatcggcatgatccaggccctgggcggcttcttcacctactttgtgatcctggccgagaatggcttcctgcccagccggctgctgggcatccggctggactgggatgacaggaccatgaatgacctggaggacagctatggccaggagtggacctatgagcagaggaaggtggtggagttcacctgccacacagccttctttgccagcatcgtggtggtgcagtgggccgacctgatcatctgcaagaccaggaggaacagcgtcttccagcagggcatgaagaacaagatcctgatcttcggcctgctggaggagacagccctggccgccttcctgagctactgccccggcatgggcgtggccctgaggatgtaccccctgaacctgctgatcttcatctatgatgaggtgaggaagctgatcctgcggcgctacccaggcggctgggtggagaaggagacctactactag

SEQ ID NO: 144517 - DNA, 2172 bp, Artificial Sequence
  Description of Artificial Sequence: Synthetic coding sequence
atgctgagcagcgccctggccctgagcggggccctggtgaagaggctgaagccacccaacggccacttcatcctgacagacacccatgacctgaacaccagcaagattgagcacagcctcttcaccgtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagaggaccagagcggggccacctttgacaagaggagccccacctggacagccctgagcagaattgctggcctgtgcaacagagctgtgttcaaggccggccaggagaacatctctgtgtccaagagggacacagctggagatgccagcgagagcgccctgctgaagtgcatcgagctgagctgtggctctgtgaggaagatgagggacaggaaccccaaggtggccgagatccccttcaacagcaccaacaagtaccagctgagcatccacgagcgggaggacagcccccagagccacgtgctggtgatgaagggggcccctgagcgcatcctggaccgctgcagcaccatcctggtgcagggcaaggagatccccctggacaaggagatgcaggatgccttccagaatgcctacatggagctgggcggcctgggggagcgggtgctgggcttctgccagctgaacctgcccagcggcaagttcccccggggcttcaagtttgacacagatgagctgaacttccccacagagaagctgtgctttgtgggcctgatgtccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccccatgagccaggtgaacccccgggaggccaaggcctgtgtggtgcacggcagtgacctgaaggacatgaccagcgagcagctggatgagatcctgaagaaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcatcgccatgggcatcagcggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatcgccaacatccccctgcccctgggcaccgtgaccatcctgtgcatcgacctgggcacagacatggtgcctgccatcagcctggcctatgaggccgctgagagtgacatcatgaagaggcagcccaggaacagccagacagacaagctggtgaatgaaagactcatctccatggcctacggccagatcggcatgatccaggccctgggcggcttcttcacctacttcgtcatcctggctgaaaatggcttcctgcccagccggctgctgggcatccggctggactgggatgacaggaccatgaatgacctggaggacagctatggccaggagtggacctatgagcagaggaaggtggtggagttcacctgccacacagccttctttgccagcatcgtggtggtgcagtgggccgacctgatcatctgcaagaccaggagaaattctgtgttccagcagggcatgaagaacaagatcctgatcttcggcctgctggaggagacagccctggccgccttcctgagctactgccccggcatgggcgtggccctgaggatgtaccccctgaaggtgacctggtggttctgtgccttcccctacagcctgctgatcttcatctatgatgaggtgaggaagctgatcctgcggcgctacccaggcggctgggtggagaaggagacctactactag

SEQ ID NO: 144518 - DNA, 2145 bp, Artificial Sequence
  Description of Artificial Sequence: Synthetic coding sequence
tgacagctgatcactggagtggccgtgttcctgggcgtgtccttctttgtgctgagcctcatcctgggctacagctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagaggaccagagcggggccacctttgacaagaggagccccacctggacagccctgagcagaattgctggcctgtgcaacagagctgtgttcaaggccggccaggagaacatctctgtgtccaagagggacacagctggagatgccagcgagagcgccctgctgaagtgcatcgagctgagctgtggctctgtgaggaagatgagggacaggaaccccaaggtggccgagatccccttcaacagcaccaacaagtaccagctgagcatccacgagcgggaggacagcccccagagccacgtgctggtgatgaagggggcccctgagcgcatcctggaccgctgcagcaccatcctggtgcagggcaaggagatccccctggacaaggagatgcaggatgccttccagaatgcctacatggagctgggcggcctgggggagcgggtgctgggcttctgccagctgaacctgcccagcggcaagttcccccggggcttcaagtttgacacagatgagctgaacttccccacagagaagctgtgctttgtgggcctgatgtccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccccatgagccaggtgaacccccgggaggccaaggcctgtgtggtgcacggcagtgacctgaaggacatgaccagcgagcagctggatgagatcctgaagaaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcatcgccatgggcatcagcggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatcgccaacatccccctgcccctgggcaccgtgaccatcctgtgcatcgacctgggcacagacatggtgcctgccatcagcctggcctatgaggccgctgagagtgacatcatgaagaggcagcccaggaacagccagacagacaagctggtgaatgaaagactcatctccatggcctacggccagattgaaaatggcttcctgcccagccggctgctgggcatccggctggactgggatgacaggaccatgaatgacctggaggacagctatggccaggagtggacctatgagcagaggaaggtggtggagttcacctgccacacagccttctttgccagcatcgtggtggtgcagtgggccgacctgatcatctgcaagaccaggaggaacagcgtcttccagcagggcatgaagaacaagatcctgatcttcggcctgctggaggagacagccctggccgccttcctgagctactgccccggcatgggcgtggccctgaggatgtaccccctgaaggtgacctggtggttctgtgccttcccctacagcctgctgatcttcatctatgatgaggtgaggaagctgatcctgcggcgctacccaggcggctgggtggagaaggagacctactactag

SEQ ID NO: 144519 - DNA, 819 bp, Artificial Sequence
  Description of Artificial Sequence: Synthetic coding sequence
atggacagcttcaagaacatggtgccccagcaggccctggtgatccgggagggggagaagatgcagatcaatgctgaggaggtggtggtgggggacctggtggaggtgaagggcggggacagagtgcctgctgacctgcgcatcatcagcagccacggctgcaaggtggacaacagcagcctgaccggggagagcgagccccagaccaggagccctgagttcacccatgagaaccccctggagaccaggaacatctgcttcttcagcaccaactgtgtggagggcacagcccggggcatcgtcatcgccaccggggacagaacagtgatgggcagaattgccaccctggccagcggcctggaggtgggccgcacccccatcgccatggagattgagcacttcatccagctgatcactggagtggccgtgttcctgggcgtgtccttctttgtgctgagcctcatcctgggctacagctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagaggaccagagcggggactgggtgctgcagaggggctggattggcctggaggaggccgagggcagcggcgtggtgggctag

SEQ ID NO: 144520 - DNA, 3042 bp, Artificial Sequence
  Description of Artificial Sequence: Synthetic coding sequence
atgggagacaagaaggatgacaaggacagccccaagaagaacaagggcaaggagcggcgggacctggatgacctgaagaaggaggtggccatgacagagcacaagatgtctgtggaggaggtgtgcaggaagtacaacacagactgtgtgcagggcctgacccacagcaaggcccaggagatcctggccagagatggccccaatgccctgaccccaccacccaccaccccagagtgggtgaagttctgccggcagctgtttggaggcttcagcatcctgctgtggattggagccatcctgtgcttcctggcctacggcatccaggccggcacagaagatgaccccagcggggacaacctgtacctgggcatcgtgctggccgctgtggtgatcatcaccggctgcttctcctactaccaggaggccaagagcagcaagatcatggagagcttcaagaacatggtgccccagcaggccctggtgatccgggagggggagaagatgcaggtgaatgctgaggaggtggtggtgggggacctggtggagatcaagggcggggacagagtgcctgctgacctgcgcatcatcagcgcccacggctgcaaggtggacaacagcagcctgactggagagagcgagccccagaccaggagcccagactgcacccatgacaaccccctggagaccaggaacatcaccttcttcagcaccaactgtgtggagggcacagcccggggcgtggtggtggccactggagacagaacagtgatgggccgcatcgccaccctggccagcggcctggaggtgggcaagacccccatcgccatcgagattgagcacttcatccagctgatcaccggggtggccgtgttcctgggcgtgtccttcttcatcctgagcctcatcctgggctacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagaggaccagagcggcaccagctttgacaagagcagccacacctgggtggccctgagccacatcgccggcctgtgcaacagagctgtgttcaagggcggccaggacaacatccctgtgctgaagagagatgtggccggagatgccagcgagagcgccctgctgaagtgcatcgagctgagcagcggctctgtgaagctgatgagggagaggaacaagaaggtggccgagatccccttcaacagcaccaacaagtaccagctgagcatccatgaaacagaggaccccaatgacaaccgctacctgctggtgatgaagggggcccctgagcgcatcctggaccgctgcagcaccatcctgctgcagggcaaggagcagcccctggatgaggagatgaaggaggccttccagaatgcctacctggagctgggcggcctgggggagcgggtgctgggcttctgccactactacctgcctgaggagcagttccccaagggctttgcctttgactgtgatgatgtgaacttcaccacagacaacctgtgctttgtgggcctgatgtccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccctgtgtcccaggtgaaccccagagatgccaaggcctgtgtgatccacggcacagacctgaaggacttcaccagcgagcagattgatgagatcctgcagaaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcgtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatggccaacatccccctgcccctgggcaccatcaccatcctgtgcatcgacctgggcacagacatggtgcctgccatcagcctggcctatgaggccgctgagagtgacatcatgaagaggcagcccaggaaccccaggacagacaagctggtgaatgaaagactcatctccatggcctacggccagatcggcatgatccaggccctgggcggcttcttctcctacttcgtcatcctggctgaaaatggcttcctgcccggcaacctggtgggcatccggctgaactgggatgacagaacagtgaatgacctggaggacagctatggccagcagtggacctatgagcagaggaaggtggtggagttcacctgccacacagccttctttgtgtccatcgtggtggtgcagtgggccgacctgatcatctgcaagaccaggagaaattctgtgttccagcagggcatgaagaacaagatcctgatcttcggcctgtttgaggagacagccctggccgccttcctgagctactgccccggcatggatgtggccctgaggatgtaccccctgaagcccagctggtggttctgtgccttcccctacagcttcctgatctttgtgtatgatgagatcaggaagctgatcctgcggagaaatcctgggggctgggtggagaaggagacctactactag

SEQ ID NO: 144521 - DNA, 2952 bp, Artificial Sequence
  Description of Artificial Sequence: Synthetic coding sequence
atgacagagcacaagatgtctgtggaggaggtgtgcaggaagtacaacacagactgtgtgcagggcctgacccacagcaaggcccaggagatcctggccagagatggccccaatgccctgaccccaccacccaccaccccagagtgggtgaagttctgccggcagctgtttggaggcttcagcatcctgctgtggattggagccatcctgtgcttcctggcctacggcatccaggccggcacagaagatgaccccagcggggacaacctgtacctgggcatcgtgctggccgctgtggtgatcatcaccggctgcttctcctactaccaggaggccaagagcagcaagatcatggagagcttcaagaacatggtgccccagcaggccctggtgatccgggagggggagaagatgcaggtgaatgctgaggaggtggtggtgggggacctggtggagatcaagggcggggacagagtgcctgctgacctgcgcatcatcagcgcccacggctgcaaggtggacaacagcagcctgactggagagagcgagccccagaccaggagcccagactgcacccatgacaaccccctggagaccaggaacatcaccttcttcagcaccaactgtgtggagggcacagcccggggcgtggtggtggccactggagacagaacagtgatgggccgcatcgccaccctggccagcggcctggaggtgggcaagacccccatcgccatcgagattgagcacttcatccagctgatcaccggggtggccgtgttcctgggcgtgtccttcttcatcctgagcctcatcctgggctacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagaggaccagagcggcaccagctttgacaagagcagccacacctgggtggccctgagccacatcgccggcctgtgcaacagagctgtgttcaagggcggccaggacaacatccctgtgctgaagagagatgtggccggagatgccagcgagagcgccctgctgaagtgcatcgagctgagcagcggctctgtgaagctgatgagggagaggaacaagaaggtggccgagatccccttcaacagcaccaacaagtaccagctgagcatccatgaaacagaggaccccaatgacaaccgctacctgctggtgatgaagggggcccctgagcgcatcctggaccgctgcagcaccatcctgctgcagggcaaggagcagcccctggatgaggagatgaaggaggccttccagaatgcctacctggagctgggcggcctgggggagcgggtgctgggcttctgccactactacctgcctgaggagcagttccccaagggctttgcctttgactgtgatgatgtgaacttcaccacagacaacctgtgctttgtgggcctgatgtccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccctgtgtcccaggtgaaccccagagatgccaaggcctgtgtgatccacggcacagacctgaaggacttcaccagcgagcagattgatgagatcctgcagaaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcgtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatggccaacatccccctgcccctgggcaccatcaccatcctgtgcatcgacctgggcacagacatggtgcctgccatcagcctggcctatgaggccgctgagagtgacatcatgaagaggcagcccaggaaccccaggacagacaagctggtgaatgaaagactcatctccatggcctacggccagatcggcatgatccaggccctgggcggcttcttctcctacttcgtcatcctggctgaaaatggcttcctgcccggcaacctggtgggcatccggctgaactgggatgacagaacagtgaatgacctggaggacagctatggccagcagtggacctatgagcagaggaaggtggtggagttcacctgccacacagccttctttgtgtccatcgtggtggtgcagtgggccgacctgatcatctgcaagaccaggagaaattctgtgttccagcagggcatgaagaacaagatcctgatcttcggcctgtttgaggagacagccctggccgccttcctgagctactgccccggcatggatgtggccctgaggatgtaccccctgaagcccagctggtggttctgtgccttcccctacagcttcctgatctttgtgtatgatgagatcaggaagctgatcctgcggagaaatcctgggggctgggtggagaaggagacctactactag

SEQ ID NO: 144522 - DNA, 3681 bp, Artificial Sequence
  Description of Artificial Sequence: Synthetic coding sequence
atgggagacaagaaggatgacaaggacagccccaagaagaacaagggcaaggagcggcgggacctggatgacctgaagaaggaggtggccatgacagagcacaagatgtctgtggaggaggtgtgcaggaagtacaacacagactgtgtgcagggcctgacccacagcaaggcccaggagatcctggccagagatggccccaatgccctgaccccaccacccaccaccccagagtgggtgaagttctgccggcagctgtttggaggcttcagcatcctgctgtggattggagccatcctgtgcttcctggcctacggcatccaggccggcacagaagatgaccccagcggggacaacctgtacctgggcatcgtgctggccgctgtggtgatcatcaccggctgcttctcctactaccaggaggccaagagcagcaagatcatggagagcttcaagaacatggtgccccagcaggccctggtgatccgggagggggagaagatgcaggtgaatgctgaggaggtggtggtgggggacctggtggagatcaagggcggggacagagtgcctgctgacctgcgcatcatcagcgcccacggctgcaaggtggacaacagcagcctgactggagagagcgagccccagaccaggagcccagactgcacccatgacaaccccctggagaccaggaacatcaccttcttcagcaccaactgtgtggagggcacagcccggggcgtggtggtggccactggagacagaacagtgatgggccgcatcgccaccctggccagcggcctggaggtgggcaagacccccatcgccatcgagattgagcacttcatccagctgatcaccggggtggccgtgttcctgggcgtgtccttcttcatcctgagcctcatcctgggctacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagaggaccagagcggcaccagctttgacaagagcagccacacctgggtggccctgagccacatcgccggcctgtgcaacagagctgtgttcaagggcggccaggacaacatccctgtgctgaagagagatgtggccggagatgccagcgagagcgccctgctgaagtgcatcgagctgagcagcggctctgtgaagctgatgagggagaggaacaagaaggtggccgagatccccttcaacagcaccaacaagtaccagctgagcatccatgaaacagaggaccccaatgacaaccgctacctgctggtgatgaagggggcccctgagcgcatcctggaccgctgcagcaccatcctgctgcagggcaaggagcagcccctggatgaggagatgaaggaggccttccagaatgcctacctggagctgggcggcctgggggagcgggtgctgggcttctgccactactacctgcctgaggagcagttccccaagggctttgcctttgactgtgatgatgtgaacttcaccacagacaacctgtgctttgtgggcctgatgtccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccctgtgtcccaggtgaaccccagagatgccaaggcctgtgtgatccacggcacagacctgaaggacttcaccagcgagcagattgatgagatcctgcagaaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcgtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatggccaacatccccctgcccctgggcaccatcaccatcctgtgcatcgacctgggcacagacatggtgcctgccatcagcctggcctatgaggccgctgagagtgacatcatgaagaggcagcccaggaaccccaggacagacaagctggtgaatgaaagactcatctccatggcctacggccagatcggcatgatccaggccctgggcggcttcttctcctacttcgtcatcctggctgaaaatggcttcctgcccggcaacctggtgggcatccggctgaactgggatgacagaacagtgaatgacctggaggacagctatggccagcagtggacctatgagcagaggaaggtggtggagttcacctgccacacagccttctttgtgtccatcgtggtggtgcagtgggccgacctgatcatctgcaagaccaggagaaattctgtgttccagcagggcatgaagaacaagatcctgatcttcggcctgtttgaggagacagccctggccgccttcctgagctactgccccggcatggatgtggccctgaggatgtaccccctgaagcccagctggtggttctgtgccttcccctacagcttcctgatctttgtgtatgatgagatcaggaagctgatcctgcggagaaatcctggaggagagggcgcccggcagggcagccggggcggccgcggggctgctggcagccaggccgccggcccccggctgcccagcccctgctggatggccctgcccccaggcagccacagcagcctgagcagccacctgagcggccaccccctgtgcctgctgaccggcctgtgcctgtgtggcttcctggtgtccctgcccctgtgccccagcctgtgctgggccgcccggctggcctgcctgagccccagcctgaccctgagcctgtccttcctgctgtgcctgagccggctgggcggggagggcaacctgctgctgaccagcgccccaccccaccggcccagcctgcccaggcctcctggccctggcccccccctgtctgtgccccccatcctgtacagcggcggccgcagccccctcttcctgtggccccacctgggcccccaccccctgcactacctgctgcccccacccctgtggctggccagcctgccctgccccaagcccctgagcagcctcttctctgtgtctgtgtccctgcccctgctgacccccctgagcatccccccagccccagccaccagcctgggcagcttcctgctgcccttcagccccccagcagatgccatcagcggcagcggccagctgagcaacatctctgtgggccgggagtag

SEQ ID NO: 144523 - DNA, 444 bp, Artificial Sequence
  Description of Artificial Sequence: Synthetic coding sequence
atgggcagcggcggcagtgacagctacagaattgccaccagccaggacaagaaggatgacaaggacagccccaagaagaacaagggcaaggagcggcgggacctggatgacctgaagaaggaggtggccatgacagagcacaagatgtctgtggaggaggtgtgcaggaagtacaacacagactgtgtgcagggcctgacccacagcaaggcccaggagatcctggccagagatggccccaatgccctgaccccaccacccaccaccccagagtgggtgaagttctgccggcagctgtttggaggcttcagcatcctgctgtggattggagccatcctgtgcttcctggcctacggcatccaggccggcacagaagatgaccccagcggggacaacctgtacctgggcatcgtgctggccgctgtggtgatcatcaccggctag

SEQ ID NO: 144524 - DNA, 2049 bp, Artificial Sequence
  Description of Artificial Sequence: Synthetic coding sequence
atgggccgcatcgccaccctggccagcggcctggaggtgggcaagacccccatcgccatcgagattgagcacttcatccagctgatcaccggggtggccgtgttcctgggcgtgtccttcttcatcctgagcctcatcctgggctacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccacgaggccgacaccacagaggaccagagcggcaccagctttgacaagagcagccacacctgggtggccctgagccacatcgccggcctgtgcaacagagctgtgttcaagggcggccaggacaacatccctgtgctgaagagagatgtggccggagatgccagcgagagcgccctgctgaagtgcatcgagctgagcagcggctctgtgaagctgatgagggagaggaacaagaaggtggccgagatccccttcaacagcaccaacaagtaccagctgagcatccatgaaacagaggaccccaatgacaaccgctacctgctggtgatgaagggggcccctgagcgcatcctggaccgctgcagcaccatcctgctgcagggcaaggagcagcccctggatgaggagatgaaggaggccttccagaatgcctacctggagctgggcggcctgggggagcgggtgctgggcttctgccactactacctgcctgaggagcagttccccaagggctttgcctttgactgtgatgatgtgaacttcaccacagacaacctgtgctttgtgggcctgatgtccatgattgacccccccagggctgctgtgcctgatgctgtgggcaaatgtagatctgctggcatcaaggtgatcatggtgactggagaccaccccatcacagccaaggccatcgccaagggcgtgggcatcatcagcgagggcaatgagaccgtggaggacattgctgcccggctgaacatccctgtgtcccaggtgaaccccagagatgccaaggcctgtgtgatccacggcacagacctgaaggacttcaccagcgagcagattgatgagatcctgcagaaccacacagagatcgtgtttgcccggaccagcccccagcagaagctgatcatcgtggagggctgccagaggcagggcgccatcgtggccgtgactggagatggagtgaatgacagccctgccctgaagaaggctgacatcggcgtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatggccaacatccccctgcccctgggcaccatcaccatcctgtgcatcgacctgggcacagacatggtgcctgccatcagcctggcctatgaggccgctgagagtgacatcatgaagaggcagcccaggaaccccaggacagacaagctggtgaatgaaagactcatctccatggcctacggccagatcggcatgatccaggccctgggcggcttcttctcctacttcgtcatcctggctgaaaatggcttcctgcccggcaacctggtgggcatccggctgaactgggatgacagaacagtgaatgacctggaggacagctatggccagcagtggacctatgagcagaggaaggtggtggagttcacctgccacacagccttctttgtgtccatcgtggtggtgcagtgggccgacctgatcatctgcaagaccaggaggaccaggagcagcagccgggcctag

SEQ ID NO: 144525 - DNA, 3075 bp, Artificial Sequence
  Description of Artificial Sequence: Synthetic coding sequence
atgggcggctgggaggaggagaggaacagaagagccacagacaagaaggatgacaaggacagccccaagaagaacaagggcaaggagcggcgggacctggatgacctgaagaaggaggtggccatgacagagcacaagatgtctgtggaggaggtgtgcaggaagtacaacacagactgtgtgcagggcctgacccacagcaaggcccaggagatcctggccagagatggccccaatgccctgaccccaccacccaccaccccagagtgggtgaagttctgccggcagctgtttggaggcttcagcatcctgctgtggattggagccatcctgtgcttcctggcctacggcatccaggccggcacagaagatgaccccagcggggacaacctgtacctgggcatcgtgctggccgctgtggtgatcatcaccggctgcttctcctactaccaggaggccaagagcagcaagatcatggagagcttcaagaacatggtgccccagcaggccctggtgatccgggagggggagaagatgcaggtgaatgctgaggaggtggtggtgggggacctggtggagatcaagggcggggacagagtgcctgctgacctgcgcatcatcagcgcccacggctgcaaggtggacaacagcagcctgaccggggagagcgagccccagaccaggagcccagactgcacccatgacaaccccctggagaccaggaacatcaccttcttcagcaccaactgtgtggagggcacagcccggggcgtggtggtggccaccggggacagaacagtgatgggcagaattgccaccctggccagcggcctggaggtgggcaagacccccatcgccattgaaattgagcacttcatccagctgatcactggagtggccgtgttcctgggcgtgtccttcttcatcctgagcctcatcctgggctacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagaggaccagagcggcaccagctttgacaagagcagccacacctgggtggccctgagccacatcgccggcctgtgcaacagagctgtgttcaagggcggccaggacaacatccctgtgctgaagagagatgtggccggagatgccagcgagagcgccctgctgaagtgcatcgagctgagcagcggctctgtgaagctgatgagggagaggaacaagaaggtggccgagatccccttcaacagcaccaacaagtaccagctgagcatccacgagacagaggaccccaatgacaaccgctacctgctggtgatgaagggggcccctgagcgcatcctggaccgctgcagcaccatcctgctgcagggcaaggagcagcccctggatgaggagatgaaggaggccttccagaatgcctacctggagctgggcggcctgggggagcgggtgctgggcttctgccactactacctgcctgaggagcagttccccaagggctttgcctttgactgtgatgatgtgaacttcaccacagacaacctgtgctttgtgggcctgatgtccatgattgatcctcccagggctgctgtgcctgatgctgtgggcaagtgccgctctgctggcatcaaggtgatcatggtgactggagaccaccccatcacagccaaggccatcgccaagggcgtgggcatcatcagcgagggcaatgaaacagtggaggacattgctgcccggctgaacatccctgtgtcccaggtgaaccccagagatgccaaggcctgcgtcatccatggaacagacctgaaggacttcaccagcgagcagattgatgagatcctgcagaaccacacagaaattgtgtttgcccggaccagcccccagcagaagctgatcatcgtggagggctgccagaggcagggcgccatcgtggccgtgactggagatggagtgaatgacagccctgccctgaagaaggctgacattggagtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatggccaacatccccctgcccctgggcaccatcaccatcctgtgcatcgacctgggcacagacatggtgcctgccatcagcctggcctatgaagctgctgagagtgacatcatgaagaggcagcccaggaaccccaggacagacaagctggtgaatgaaagactcatctccatggcctacggccagatcggcatgatccaggccctgggcggcttcttctcctactttgtgatcctggccgagaatggcttcctgcccggcaacctggtgggcatccggctgaactgggatgacagaacagtgaatgacctggaggacagctatggccagcagtggacctatgagcagaggaaggtggtggagttcacctgccacacagccttctttgtgtccatcgtggtggtgcagtgggccgacctgatcatctgcaagaccaggaggaacagcgtcttccagcagggcatgaagaacaagatcctgatcttcggcctgtttgaggagacagccctggccgccttcctgagctactgccccggcatggatgtggccctgaggatgtaccccctgaagcccagctggtggttctgtgccttcccctacagcttcctgatctttgtgtatgatgagatcaggaagctgatcctgcggaggaaccctgggggctgggtggagaaggagacctactactag

SEQ ID NO: 144526 - DNA, 3081 bp, Artificial Sequence
  Description of Artificial Sequence: Synthetic coding sequence
atgggcagcggcggcagtgacagctacagaattgccaccagccaggacaagaaggatgacaaggacagccccaagaagaacaagggcaaggagcggcgggacctggatgacctgaagaaggaggtggccatgacagagcacaagatgtctgtggaggaggtgtgcaggaagtacaacacagactgtgtgcagggcctgacccacagcaaggcccaggagatcctggccagagatggccccaatgccctgaccccaccacccaccaccccagagtgggtgaagttctgccggcagctgtttggaggcttcagcatcctgctgtggattggagccatcctgtgcttcctggcctacggcatccaggccggcacagaagatgaccccagcggggacaacctgtacctgggcatcgtgctggccgctgtggtgatcatcaccggctgcttctcctactaccaggaggccaagagcagcaagatcatggagagcttcaagaacatggtgccccagcaggccctggtgatccgggagggggagaagatgcaggtgaatgctgaggaggtggtggtgggggacctggtggagatcaagggcggggacagagtgcctgctgacctgcgcatcatcagcgcccacggctgcaaggtggacaacagcagcctgaccggggagagcgagccccagaccaggagcccagactgcacccatgacaaccccctggagaccaggaacatcaccttcttcagcaccaactgtgtggagggcacagcccggggcgtggtggtggccaccggggacagaacagtgatgggcagaattgccaccctggccagcggcctggaggtgggcaagacccccatcgccattgaaattgagcacttcatccagctgatcactggagtggccgtgttcctgggcgtgtccttcttcatcctgagcctcatcctgggctacacctggctggaggccgtcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacaaccagatccatgaagctgacaccacagaggaccagagcggcaccagctttgacaagagcagccacacctgggtggccctgagccacatcgccggcctgtgcaacagagctgtgttcaagggcggccaggacaacatccctgtgctgaagagagatgtggccggagatgccagcgagagcgccctgctgaagtgcatcgagctgagcagcggctctgtgaagctgatgagggagaggaacaagaaggtggccgagatccccttcaacagcaccaacaagtaccagctgagcatccacgagacagaggaccccaatgacaaccgctacctgctggtgatgaagggggcccctgagcgcatcctggaccgctgcagcaccatcctgctgcagggcaaggagcagcccctggatgaggagatgaaggaggccttccagaatgcctacctggagctgggcggcctgggggagcgggtgctgggcttctgccactactacctgcctgaggagcagttccccaagggctttgcctttgactgtgatgatgtgaacttcaccacagacaacctgtgctttgtgggcctgatgtccatgattgatcctcccagggctgctgtgcctgatgctgtgggcaagtgccgctctgctggcatcaaggtgatcatggtgactggagaccaccccatcacagccaaggccatcgccaagggcgtgggcatcatcagcgagggcaatgaaacagtggaggacattgctgcccggctgaacatccctgtgtcccaggtgaaccccagagatgccaaggcctgcgtcatccatggaacagacctgaaggacttcaccagcgagcagattgatgagatcctgcagaaccacacagaaattgtgtttgcccggaccagcccccagcagaagctgatcatcgtggagggctgccagaggcagggcgccatcgtggccgtgactggagatggagtgaatgacagccctgccctgaagaaggctgacattggagtggccatgggcattgctggcagtgatgtgtccaagcaggccgctgacatgatcctgctggatgacaactttgccagcatcgtgactggagtggaggagggccgcctcatctttgacaacctgaagaagagcatcgcctacaccctgaccagcaacatccctgagatcacccccttcctgctcttcatcatggccaacatccccctgcccctgggcaccatcaccatcctgtgcatcgacctgggcacagacatggtgcctgccatcagcctggcctatgaagctgctgagagtgacatcatgaagaggcagcccaggaaccccaggacagacaagctggtgaatgaaagactcatctccatggcctacggccagatcggcatgatccaggccctgggcggcttcttctcctactttgtgatcctggccgagaatggcttcctgcccggcaacctggtgggcatccggctgaactgggatgacagaacagtgaatgacctggaggacagctatggccagcagtggacctatgagcagaggaaggtggtggagttcacctgccacacagccttctttgtgtccatcgtggtggtgcagtgggccgacctgatcatctgcaagaccaggaggaacagcgtcttccagcagggcatgaagaacaagatcctgatcttcggcctgtttgaggagacagccctggccgccttcctgagctactgccccggcatggatgtggccctgaggatgtaccccctgaagcccagctggtggttctgtgccttcccctacagcttcctgatctttgtgtatgatgagatcaggaagctgatcctgcggaggaaccctgggggctgggtggagaaggagacctactactag

SEQ ID NO: 144527 - DNA, 3090 bp, Artificial Sequence
  Description of Artificial Sequence: Synthetic coding sequence
atgggcctgtggggcaagaagggcaccgtggcccctcatgaccagagccccaggagaagacccaagaagggcctcatcaagaagaagatggtgaagcgggagaagcagaagaggaacatggaggagctgaagaaggaggtggtgatggatgaccacaagctgaccctggaggagctgagcaccaagtacagcgtggacctgaccaagggccacagccaccagagggccaaggagatcctgacccggggcggccccaacacagtgaccccaccacccaccaccccagagtgggtgaagttctgcaagcagctgtttggaggcttcagcctgctgctgtggacaggagccatcctgtgctttgtggcctacagcatccagatctacttcaatgaggagcccaccaaggacaacctgtacctgagcatcgtgctgtctgtggtggtgattgtgacaggctgcttctcctactaccaggaggccaagagcagcaagatcatggagagcttcaagaacatggtgccccagcaggccctggtgatccggggcggggagaagatgcagatcaacgtgcaggaggtggtgctgggggacctggtggagatcaagggcggggacagagtgcctgctgacctgcggctcatcagcgcccagggctgcaaggtggacaacagcagcctgactggagagagcgagccccagagccgcagcccagacttcacccatgagaaccccctggagaccaggaacatctgcttcttcagcaccaactgtgtggagggcacagcccggggcatcgtgattgccactggagacagcacagtgatgggccgcatcgccagcctgaccagcggcctggccgtgggccagacccccatcgctgctgagattgagcacttcatccacctgatcaccgtggtggccgtgttcctgggcgtgaccttctttgccctgagcctgctgctgggctacggctggctggaggccatcatcttcctgattggcatcatcgtggccaacgtgcctgagggcctgctggccaccgtgacagtgtgcctgaccctgacagccaagaggatggccaggaagaactgcctggtgaagaacctggaggccgtggagaccctgggcagcaccagcaccatctgcagcgacaagacaggcaccctgacccagaacaggatgacagtggcccacatgtggtttgacatgacagtgtatgaggccgacaccacagaggagcagacaggcaagaccttcaccaagagcagtgacacctggttcatgctggccagaattgctggcctgtgcaacagagctgacttcaaggccaaccaggagatcctgcccatcgccaagagggccaccactggagatgccagcgagagcgccctgctgaagttcatcgagcagagctacagctctgtggccgagatgagggagaagaaccccaaggtggccgagatccccttcaacagcaccaacaagtaccagatgagcatccacctgcgggaggacagcagccagacccacgtgctgatgatgaagggggcccctgagcgcatcctggagttctgcagcaccttcctgctgaatggccaggagtacagcatgaatgatgagatgaaggaggccttccagaatgcctacctggagctgggcggcctgggggagcgggtgctgggcttctgcttcctgaacctgcccagcagcttcagcaagggcttccccttcaacacagatgagatcaacttccccatggacaacctgtgctttgtgggcctcatctccatgattgacccccccagggctgctgtgcctgatgctgtgtccaaatgtagatctgctggcatcaaggtgatcatggtgactggagaccaccccatcacagccaaggccatcgccaagggcgtgggcatcatcagcgagggcacagaaacagctgaggaggtggccgcccggctgaagatccccatcagcaaggtggatgccagcgctgccaaggccatcgtggtgcacggggctgagctgaaggacatccagagcaagcagctggaccagatcctgcagaaccaccctgagatcgtgtttgcccggaccagcccccagcagaagctgatcatcgtggagggctgccagaggctgggcgctgtggtggccgtgactggagatggagtgaatgacagccctgccctgaagaaggctgacatcggcatcgccatgggcatcagcggcagtgatgtgtccaagcaggccgctgacatgatcctgctggatgacaactttgccagcatcgtgactggagtggaggagggccgcctcatctttgacaacctgaagaagagcatcatgtacaccctgaccagcaacatccctgagatcacccccttcctgatgttcatcatcctgggcatccccctgcccctgggcaccatcaccatcctgtgcatcgacctgggcacagacatggtgcctgccatcagcctggcctatgagagcgctgagagtgacatcatgaagaggctgcccaggaaccccaagacagacaacctggtgaaccacaggctcatcggcatggcctacggccagatcggcatgatccaggccctggccggcttcttcacctacttcgtcatcctggctgaaaatggcttccggcctgtggacctgctgggcatccggctgcactgggaggacaagtacctgaatgacctggaggacagctatggccagcagtggacctatgagcagaggaaggtggtggagttcacctgccagacagccttctttgtgaccatcgtggtggtgcagtgggccgacctgatcatcagcaagaccaggaggaacagcctcttccagcagggcatgaggaacaaggtgctgatcttcggcatcctggaggagaccctgctggccgccttcctgagctacaccccaggcatggatgtggccctgaggatgtaccccctgaagatcacctggtggctgtgtgccatcccctacagcatcctgatctttgtgtatgatgagatcaggaagctgctgatccggcagcacccagatggctgggtggagcgggagacctactactag

SEQ ID NO: 144528 - DNA, 498 bp, Artificial Sequence
  Description of Artificial Sequence: Synthetic coding sequence
atgatccaggccctggccggcttcttcacctacttcgtcatcctggctgaaaatggcttccggcctgtggacctgctgggcatccggctgcactgggaggacaagtacctgaatgacctggaggacagctatggccagcagtggacctatgagcagaggaaggtggtggagttcacctgccagacagccttctttgtgaccatcgtggtggtgcagtgggccgacctgatcatcagcaagaccaggaggaacagcctcttccagcagggcatgaggaacaaggtgctgatcttcggcatcctggaggagaccctgctggccgccttcctgagctacaccccaggcatggatgtggccctgaggatgtaccccctgaagatcacctggtggctgtgtgccatcccctacagcatcctgatctttgtgtatgatgagatcaggaagctgctgatccggcagcacccagatggctgggtggagcgggagacctactactag

SEQ ID NO: 144529 - DNA, 888 bp, Artificial Sequence
  Description of Artificial Sequence: Synthetic coding sequence
atgggcaagaggaagtgcagccctgccagccagagcctcttcctgttccagttccagaagatggagctgaagttcaagatcctgctcttctacgtgatcttctacggctgcctggccggcatcttcatcggcaccatccaggtgatgctgctgaccatcagcgagttcaagcccacctaccaggacagagtggcccctcctggcctgacccagatcccccagatccagaagacagagatctccttccggcccaatgaccccaagagctatgaggcctacgtgctgaacatcgtgcgcttcctggagaagtacaaggacagcgcccagagagatgacatgatctttgaggactgtggagatgtgcccagcgagcccaaggagcggggggacttcaaccacgagcggggggagaggaaggtgtgccgcttcaagctggagtggctgggcaactgcagcggcctgaatgatgagacctacggctacaaggagggcaagccctgcatcatcatcaagctgaacagagtgctgggcttcaagcccaagccacccaagaatgaaagcctggagacctaccctgtgatgaagtacaaccccaacgtgctgcctgtgcagtgcaccgggaagagagatgaggacaaggacaaggtgggcaatgtggagtacttcggcctgggcaacagccctggcttccccctgcagtactacccctactacggcaagctgctgcagcccaagtacctgcagcccctgctggccgtgcagttcaccaacctgaccatggacacagagatcagaattgagtgcaaggcctatggagaaaatattggctacagcgagaaggaccgcttccagggccgctttgatgtgaagattgaggtgaagagctag

SEQ ID NO: 144530 - DNA, 912 bp, Artificial Sequence
  Description of Artificial Sequence: Synthetic coding sequence
atggcccggggcaaggccaaggaggagggctcctggaagaagttcatctggaacagcgagaagaaggagttcctgggccgcactggaggctcctggttcaagatcctgctcttctacgtgatcttctacggctgcctggccggcatcttcatcggcaccatccaggtgatgctgctgaccatcagcgagttcaagcccacctaccaggacagagtggcccctcctggcctgacccagatcccccagatccagaagacagagatctccttccggcccaatgaccccaagagctatgaggcctacgtgctgaacatcgtgcgcttcctggagaagtacaaggacagcgcccagagagatgacatgatctttgaggactgtggagatgtgcccagcgagcccaaggagcggggggacttcaaccacgagcggggggagaggaaggtgtgccgcttcaagctggagtggctgggcaactgcagcggcctgaatgatgagacctacggctacaaggagggcaagccctgcatcatcatcaagctgaacagagtgctgggcttcaagcccaagccacccaagaatgaaagcctggagacctaccctgtgatgaagtacaaccccaacgtgctgcctgtgcagtgcaccgggaagagagatgaggacaaggacaaggtgggcaatgtggagtacttcggcctgggcaacagccctggcttccccctgcagtactacccctactacggcaagctgctgcagcccaagtacctgcagcccctgctggccgtgcagttcaccaacctgaccatggacacagagatcagaattgagtgcaaggcctatggagaaaatattggctacagcgagaaggaccgcttccagggccgctttgatgtgaagattgaggtgaagagctag

SEQ ID NO: 144531 - DNA, 912 bp, Artificial Sequence; identical to SEQ ID NO: 144530
  Description of Artificial Sequence: Synthetic coding sequence

SEQ ID NO: 144532 - DNA, 744 bp, Artificial Sequence
  Description of Artificial Sequence: Synthetic coding sequence
atgctgctgaccatcagcgagttcaagcccacctaccaggacagagtggcccctcctggcctgacccagatcccccagatccagaagacagagatctccttccggcccaatgaccccaagagctatgaggcctacgtgctgaacatcgtgcgcttcctggagaagtacaaggacagcgcccagagagatgacatgatctttgaggactgtggagatgtgcccagcgagcccaaggagcggggggacttcaaccacgagcggggggagaggaaggtgtgccgcttcaagctggagtggctgggcaactgcagcggcctgaatgatgagacctacggctacaaggagggcaagccctgcatcatcatcaagctgaacagagtgctgggcttcaagcccaagccacccaagaatgaaagcctggagacctaccctgtgatgaagtacaaccccaacgtgctgcctgtgcagtgcaccgggaagagagatgaggacaaggacaaggtgggcaatgtggagtacttcggcctgggcaacagccctggcttccccctgcagtactacccctactacggcaagctgctgcagcccaagtacctgcagcccctgctggccgtgcagttcaccaacctgaccatggacacagagatcagaattgagtgcaaggcctatggagaaaatattggctacagcgagaaggaccgcttccagggccgctttgatgtgaagattgaggtgaagagctag

SEQ ID NO: 144533 - DNA, 873 bp, Artificial Sequence
  Description of Artificial Sequence: Synthetic coding sequence
atggtgatccagaaggagaagaagagctgtggccaggtggtggaggagtggaaggagtttgtgtggaaccccaggacccaccagttcatgggccgcacaggcacctcctgggccttcatcctgctcttctacctggtgttctacggcttcctgacagccatgttcaccctgaccatgtgggtgatgctgcagacagtgtctgaccacacccccaagtaccaggaccggctggccaccccaggcctgatgatccggcccaagacagagaacctggatgtgattgtgaatgtgtctgacacagagagctgggaccagcacgtgcagaagctgaacaagttcctggagccctacaatgacagcatccaggcccagaagaatgatgtgtgcaggcctggccgctactatgagcagcctgacaacggggtgctgaactaccccaagagggcctgccagttcaacagaacccagctgggcaactgcagcggcattggagacagcacccactacggctacagcacaggccagccctgtgtgttcatcaagatgaacagagtcatcaacttctacgccggggccaaccagagcatgaatgtgacctgtgccggcaagagagatgaagatgctgagaacctgggcaactttgtgatgtttcctgccaacggcaacatcgacctgatgtacttcccctactacggcaagaagttccacgtgaactacacccagcccctggtggccgtgaagttcctgaatgtgacccccaacgtggaggtgaatgtggagtgccgcatcaatgctgccaacatcgccacagatgatgagcgggacaagtttgctggccgggtggccttcaagctgcgcatcaacaagacctag

SEQ ID NO: 144534 - DNA, 840 bp, Artificial Sequence
  Description of Artificial Sequence: Synthetic coding sequence
atgaccaagaatgagaagaagagcctgaaccagagcctggccgagtggaagctgttcatctacaaccccaccactggagagttcctgggccgcacagccaagtcctggggcctcatcctgctcttctacctggtgttctacggcttcctggccgccctcttctccttcaccatgtgggtgatgctgcagaccctgaatgatgaggtgcccaagtacagagaccagatccccagccctggcctgatggtgttccccaagcctgtgacagccctggagtacaccttcagcagaagtgaccccaccagctatgccggctacatcgaggacctgaagaagttcctgaagccctacaccctggaggagcagaagaacctgactgtgtgcccagatggagccctgtttgagcagaagggccctgtgtatgtggcctgccagttccccatcagcctgctgcaggcctgcagcggcatgaatgaccctgactttggctacagccagggcaacccctgcatcctggtgaagatgaaccgcatcatcggcctgaagccagagggcgtgcccagaattgactgtgtgtccaagaatgaagacatccccaacgtggccgtgtacccccacaacggcatgattgacctgaagtacttcccctactacggcaagaagctgcacgtgggctacctgcagcccctggtggccgtgcaggtgtcctttgcccccaacaacacaggcaaggaggtgacagtggagtgcaagattgatggcagcgccaacctgaagagccaggatgaccgggacaagttcctgggccgggtgatgttcaagatcacagcccgggcctag

SEQ ID NO: 144535 - DNA, 582 bp, Artificial Sequence
  Description of Artificial Sequence: Synthetic coding sequence
atgctgtctgagggggacatcctcttcagcagcctgctgagcagccccagcctcttctggcccccaggcctcatcctgctcttctacctggtgttctacggcttcctggccgccctcttctccttcaccatgtgggtgatgctgcagaccctgaatgatgaggtgcccaagtacagagaccagatccccagccctggcctgatggtgttccccaagcctgtgacagccctggagtacaccttcagcagaagtgaccccaccagctatgccggctacatcgaggacctgaagaagttcctgaagccctacaccctggaggagcagaagaacctgactgtgtgcccagatggagccctgtttgagcagaagggccctgtgtatgtggcctgccagttccccatcagcctgctgcaggcctgcagcggcatgaatgaccctgactttggctacagccagggcaacccctgcatcctggtgaagatgaaccgcatcatcggcctgaagccagagggcgtgcccagaattgactgtgtgtccaagaccaacaacgtgaaggatggcatgaagatctaccagatgtag

SEQ ID NO: 144536 - DNA, 2139 bp, Artificial Sequence
  Description of Artificial Sequence: Synthetic coding sequence
atggccctgctggccatgcacagctggcgctgggccgctgctgctgctgcctttgagaagagaagacacagcgccatcctgatccggcccctggtgtctgtgtctggcagcggcccccagtggaggccccaccagctgggcgccctgggcacagcccgggcctaccagatccctgagagcctgaagagcatcacctggcagaggctgggcaaaggaaacagcggccagttcctggatgctgccaaggccctgcaggtgtggcccctcatcgagaagaggacctgctggcacggccacgccggcggcggcctgcacacagaccccaaggagggcgccatgaacatcgtggtgcccttcatgttcaagtatgctgtggacagcctgaaccagatgagcggcaacatgctgaacctgagtgatgcccccaacacagtggccaccatggccacagctgtgctgattggctacggcgtgtccagagctggagctgccttcttcaatgaggtgagaaatgctgtgtttgggaaggtggcccagaacagcatcagaagaattgccaagaatgtgttcctgcacctgcacaacctggacctgggcttccacctgagccggcagacaggagccctgagcaaggccatcgaccggggcacccggggcatcagctttgtgctgagcgccctggtgttcaacctgctgcccatcatgtttgaggtgatgctggtgtctggagtgctgtactacaagtgtggggcccagtttgccctggtgaccctgggcaccctgggcacctacacagccttcaccgtggccgtgacccgctggaggacccgcttccgcatcgagatgaacaaggctgacaatgatgctggaaatgctgccatcgacagcctgctgaactatgagaccgtgaagtacttcaacaatgaaagatatgaggcccagagatatgatggcttcctgaagacctatgaaacagccagcctgaagagcaccagcaccctggccatgctgaactttggccagagcgccatcttctctgtgggcctgacagccatcatggtgctggccagccagggcatcgtggccggcaccctgactgtgggggacctggtgatggtgaatggcctgctcttccagctgagcctgcccctgaacttcctgggcaccgtgtaccgggagacccggcaggccctgattgacatgaacaccctcttcaccctgctgaaggtggacacccagatcaaggacaaggtgatggccagccccctgcagatcaccccccagacagccaccgtggcctttgacaacgtgcactttgagtacatcgagggccagaaggtgctgagcggcatcagctttgaggtgcctgctgggaagaaggtggccatcgtgggcggcagcggcagcggcaagagcaccatcgtgcggctgctcttccgcttctatgagccccagaagggcagcatctacctggccggccagaacatccaggatgtgtccctggagagcctgcggcgggctgtgggcgtggtgccccaggatgctgtgctcttccacaacaccatctactacaacctgctgtatggcaacatcagcgccagccctgaggaggtgtatgctgtggccaagctggccggcctgcatgatgccatcctgaggatgccccacggctatgacacccaggtgggggagcggggcctgaagctgagcggcggggagaagcagagggtggccatcgcccgggccatcctgaaggacccccctgtgatcctgtatgatgaggccaccagcagcctggacagcatcacagaggagaccatcctgggcgccatgaaggatgtggtgaagcacaggaccagcatcttcatcgcccaccggctgagcacagtggtggatgctgatgagatcatcgtgctggaccagggcaaggtggccgagcggggcacccaccacggcctgctggccaacccccacagcatctacagcgagatgtggcacacccagagcagccgggtgcagaaccacgacaaccccaagtgggaggccaagaaggagaacatcagcaaggaggaggagaggaagaagctgcaggaggagatcgtgaacagcgtgaagggctgcggcaactgcagctgctag

SEQ ID NO: 144537 - DNA, 2046 bp, Artificial Sequence
  Description of Artificial Sequence: Synthetic coding sequence
atgaggctgtggaaggctgtggtggtgaccctggccttcatgtctgtggacatctgtgtgaccacagccatctacgtgttcagccacctggacaggagcctgctggaggacatccgccacttcaacatctttgacagcgtgctggacctgtgggccgcctgcctgtaccgcagctgcctgctgctgggcgccaccatcggcgtggccaagaacagcgccctgggcccccggcggctgcgggcctcctggctggtgatcaccctggtgtgcctgtttgtgggcatctatgccatggtgaagctgctgctcttcagcgaggtgcggcggcccatccgggacccctggttctgggccctgtttgtgtggacctacatcagcctgggcgccagcttcctgctgtggtggctgctgagcacagtgcggcccggcacccaggccctggagcctggagctgccacagaagctgagggcttccctggcagcggccggcccccacctgagcaggccagcggggccaccctgcagaagctgctgagctacaccaagccagatgtggccttcctggtggccgccagcttcttcctgattgtggccgccctgggggagaccttcctgccctactacacaggccgggccattgatggcatcgtcatccagaagtccatggaccagttcagcacagctgtggtgattgtgtgcctgctggccatcggcagcagctttgctgctggcatccggggcggcatcttcaccctcatctttgcccggctgaacatccggctgaggaactgcctcttccgcagcctggtgtcccaggagaccagcttctttgatgaaaatagaactggagacctgatcagccggctgaccagtgacaccaccatggtgtctgacctggtgtcccagaacatcaacgtgttcctgaggaacacagtgaaggtgactggagtggtggtgttcatgttcagcctgtcctggcagctgagcctggtgaccttcatgggcttccccatcatcatgatggtgagcaacatctacggcaagtactacaagaggctgagcaaggaggtgcagaatgccctggcccgggccagcaacacagctgaggagaccatcagcgccatgaagacagtgcgcagctttgccaatgaggaggaggaggccgaggtgtacctgaggaagctgcagcaggtgtacaagctgaacaggaaggaggccgccgcctacatgtactacgtgtggggcagcggcctgaccctgctggtggtgcaggtgtccatcctgtactacggcggccacctggtgatcagcggccagatgaccagcggcaacctgattgccttcatcatctatgaatttgtgctgggggactgcatggagagcgtgggctctgtgtacagcggcctgatgcagggcgtgggcgctgctgagaaggtgtttgagttcatcgaccggcagcccaccatggtgcatgatggcagcctggccccagaccacctggagggccgggtggactttgaaaatgtgaccttcacctaccgcacccggccccacacccaggtgctgcagaatgtgtccttcagcctgagccctgggaaggtgacagccctggtgggccccagcggcagcggcaagagcagctgtgtgaacatcctggagaacttctaccccctggagggcggccgggtgctgctggatggcaagcccatcagcgcctatgaccacaagtacctgcacagggtcatcagcctggtgtcccaggagcctgtgctgtttgcccggagcatcacagacaacatctcctatggcctgcccaccgtgccctttgagatggtggtggaggccgcccagaaggccaatgcccacggcttcatcatggagctgcaggacggctacagcacagagaccggggagaagggggcccagctgagcggcggccagaagcagagggtggccatggcccgggccctggtgagaaatcctcctgtgctgatcctggatgaggccaccagcgccctggatgctgagagcgagtacctgatctag

SEQ ID NO: 144538 - DNA, 2052 bp, Artificial Sequence
  Description of Artificial Sequence: Synthetic coding sequence
atgaggctgtggaaggctgtggtggtgaccctggccttcatgtctgtggacatctgtgtgaccacagccatctacgtgttcagccacctggacaggagcctgctggaggacatccgccacttcaacatctttgacagcgtgctggacctgtgggccgcctgcctgtaccgcagctgcctgctgctgggcgccaccatcggcgtggccaagaacagcgccctgggcccccggcggctgcgggcctcctggctggtgatcaccctggtgtgcctgtttgtgggcatctatgccatggtgaagctgctgctcttcagcgaggtgcggcggcccatccgggacccctggttctgggccctgtttgtgtggacctacatcagcctgggcgccagcttcctgctgtggtggctgctgagcacagtgcggcccggcacccaggccctggagcctggagctgccacagaagctgagggcttccctggcagcggccggcccccacctgagcaggccagcggggccaccctgcagaagctgctgagctacaccaagccagatgtggccttcctggtggccgccagcttcttcctgattgtggccgccctgggggagaccttcctgccctactacacaggccgggccattgatggcatcgtcatccagaagtccatggaccagttcagcacagctgtggtgattgtgtgcctgctggccatcggcagcagctttgctgctggcatccggggcggcatcttcaccctcatctttgcccggctgaacatccggctgaggaactgcctcttccgcagcctggtgtcccaggagaccagcttctttgatgaaaatagaactggagacctgatcagccggctgaccagtgacaccaccatggtgtctgacctggtgtcccagaacatcaacgtgttcctgaggaacacagtgaaggtgactggagtggtggtgttcatgttcagcctgtcctggcagctgagcctggtgaccttcatgggcttccccatcatcatgatggtgagcaacatctacggcaagtactacaagaggctgagcaaggaggtgcagaatgccctggcccgggccagcaacacagctgaggagaccatcagcgccatgaagacagtgcgcagctttgccaatgaggaggaggaggccgaggtgtacctgaggaagctgcagcaggtgtacaagctgaacaggaaggaggccgccgcctacatgtactacgtgtggggcagcggcctgaccctgctggtggtgcaggtgtccatcctgtactacggcggccacctggtgatcagcggccagatgaccagcggcaacctgattgccttcatcatctatgaatttgtgctgggggactgcatggagagcgtgggctctgtgtacagcggcctgatgcagggcgtgggcgctgctgagaaggtgtttgagttcatcgaccggcagcccaccatggtgcatgatggcagcctggccccagaccacctggagggccgggtggactttgaaaatgtgaccttcacctaccgcacccggccccacacccaggtgctgcagaatgtgtccttcagcctgagccctgggaaggtgacagccctggtgggccccagcggcagcggcaagagcagctgtgtgaacatcctggagaacttctaccccctggagggcggccgggtgctgctggatggcaagcccatcagcgcctatgaccacaagtacctgcacagggtcatcagcctggtgtcccaggagcctgtgctgtttgcccggagcatcacagacaacatctcctatggcctgcccaccgtgccctttgagatggtggtggaggccgcccagaaggccaatgcccacggcttcatcatggagctgcaggacggctacagcacagagaccggggagaagggggcccagctgagcggcggccagaagcagagggtggccatggcccgggccctggtgagaaatcctcctgtgctgatcctggatgaggccaccagcgccctggatgctgagagcgagtacctgtgtgccggctag

SEQ ID NO: 144539 - DNA, 300 bp, Artificial Sequence
  Description of Artificial Sequence: Synthetic coding sequence
atggccgccccagctgagccctgtgccggccagggcgtgtggaaccagacagagcctgagcctgctgccaccagcctgctgagcctgtgcttcctgaggacagctggggtgtgggtgccccccatgtacctgtgggtgctgggccccatctacctgctcttcatccaccaccacggccggggctacctgaggatgagccccctcttcaaggccaagatggtggccgccatccctggcagcctggagcctggaaatgtgcggggccggcagggcaccggctggaacctggtgaagagctag

SEQ ID NO: 144540 - DNA, 372 bp, Artificial Sequence
  Description of Artificial Sequence: Synthetic coding sequence
atgcccagcgctggcaccctgccctgggtgcagggcatcatctgcaatgccaacaacccctgcttccgctaccccaccccaggagaggcccctggggtggtgggcaacttcaacaagagcatcgtggcccggctcttcagtgatgcccggcggctgctgctgtacagccagaaggacacctccatgaaggacatgaggaaggtgctgcggaccctgcagcagatcaagaagagcagcagcaacctgaagctgcaggacttcctggtggacaatgagaccttcagcggcttcctgtaccacaacctgagcctgcccaagagcacagtggacaagatgctgcgggcagatgtgatcctgcacaaggtgtcctag

SEQ ID NO: 144541 - DNA, 6786 bp, Artificial Sequence
  Description of Artificial Sequence: Synthetic coding sequence
atggcctgctggccccagctgcggctgctgctgtggaagaacctgaccttcagaagacggcagacctgccagctgctgctggaggtggcctggcccctcttcatcttcctgatcctgatctctgtgcggctgagctacccaccctatgagcagcacgagtgccacttccccaacaaggccatgcccagcgctggcaccctgccctgggtgcagggcatcatctgcaatgccaacaacccctgcttccgctaccccaccccaggagaggcccctggggtggtgggcaacttcaacaagagcatcgtggcccggctcttcagtgatgcccggcggctgctgctgtacagccagaaggacacctccatgaaggacatgaggaaggtgctgcggaccctgcagcagatcaagaagagcagcagcaacctgaagctgcaggacttcctggtggacaatgagaccttcagcggcttcctgtaccacaacctgagcctgcccaagagcacagtggacaagatgctgcgggcagatgtgatcctgcacaaggtgttcctgcagggctaccagctgcacctgaccagcctgtgcaatggcagcaagtctgaggagatgatccagctgggggaccaggaggtgtctgagctgtgtggcctgccccgggagaagctggccgctgctgagcgggtgctgcggagcaacatggacatcctgaagcccatcctgcggaccctgaacagcaccagccccttccccagcaaggagctggccgaggccaccaagaccctgctgcacagcctgggcaccctggcccaggagctgttctccatgaggtcctggagcgacatgaggcaggaggtgatgttcctgaccaacgtgaacagcagcagcagcagcacccagatctaccaggccgtgtccagaattgtgtgtggccaccctgagggcggcggcctgaagatcaagagcctgaactggtatgaggacaacaactacaaggccctgtttggaggaaatggaacagaagaagatgctgagaccttctatgacaacagcaccaccccctactgcaatgacctgatgaagaacctggagagcagccccctgagccgcatcatctggaaggccctgaagcccctgctggtgggcaagatcctgtacaccccagacaccccagccacccggcaggtgatggccgaggtgaacaagaccttccaggagctggccgtgttccatgacctggagggcatgtgggaggagctgagccccaagatctggaccttcatggagaacagccaggagatggacctggtgaggatgctgctggacagccgggacaatgaccacttctgggagcagcagctggatggcctggactggacagcccaggacatcgtggccttcctggccaagcacccagaagatgtgcagagcagcaatggatctgtgtacacctggagggaggccttcaatgagaccaaccaggccatccgcaccatcagccgcttcatggagtgtgtgaacctgaacaagctggagcccatcgccacagaggtgtggctgatcaacaagtccatggagctgctggatgagaggaagttctgggccggcatcgtgttcaccggcatcaccccaggcagcattgagctgccccaccacgtgaagtacaagatccgcatggacatcgacaacgtggagaggaccaacaagatcaaggatggctactgggaccccggccccagggctgacccctttgaggacatgagatatgtgtggggcggctttgcctacctgcaggatgtggtggagcaggccatcatccgggtgctgactggaacagagaagaagacaggagtgtacatgcagcagatgccctacccctgctacgtggatgacatcttcctgcgggtgatgagccgctccatgcccctcttcatgaccctggcctggatctacagcgtggccgtcatcatcaagggcatcgtgtatgagaaggaggcccggctgaaggagaccatgaggatcatgggcctggacaacagcatcctgtggttctcctggttcatcagcagcctcatccccctgctggtgtctgctggcctgctggtggtgatcctgaagctgggcaacctgctgccctacagcgaccccagcgtggtgtttgtgttcctgtctgtgtttgctgtggtgaccatcctgcagtgcttcctgatcagcaccctcttcagccgggccaacctggccgccgcctgtggcggcatcatctacttcaccctgtacctgccctacgtgctgtgtgtggcctggcaggactatgtgggcttcaccctgaagatctttgccagcctgctgagccctgtggcctttggatttggctgtgagtactttgccctgtttgaggagcagggcatcggcgtgcagtgggacaacctgtttgagagccctgtggaggaggatggcttcaacctgaccacctctgtgtccatgatgctgtttgacaccttcctgtatggagtgatgacctggtacatcgaggccgtgtttcctggccagtatggcatcccccggccctggtacttcccctgcaccaagagctactggtttggagaggagagtgatgagaagagccaccctggcagcaaccagaagaggatcagcgagatctgcatggaggaggagcccacccacctgaagctgggcgtgtccatccagaacctggtgaaggtgtacagagatggcatgaaggtggccgtggatggcctggccctgaacttctatgagggccagatcaccagcttcctgggccacaatggagctgggaagaccaccaccatgagcatcctgaccggcctcttcccccccaccagcggcacagcctacatcctgggcaaggacatccgctctgagatgagcaccatccggcagaacctgggcgtgtgcccccagcacaacgtgctgtttgacatgctgactgtggaggagcacatctggttctacgcccggctgaagggcctgtctgagaagcacgtgaaggccgagatggagcagatggccctggatgtgggcctgcccagcagcaagctgaagagcaagaccagccagctgagcggcggcatgcagaggaagctgtctgtggccctggcctttgtgggcggcagcaaggtggtgatcctggatgagcccacagctggggtggacccctacagccggcggggcatctgggagctgctgctgaagtaccggcagggccgcaccatcatcctgagcacccaccacatggatgaagcagatgtgctgggggacagaattgccatcatcagccacggcaagctgtgctgcgtgggcagcagcctcttcctgaagaaccagctgggcaccggctactacctgaccctggtgaagaaggatgtggagagcagcctgagcagctgcaggaacagcagcagcacagtgtcctacctgaagaaggaggacagcgtgtcccagagcagcagtgatgctggcctgggcagtgaccatgaaagtgacaccctgaccattgatgtgtctgccatcagcaacctgatcaggaagcacgtgtctgaggcccggctggtggaggacatcggccacgagctgacctacgtgctgccctatgaggccgccaaggagggcgcctttgtggagctgttccatgaaattgatgaccggctgagtgacctgggcatcagcagctatggcatcagcgagaccaccctggaggagatcttcctgaaggtggccgaggagagcggcgtggatgctgagaccagtgatggcaccctgcctgcccggaggaacagaagagcctttggagacaagcagagctgcctgcggcccttcacagaagatgatgctgctgaccccaatgacagcgacatcgaccctgagagccgggagacagacctgctgagcggcatggatggcaagggcagctaccaggtgaagggctggaagctgacccagcagcagtttgtggccctgctgtggaagaggctgctgattgcccggcgcagcaggaagggcttctttgcccagatcgtgctgcctgctgtgtttgtgtgcatcgccctggtgttcagcctgattgtgcccccatttgggaagtaccccagcctggagctgcagccctggatgtacaatgagcagtacacctttgtgtccaatgatgcccctgaggacaccggcaccctggagctgctgaatgccctgaccaaggaccccggcttcggcacccgctgcatggagggcaaccccatcccagacaccccctgccaggccggggaggaggagtggaccacagcccctgtgccccagaccatcatggacctcttccagaatggaaactggaccatgcagaaccccagccctgcctgccagtgcagcagtgacaagatcaagaagatgctgcctgtgtgccccccaggagctgggggcctgcccccaccccagaggaagcagaacacagctgacatcctgcaggacctgactggaagaaacatcagtgactacctggtgaagacctacgtgcagatcatcgccaagagcctgaagaacaagatctgggtgaatgagttccgctatggaggcttcagcctgggcgtgagcaacacccaggccctgccccccagccaggaggtgaatgatgccatcaagcagatgaagaagcacctgaagctggccaaggacagcagcgctgaccgcttcctgaacagcctgggccgcttcatgacaggcctggacaccaagaacaacgtgaaggtgtggttcaacaacaagggctggcacgccatcagcagcttcctgaatgtcatcaacaatgccatcctgcgggccaacctgcagaagggggagaaccccagccactacggcatcacagccttcaaccaccccctgaacctgaccaagcagcagctgtctgaggtggccctgatgaccacctctgtggatgtgctggtgtccatctgtgtgatctttgccatgagctttgtgcctgccagctttgtggtgttcctgatccaggagcgggtgtccaaggccaagcacctgcagttcatctctggagtgaagcctgtgatctactggctgagcaactttgtgtgggacatgtgcaactacgtggtgcctgccaccctggtgatcatcatcttcatctgcttccagcagaagagctatgtgagcagcaccaacctgcctgtgctggccctgctgctgctgctgtatggctggagcatcacccccctgatgtacccagccagctttgtgttcaagatccccagcacagcctacgtggtgctgacctctgtgaacctcttcatcggcatcaatggatctgtggccacctttgtgctggagctgttcacagacaacaagctgaacaacatcaatgacatcctgaagtctgtgttcctgatcttcccccacttctgcctgggccggggcctgattgacatggtgaagaaccaggccatggctgatgccctggagagatttggagaaaatagatttgtgagccccctgtcctgggacctggtgggcaggaacctgtttgccatggctgtggagggcgtggtgttcttcctgatcaccgtgctgatccagtaccgcttcttcatccggcccaggcctgtgaatgccaagctgagccccctgaatgatgaagatgaagatgtgcggcgggagcggcagaggatcctggatggcggcggccagaatgacatcctggagatcaaggagctgaccaagatctacagaaggaagaggaagccagctgtggaccgcatctgtgtgggcatccccccaggagagtgcttcggcctgctgggcgtgaatggagctgggaagagcagcaccttcaagatgctgaccggggacaccaccgtgaccagaggagatgccttcctgaacaagaacagcatcctgagcaacatccacgaggtgcaccagaacatgggctactgcccccagtttgatgccatcacagagctgctgaccggccgggagcacgtggagttctttgccctgctgcggggcgtgcctgagaaggaggtgggcaaggtgggggagtgggccatcaggaagctgggcctggtgaagtatggagagaagtatgccggcaactacagcggcggcaacaagaggaagctgagcacagccatggccctgattggaggcccccctgtggtgttcctggatgagcccaccaccggcatggaccccaaggcccggcgcttcctgtggaactgtgccctgtctgtggtgaaggagggccgctctgtggtgctgaccagccacagcatggaggagtgtgaggccctgtgcaccaggatggccatcatggtgaatggccgcttccgctgcctgggctctgtgcagcacctgaagaacagatttggagatggctacaccatcgtggtgagaattgctggcagcaacccagacctgaagcctgtgcaggacttcttcggcctggccttccctggctctgtgctgaaggagaagcacaggaacatgctgcagtaccagctgcccagcagcctgagcagcctggcccgcatcttcagcatcctgagccagagcaagaagaggctgcacatcgaggactacagcgtgtcccagaccaccctggaccaggtgtttgtgaactttgccaaggaccagagtgatgatgaccacctgaaggacctgagcctgcacaagaaccagacagtggtggatgtggccgtgctgaccagcttcctgcaggatgagaaggtgaaggagagctatgtgtag

SEQ ID NO: 144542 - DNA, 1092 bp, Artificial Sequence
  Description of Artificial Sequence: Synthetic coding sequence
atggcctgctggccccagctgcggctgctgctgtggaagaacctgaccttcagaagacggcagacctgccagctgctgctggaggtggcctggcccctcttcatcttcctgatcctgatctctgtgcggctgagctacccaccctatgagcagcacgagtgccacttccccaacaaggccatgcccagcgctggcaccctgccctgggtgcagggcatcatctgcaatgccaacaacccctgcttccgctaccccaccccaggagaggcccctggggtggtgggcaacttcaacaagagcatcgtggcccggctcttcagtgatgcccggcggctgctgctgtacagccagaaggacacctccatgaaggacatgaggaaggtgctgcggaccctgcagcagatcaagaagagcagcagcaacctgaagctgcaggacttcctggtggacaatgagaccttcagcggcttcctgtaccacaacctgagcctgcccaagagcacagtggacaagatgctgcgggcagatgtgatcctgcacaaggtgttcctgcagggctaccagctgcacctgaccagcctgtgcaatggcagcaagtctgaggagatgatccagctgggggaccaggaggtgtctgagctgtgtggcctgccccgggagaagctggccgctgctgagcgggtgctgcggagcaacatggacatcctgaagcccatcctgatggatgtgacctgtgatgacatcgcccacggccagctgactgtgcccaggtctgctgctgtggccgccactggagatgccaagcccaacatgatgggccgggagaccctgctgagcatctgtgcctctgtgcccaaggtggagttccacgagcggcacatcctgaagcacttctccttctgtgtgtgtgtgtctgtgtccctcttccctgccaagggcatcgtgtccttctcctgggccagcttccgcatctgggtgctgtggaaggctgtgttctggcagcacggggagagcatggctgtgtgggagggccagctgggcctgggcctgaacatcgcctttgagtacttcaccagcattgatgtgggctag

SEQ ID NO: 144543 - DNA, 4632 bp, Artificial Sequence
  Description of Artificial Sequence: Synthetic coding sequence
atgaacaagatggccctggccagcttcatgaagggccgcaccgtcatcggcaccccagatgaggagaccatggacatcgagctgcccaagaagtaccacgagatggtgggcgtcatcttcagtgacaccttctcctaccgcctgaagttcaactggggctaccgcatccctgtgatcaaggagcacagcgagtacacagagcactgctgggccatgcatggagagatcttctgctacctggccaagtactggctgaagggctttgtggccttccaggccgccatcaatgctgccatcatcgaggtgaccaccaaccacagcgtgatggaggagctgaccagcgtcatcggcatcaacatgaagatcccccccttcatcagcaagggggagatcatgaatgagtggttccacttcacctgcctggtgtccttcagcagcttcatctactttgccagcctgaatgtggcccgggagcggggcaagttcaagaagctgatgacagtgatgggcctgcgggagagcgccttctggctgtcctggggcctgacctacatctgcttcatcttcatcatgagcatcttcatggccctggtgatcaccagcatccccatcgtgttccacacaggcttcatggtgatcttcaccctgtacagcctgtatggcctgagcctgattgccctggccttcctgatgtctgtgctgatcaggaagcccatgctggccggcctggccggcttcctgttcaccgtcttctggggctgcctgggcttcaccgtgctgtaccggcagctgcccctgagcctgggctgggtgctgagcctgctgagcccctttgccttcaccgctggcatggcccagatcacccacctggacaactacctgtctggagtcatcttcccagaccccagcggggacagctacaagatgattgccaccttcttcatcctggcctttgacaccctcttctacctgatcttcaccctgtactttgagcgggtgctgcctgacaaggatggccacggggacagccccctcttcttcctgaagagcagcttctggagcaagcaccagaacacccaccacgagatctttgaaaatgagatcaaccctgagcacagcagtgatgacagctttgagcctgtgtccccagagttccacggcaaggaggccatccgcatcagaaatgtcatcaaggagtacaacgggaagacaggcaaggtggaggccctgcagggcatcttctttgacatctatgagggccagatcacagccatcctgggccacaatggagctgggaagagcaccctgctgaacatcctgagcggcctgtctgtgtccacagagggcagcgccaccatctacaacacccagctgtctgagatcacagacatggaggagatcaggaagaacatcggcttctgcccccagttcaacttccagtttgacttcctgactgtgcgggagaacctgcgggtgtttgccaagatcaagggcatccagcccaaggaggtggagcaggaggtgaagaggatcatcatggagctggacatgcagagcatccaggacatcatcgccaagaagctgagcggcggccagaagaggaagctgaccctgggcatcgccatcctgggggacccccaggtgctgctgctggatgagcccacagctggcctggaccccttcagccgccaccgggtgtggagcctgctgaaggagcacaaggtggacaggctcatcctcttcagcacccagttcatggatgaagctgacatcctggccgacaggaaggtgttcctgagcaatggcaagctgaagtgtgccggcagcagcctcttcctgaagaggaagtggggcatcggctaccacctgagcctgcacagaaatgagatgtgtgacacagagaagatcaccagcctcatcaagcagcacatcccagatgccaagctgaccacagaaagtgaggagaagctggtgtacagcctgcccctggagaagaccaacaagttcccagacctgtacagcgacctggacaagtgcagcgaccagggcatcagaaattatgctgtgtctgtgaccagcctgaatgaggtgttcctgaacctggagggcaagagcgccattgatgagccagactttgacatcggcaagcaggagaagatccacgtgaccaggaacacaggagatgagagcgagatggagcaggtgctgtgcagcctgcctgagaccaggaaggctgtgagcagcgctgccctgtggaggcggcagatctatgctgtggccaccctgcgcttcctgaagctgcggcgggagcggcgggccctgctgtgcctgctgctggtgctgggcatcgccttcatccccatcatcctggagaagatcatgtacaaggtgacccgggagacccactgctgggagttcagccccagcatgtacttcctgagcctggagcagatccccaagacccccctgaccagcctgctgattgtgaacaacacaggcagcaacatcgaggacctggtgcacagcctgaagtgccaggacatcgtgctggagattgatgacttcaggaacagaaatggaagtgatgaccccagctacaatggagccatcatcgtgtctggggaccagaaggactaccgcttctctgtggcctgcaacaccaagaagctgaactgcttccctgtgctgatgggcatcgtgtccaatgccctgatgggcatcttcaacttcacagagctgatccagatggagagcaccagcttcagcagagatgacatcgtgctggacctgggcttcattgatggcagcatcttcctgctgctgatcaccaactgtgtgagccccttcatcggcatgagcagcatcagtgactacaagaagaatgtgcagagccagctgtggatcagcggcctgtggcccagcgcctactggtgtggccaggccctggtggacatccccctgtacttcctgatcctcttcagcatccacctgatctactacttcatcttcctgggcttccagctgtcctgggagctgatgtttgtgctggtggtgtgcatcatcggctgtgctgtgtccctcatcttcctgacctacgtgctgtccttcatcttcaggaagtggaggaagaacaacggcttctggagctttggcttcttcatcatcctgatctgtgtgtccaccatcatggtgtccacccagtatgagaagctgaacctgatcctgtgcatgatcttcatccccagcttcaccctgctgggctacgtgatgctgctgatccagctggacttcatgaggaacctggacagcctggacaaccgcatcaatgaggtgaacaagaccatcctgctgaccaccctcatcccctacctgcagagcgtcatcttcctgtttgtgatccgctgcctggagatgaagtatggaaatgagatcatgaacaaggaccctgtgttccgcatcagccccaggagccgggagacccaccccaaccctgaggagcctgaggaggaggatgaagatgtgcaggccgagcgggtgcaggccgccaatgccctgacagcccccaacctggaggaggagcccgtcatcacagccagctgcctgcacaaggagtactatgagaccaagaagagctgcttcagcaccaggaagaagaagatcgccatcagaaatgtgtccttctgtgtgaagaagggggaggtgctgggcctgctgggccacaatggagctgggaagagcaccagcatcaagatgatcaccggctgcaccaagcccacagctggggtggtggtgctgcagggcagccgggcctctgtgcggcagcagcacgacaacagcctgaagttcctgggctactgcccccaggagaacagcctgtggcccaagctgaccatgaaggagcacctggagctgtatgctgctgtgaagggcctgggcaaggaggatgctgccctgagcatcagccggctggtggaggccctgaagctgcaggagcagctgaaggcccctgtgaagaccctgtctgagggcatcaagaggaagctgtgctttgtgctgagcatcctgggcaaccccagcgtggtgctgctggatgagcccttcaccggcatggaccctgagggccagcagcagatgtggcagatcctgcaggccaccgtgaagaacaaggagcggggcaccctgctgaccacccactacatgtctgaggccgaggccgtgtgtgacaggatggccatgatggtgtctggcaccctgcgctgcatcggcagcatccagcacctgaagaacaagtttggccgggactacctgctggagatcaagatgaaggagcccacccaggtggaggccctgcacacagagatcctgaagctgttcccccaggccgcctggcaggagcgctacagcagcctgatggcctacaagctgcctgtggaggatgtgcaccccctgagccgggccttcttcaagctggaggccatgaagcagaccttcaacctggaggagtacagcctgagccaggccaccctggagcaggtgttcctggagctgtgcaaggagcaggagctgggcaatgtggatgacaagattgacaccaccgtggagtggaagctgctgccccaggaggacccctag

SEQ ID NO: 144544 - DNA, 1401 bp, Artificial Sequence
  Description of Artificial Sequence: Synthetic coding sequence
atgaacaagatggccctggccagcttcatgaagggccgcaccgtcatcggcaccccagatgaggagaccatggacatcgagctgcccaagaagtaccacgagatggtgggcgtcatcttcagtgacaccttctcctaccgcctgaagttcaactggggctaccgcatccctgtgatcaaggagcacagcgagtacacagagcactgctgggccatgcatggagagatcttctgctacctggccaagtactggctgaagggctttgtggccttccaggccgccatcaatgctgccatcatcgaggtgaccaccaaccacagcgtgatggaggagctgaccagcgtcatcggcatcaacatgaagatcccccccttcatcagcaagggggagatcatgaatgagtggttccacttcacctgcctggtgtccttcagcagcttcatctactttgccagcctgaatgtggcccgggagcggggcaagttcaagaagctgatgacagtgatgggcctgcgggagagcgccttctggctgtcctggggcctgacctacatctgcttcatcttcatcatgagcatcttcatggccctggtgatcaccagcatccccatcgtgttccacacaggcttcatggtgatcttcaccctgtacagcctgtatggcctgagcctgattgccctggccttcctgatgtctgtgctgatcaggaagcccatgctggccggcctggccggcttcctgttcaccgtcttctggggctgcctgggcttcaccgtgctgtaccggcagctgcccctgagcctgggctgggtgctgagcctgctgagcccctttgccttcaccgctggcatggcccagatcacccacctggacaactacctgtctggagtcatcttcccagaccccagcggggacagctacaagatgattgccaccttcttcatcctggcctttgacaccctcttctacctgatcttcaccctgtactttgagcgggtgctgcctgacaaggatggccacggggacagccccctcttcttcctgaagagcagcttctggagcaagcaccagaacacccaccacgagatctttgaaaatgagatcaaccctgagcacagcagtgatgacagctttgagcctgtgtccccagagttccacggcaaggaggccatccgcatcagaaatgtcatcaaggagtacaacgggaagacaggcaaggtggaggccctgcagggcatcttctttgacatctatgagggccagatcacagccatcctgggccacaatggagctgggaagagcaccctgctgaacatcctgagcggcctgtctgtgtccacagagggcaagaagaactacaacggcatcagacatgccaagcacagccgccactactgctag

SEQ ID NO: 144545 - DNA, 279 bp, Artificial Sequence
  Description of Artificial Sequence: Synthetic coding sequence
atgaacaagatggccctggccagcttcatgaagggccgcaccgtcatcggcaccccagatgaggagaccatggacatcgagctgcccaagaagtaccacgagatggtgggcgtcatcttcagtgacaccttctcctaccgcctgaagttcaactggggctaccgcatccctgtgatcaaggagcacagcgagtacacaggccacaacaagagcttctgcaatggaggagtggacatctcctactggaacaagtatgaggacaccaccttccacttctag

SEQ ID NO: 144546 - DNA, 1359 bp, Artificial Sequence
  Description of Artificial Sequence: Synthetic coding sequence
atgaacaagatggccctggccagcttcatgaagggccgcaccgtcatcggcaccccagatgaggagaccatggacatcgagctgcccaagaagtaccacgagatggtgggcgtcatcttcagtgacaccttctcctaccgcctgaagttcaactggggctaccgcatccctgtgatcaaggagcacagcgagtacacagagcactgctgggccatgcatggagagatcttctgctacctggccaagtactggctgaagggctttgtggccttccaggccgccatcaatgctgccatcatcgaggtgaccaccaaccacagcgtgatggaggagctgaccagcgtcatcggcatcaacatgaagatcccccccttcatcagcaagggggagatcatgaatgagtggttccacttcacctgcctggtgtccttcagcagcttcatctactttgccagcctgaatgtggcccgggagcggggcaagttcaagaagctgatgacagtgatgggcctgcgggagagcgccttctggctgtcctggggcctgacctacatctgcttcatcttcatcatgagcatcttcatggccctggtgatcaccagcatccccatcgtgttccacacaggcttcatggtgatcttcaccctgtacagcctgtatggcctgagcctgattgccctggccttcctgatgtctgtgctgatcaggaagcccatgctggccggcctggccggcttcctgttcaccgtcttctggggctgcctgggcttcaccgtgctgtaccggcagctgcccctgagcctgggctgggtgctgagcctgctgagcccctttgccttcaccgctggcatggcccagatcacccacctggacaactacctgtctggagtcatcttcccagaccccagcggggacagctacaagatgattgccaccttcttcatcctggcctttgacaccctcttctacctgatcttcaccctgtactttgagcgggtgctgcctgacaaggatggccacggggacagccccctcttcttcctgaagagcagcttctggagcaagcaccagaacacccaccacgagatctttgaaaatgagatcaaccctgagcacagcagtgatgacagctttgagcctgtgtccccagagttccacggcaaggaggccatccgcatcagaaatgtcatcaaggagtacaacgggaagacaggcaaggtggaggccctgcagggcagcgaggagcggctgtgcccagctgcccaccggctgcgctgtggggagcggctgtgcccagctgcccaccacctgggctgtgaggagcggccctgcccagctgccacccccagcggcaactag

SEQ ID NO: 144547 - DNA, 7788 bp, Artificial Sequence
  Description of Artificial Sequence: Synthetic coding sequence
atggccagcctcttccaccagctgcagatcctggtgtggaagaactggctgggcgtgaagaggcagcccctgtggaccctggtgctgatcctgtggcctgtgatcatcttcatcatcctggccatcaccaggaccaagttccccccaacagccaagcccacctgctacctggcccccaggaacctgcccagcacaggcttcttccccttcctgcagaccctgctgtgtgacacagacagcaagtgcaaggacaccccctacggcccccaggacctgctgcggaggaagggcattgatgatgccctcttcaaggacagcgagatcctgaggaagagcagcaacctggacaaggacagcagcctgtccttccagagcacccaggtgcctgagaggagacatgccagcctggccaccgtcttccccagccccagcagtgacctggagatccctggcacctacaccttcaacggcagccaggtgctggcccgcatcctgggcctggagaagctgctgaagcagaacagcaccagcgaggacatcagaagagagctgtgtgacagctacagcggctacatcgtggatgatgccttctcctggaccttcctgggcagaaatgtgttcaacaagttctgcctgagcaacatgaccctgctggagagcagcctgcaggagctgaacaagcagttcagccagctgagcagtgaccccaacaaccagaagatcgtgttccaggagatcgtgaggatgctgtccttcttcagccaggtgcaggagcagaaggctgtgtggcagctgctgagcagcttccccaacgtgttccagaatgacaccagcctgagcaacctgtttgatgtgctgaggaaggccaacagcgtgctgctggtggtgcagaaggtgtaccccaggtttgccaccaatgaaggcttccgcaccctgcagaagtctgtgaagcacctgctgtacaccctggacagccctgcccagggcgacagcgacaacatcacccacgtgtggaatgaagatgatggccagaccctgagccccagcagcctggccgcccagctgctgatcctggagaactttgaagatgccctgctgaacatcagcgccaacagcccctacatcccctacctggcctgtgtgagaaatgtgacagacagcctggcccggggcagccctgagaacctgcggctgctgcagagcaccatccgcttcaagaagagcttcctgagaaatggcagctatgaggactacttcccccctgtgcctgaggtgctgaagagcaagctgagccagctgaggaacctgacagagctgctgtgtgagagcgagaccttcagcctgattgagaagagctgccagctgagtgacatgagctttggcagcctgtgtgaggagagcgagtttgacctgcagctgctggaggccgctgagctgggcacagaaattgctgccagcctgctgtaccatgacaacgtcatcagcaagaaggtgcgggacctgctgactggagaccccagcaagatcaacctgaacatggaccagttcctggagcaggccctgcagatgaactacctggagaacatcacccagctgatccccatcatcgaggccatgctgcacgtgaacaacagcgcagatgccagcgagaagccaggccagctgctggagatgttcaagaatgtggaggagctgaaggaggacctgcggaggaccaccggcatgagcaacagaaccatcgacaagctgctggccatccccatcccagacaacagagctgagatcatcagccaggtgttctggctgcacagctgtgacaccaacatcaccacccccaagctggaggatgccatgaaggagttctgcaacctgagcctgtctgagaggagccggcagagctacctgattggcctgaccctgctgcactacctgaacatctacaacttcacctacaaggtgttcttccccaggaaggaccagaagcctgtggagaagatgatggagctgttcatccggctgaaggagatcctgaaccagatggccagcggcacccaccccctgctggacaagatgaggagcctgaagcagatgcacctgcccaggtctgtgcccctgacccaggccatgtaccgcagcaacaggatgaacaccccccagggcagcttcagcaccatcagccaggccctgtgcagccagggcatcaccacagagtacctgacagccatgctgcccagcagccagaggcccaagggcaaccacaccaaggacttcctgacctacaagctgaccaaggagcagatcgccagcaaatatggcatccccatcaacagcacccccttctgcttcagcctgtacaaggacatcatcaacatgcctgctggccctgtgatctgggccttcctgaagcccatgctgctgggccgcatcctgtatgccccctacaaccctgtgaccaaggccatcatggagaagagcaatgtgaccctgcggcagctggccgagctgcgggagaagagccaggagtggatggacaagagccccctcttcatgaacagcttccacctgctgaaccaggccatccccatgctgcagaacaccctgaggaacccctttgtgcaggtgtttgtgaagttctctgtgggcctggatgctgtggagctgctgaagcagattgatgagctggacatcctgcggctgaagctggagaacaacatcgacatcatcgaccagctgaacaccctgagcagcctgactgtgaacatcagcagctgtgtgctgtatgaccgcatccaggccgccaagaccattgatgagatggagcgggaggccaagaggctgtacaagagcaatgagctgtttggatctgtcatcttcaagctgcccagcaacagatcctggcaccggggctatgacagcggaaatgtgttcctgccccctgtgatcaagtacaccatccgcatgagcctgaagacagcccagaccaccaggagcctgcggaccaagatctgggcccctggcccccacaacagccccagccacaaccagatctacggccgggccttcatctacctgcaggacagcattgaaagagccatcatcgagctgcagacaggaagaaacagccaggagattgctgtgcaggtgcaggccatcccctacccctgcttcatgaaggacaacttcctgacctctgtgtcctacagcctgcccatcgtgctgatggtggcctgggtggtgttcatcgccgcctttgtgaagaagctggtgtatgagaaggacctgcggctgcacgagtacatgaagatgatgggcgtgaacagctgcagccacttctttgcctggctgattgagagcgtgggcttcctgctggtgaccatcgtcatcctgatcatcatcctgaagtttggaaacatcctgcccaagaccaacggcttcatcctcttcctgtacttcagtgactacagcttctctgtgattgccatgagctacctgatcagcgtcttcttcaacaacaccaacattgctgccctgattggcagcctcatctacatcatcgccttcttccccttcatcgtgctggtgacagtggagaatgagctgtcctatgtgctgaaggtgttcatgagcctgctgagccccacagccttctcctatgccagccagtacatcgcccgctatgaggagcagggcatcggcctgcagtgggagaacatgtacaccagccctgtgcaggatgacaccaccagctttggctggctgtgctgcctgatcctggccgacagcttcatctacttcctgattgcctggtacgtgagaaatgtgtttcctggcacctacggcatggccgccccctggtacttccccatcctgcccagctactggaaggagcgcttcggctgtgccgaggtgaagccagagaagagcaatggcctgatgttcaccaacatcatgatgcagaacaccaaccccagcgccagccctgagtacatgttcagcagcaacatcgagcctgagcccaaggacctgactgtgggcgtggccctgcatggagtgaccaagatctacggcagcaaggtggccgtggacaacctgaacctgaacttctatgagggccacatcaccagcctgctgggccccaacggggccggcaagaccaccaccatctccatgctgaccggcctgtttggagccagcgctggcaccatctttgtgtatggcaaggacatcaagacagacctgcacacagtgaggaagaacatgggcgtgtgcatgcagcatgatgtgctcttctcctacctgaccaccaaggagcacctgctgctgtatggcagcatcaaggtgccccactggaccaagaagcagctgcacgaggaggtgaagaggaccctgaaggacaccggcctgtacagccaccgccacaagagggtgggcaccctgagcggcggcatgaagaggaagctgagcatcagcatcgccctgattggaggcagccgggtggtgatcctggatgagcccagcactggagtggacccctgcagccgccgcagcatctgggatgtgatcagcaagaacaagacagcccggaccatcatcctgagcacccaccacctggatgaggccgaggtgctgagtgacagaattgccttcctggagcagggcggcctgcgctgctgcggcagccccttctacctgaaggaggcctttggagatggctaccacctgaccctgaccaagaagaagagccccaacctgaatgccaatgctgtgtgtgacaccatggctgtgacagccatgatccagagccacctgcctgaggcctacctgaaggaggacatcggcggggagctggtgtatgtgctgccccccttcagcaccaaggtgtctggggcctacctgagcctgctgcgggccctggacaatggcatgggagacctgaacatcggctgctacggcatcagtgacaccaccgtggaggaggtgttcctgaacctgaccaaggagagccagaagaacagcgccatgagcctggagcacctgacccagaagaagattggcaacagcaatgccaacggcatcagcaccccagatgacctgtctgtgagcagcagcaacttcacagacagagatgacaagatcctgaccagaggagagcggctggatggcttcggcctgctgctgaagaagatcatggccatcctgatcaagcgcttccaccacaccaggaggaactggaagggcctcatcgcccaggtgatcctgcccatcgtgtttgtgaccacagccatgggcctgggcaccctgaggaacagcagcaacagctacccagagatccagatcagccccagcctgtatggcaccagcgagcagacagccttctacgccaactaccaccccagcacagaggccctggtgtctgccatgtgggacttccctggcatcgacaacatgtgcctgaacaccagtgacctgcagtgcctgaacaaggacagcctggagaagtggaacaccagcggggagcccatcaccaactttggagtgtgcagctgcagtgaaaatgtgcaggagtgccccaagttcaactacagccccccccacaggaggacctacagcagccaggtgatctacaacctgaccggccagagggtggagaactacctgatcagcacagccaatgaatttgtgcagaagagatatggaggctggagctttggcctgcccctgaccaaggacctgcgctttgacatcaccggggtgcctgccaacagaaccctggccaaggtgtggtatgaccctgagggctaccacagcctgcctgcctacctgaacagcctgaacaacttcctgctgcgggtgaacatgagcaaatatgatgctgcccggcacggcatcatcatgtacagccacccctacccaggagtgcaggaccaggagcaggccaccatcagcagcctgattgacatcctggtggccctgagcatcctgatgggctacagcgtgaccacagccagctttgtgacctacgtggtgcgggagcaccagaccaaggccaagcagctgcagcacatctctggaattggagtgacctgctactgggtgaccaacttcatctatgacatggtgttctacctggtgcctgtggccttcagcatcggcatcatcgccatcttcaagctgcctgccttctacagcgagaacaacctgggcgctgtgtccctgctgctgctgctgtttggctacgccaccttctcctggatgtacctgctggccggcctcttccatgaaacaggcatggccttcatcacctacgtgtgtgtgaacctcttcttcggcatcaacagcatcgtgtccctgtctgtggtgtacttcctgagcaaggagaagcccaatgaccccaccctggagctgatcagcgagaccctgaagaggatcttcctgatcttcccccagttctgcttcggctacggcctgattgagctgagccagcagcagagcgtgctggacttcctgaaggcctacggcgtggagtacccaaatgagacctttgagatgaacaagctgggcgccatgtttgtggccctggtgtcccagggcaccatgttcttcagcctgcggctgctgatcaatgaaagcctcatcaagaagctgcggctcttcttcaggaagttcaacagcagccacgtgcgggagaccattgatgaagatgaagatgtgcgggcagagcggctgcgggtggagagcggggctgctgagtttgacctggtgcagctgtactgcctgaccaagacctaccagctgatccacaagaagatcatcgctgtgaacaacatcagcatcggcatcccagctggggagtgcttcggcctgctgggcgtgaatggagctgggaagaccaccatcttcaagatgctgaccggggacatcatccccagcagcggcaacatcctgatccggaacaagacaggcagcctgggccacgtggacagccacagcagcctggtgggctactgcccccaggaggatgccctggatgacctggtgacagtggaggagcacctgtacttctacgcccgggtgcacggcatccctgagaaggacatcaaggagaccgtgcacaagctgctgcggcggctgcacctgatgcccttcaaggaccgggccacctccatgtgcagctatggcaccaagaggaagctgagcacagccctggccctgattggcaagcccagcatcctgctgctggatgagcccagcagcggcatggaccccaagagcaagaggcacctgtggaagatcatcagcgaggaggtgcagaacaagtgcagcgtcatcctgaccagccacagcatggaggagtgtgaggccctgtgcacccggctggccatcatggtgaatggcaagttccagtgcatcggcagcctgcagcacatcaagagccgcttcggccggggcttcaccgtgaaggtgcacctgaagaacaacaaggtgaccatggagaccctgaccaagttcatgcagctgcacttccccaagacctacctgaaggaccagcacctgtccatgctggagtaccacgtgcctgtgacagctggaggagtggccaacatctttgacctgctggagaccaacaagacagccctgaacatcaccaacttcctggtgtcccagaccaccctggaggaggtgttcatcaactttgccaaggaccagaagagctatgaaacagctgacaccagcagccagggcagcaccatctctgtggacagccaggatgaccagatggagagctag

SEQ ID NO: 144548 - DNA, 6834 bp, Artificial Sequence
  Description of Artificial Sequence: Synthetic coding sequence
atgttcacctacatcaagatcatcaccagcggggacagcgacaacatcacccacgtgtggaatgaagatgatggccagaccctgagccccagcagcctggccgcccagctgctgatcctggagaactttgaagatgccctgctgaacatcagcgccaacagcccctacatcccctacctggcctgtgtgagaaatgtgacagacagcctggcccggggcagccctgagaacctgcggctgctgcagagcaccatccgcttcaagaagagcttcctgagaaatggcagctatgaggactacttcccccctgtgcctgaggtgctgaagagcaagctgagccagctgaggaacctgacagagctgctgtgtgagagcgagaccttcagcctgattgagaagagctgccagctgagtgacatgagctttggcagcctgtgtgaggagagcgagtttgacctgcagctgctggaggccgctgagctgggcacagaaattgctgccagcctgctgtaccatgacaacgtcatcagcaagaaggtgcgggacctgctgactggagaccccagcaagatcaacctgaacatggaccagttcctggagcaggccctgcagatgaactacctggagaacatcacccagctgatccccatcatcgaggccatgctgcacgtgaacaacagcgcagatgccagcgagaagccaggccagctgctggagatgttcaagaatgtggaggagctgaaggaggacctgcggaggaccaccggcatgagcaacagaaccatcgacaagctgctggccatccccatcccagacaacagagctgagatcatcagccaggtgttctggctgcacagctgtgacaccaacatcaccacccccaagctggaggatgccatgaaggagttctgcaacctgagcctgtctgagaggagccggcagagctacctgattggcctgaccctgctgcactacctgaacatctacaacttcacctacaaggtgttcttccccaggaaggaccagaagcctgtggagaagatgatggagctgttcatccggctgaaggagatcctgaaccagatggccagcggcacccaccccctgctggacaagatgaggagcctgaagcagatgcacctgcccaggtctgtgcccctgacccaggccatgtaccgcagcaacaggatgaacaccccccagggcagcttcagcaccatcagccaggccctgtgcagccagggcatcaccacagagtacctgacagccatgctgcccagcagccagaggcccaagggcaaccacaccaaggacttcctgacctacaagctgaccaaggagcagatcgccagcaaatatggcatccccatcaacagcacccccttctgcttcagcctgtacaaggacatcatcaacatgcctgctggccctgtgatctgggccttcctgaagcccatgctgctgggccgcatcctgtatgccccctacaaccctgtgaccaaggccatcatggagaagagcaatgtgaccctgcggcagctggccgagctgcgggagaagagccaggagtggatggacaagagccccctcttcatgaacagcttccacctgctgaaccaggccatccccatgctgcagaacaccctgaggaacccctttgtgcaggtgtttgtgaagttctctgtgggcctggatgctgtggagctgctgaagcagattgatgagctggacatcctgcggctgaagctggagaacaacatcgacatcatcgaccagctgaacaccctgagcagcctgactgtgaacatcagcagctgtgtgctgtatgaccgcatccaggccgccaagaccattgatgagatggagcgggaggccaagaggctgtacaagagcaatgagctgtttggatctgtcatcttcaagctgcccagcaacagatcctggcaccggggctatgacagcggaaatgtgttcctgccccctgtgatcaagtacaccatccgcatgagcctgaagacagcccagaccaccaggagcctgcggaccaagatctgggcccctggcccccacaacagccccagccacaaccagatctacggccgggccttcatctacctgcaggacagcattgaaagagccatcatcgagctgcagacaggaagaaacagccaggagattgctgtgcaggtgcaggccatcccctacccctgcttcatgaaggacaacttcctgacctctgtgtcctacagcctgcccatcgtgctgatggtggcctgggtggtgttcatcgccgcctttgtgaagaagctggtgtatgagaaggacctgcggctgcacgagtacatgaagatgatgggcgtgaacagctgcagccacttctttgcctggctgattgagagcgtgggcttcctgctggtgaccatcgtcatcctgatcatcatcctgaagtttggaaacatcctgcccaagaccaacggcttcatcctcttcctgtacttcagtgactacagcttctctgtgattgccatgagctacctgatcagcgtcttcttcaacaacaccaacattgctgccctgattggcagcctcatctacatcatcgccttcttccccttcatcgtgctggtgacagtggagaatgagctgtcctatgtgctgaaggtgttcatgagcctgctgagccccacagccttctcctatgccagccagtacatcgcccgctatgaggagcagggcatcggcctgcagtgggagaacatgtacaccagccctgtgcaggatgacaccaccagctttggctggctgtgctgcctgatcctggccgacagcttcatctacttcctgattgcctggtacgtgagaaatgtgtttcctggcacctacggcatggccgccccctggtacttccccatcctgcccagctactggaaggagcgcttcggctgtgccgaggtgaagccagagaagagcaatggcctgatgttcaccaacatcatgatgcagaacaccaaccccagcgccagccctgagtacatgttcagcagcaacatcgagcctgagcccaaggacctgactgtgggcgtggccctgcatggagtgaccaagatctacggcagcaaggtggccgtggacaacctgaacctgaacttctatgagggccacatcaccagcctgctgggccccaacggggccggcaagaccaccaccatctccatgctgaccggcctgtttggagccagcgctggcaccatctttgtgtatggcaaggacatcaagacagacctgcacacagtgaggaagaacatgggcgtgtgcatgcagcatgatgtgctcttctcctacctgaccaccaaggagcacctgctgctgtatggcagcatcaaggtgccccactggaccaagaagcagctgcacgaggaggtgaagaggaccctgaaggacaccggcctgtacagccaccgccacaagagggtgggcaccctgagcggcggcatgaagaggaagctgagcatcagcatcgccctgattggaggcagccgggtggtgatcctggatgagcccagcactggagtggacccctgcagccgccgcagcatctgggatgtgatcagcaagaacaagacagcccggaccatcatcctgagcacccaccacctggatgaggccgaggtgctgagtgacagaattgccttcctggagcagggcggcctgcgctgctgcggcagccccttctacctgaaggaggcctttggagatggctaccacctgaccctgaccaagaagaagagccccaacctgaatgccaatgctgtgtgtgacaccatggctgtgacagccatgatccagagccacctgcctgaggcctacctgaaggaggacatcggcggggagctggtgtatgtgctgccccccttcagcaccaaggtgtctggggcctacctgagcctgctgcgggccctggacaatggcatgggagacctgaacatcggctgctacggcatcagtgacaccaccgtggaggaggtgttcctgaacctgaccaaggagagccagaagaacagcgccatgagcctggagcacctgacccagaagaagattggcaacagcaatgccaacggcatcagcaccccagatgacctgtctgtgagcagcagcaacttcacagacagagatgacaagatcctgaccagaggagagcggctggatggcttcggcctgctgctgaagaagatcatggccatcctgatcaagcgcttccaccacaccaggaggaactggaagggcctcatcgcccaggtgatcctgcccatcgtgtttgtgaccacagccatgggcctgggcaccctgaggaacagcagcaacagctacccagagatccagatcagccccagcctgtatggcaccagcgagcagacagccttctacgccaactaccaccccagcacagaggccctggtgtctgccatgtgggacttccctggcatcgacaacatgtgcctgaacaccagtgacctgcagtgcctgaacaaggacagcctggagaagtggaacaccagcggggagcccatcaccaactttggagtgtgcagctgcagtgaaaatgtgcaggagtgccccaagttcaactacagccccccccacaggaggacctacagcagccaggtgatctacaacctgaccggccagagggtggagaactacctgatcagcacagccaatgaatttgtgcagaagagatatggaggctggagctttggcctgcccctgaccaaggacctgcgctttgacatcaccggggtgcctgccaacagaaccctggccaaggtgtggtatgaccctgagggctaccacagcctgcctgcctacctgaacagcctgaacaacttcctgctgcgggtgaacatgagcaaatatgatgctgcccggcacggcatcatcatgtacagccacccctacccaggagtgcaggaccaggagcaggccaccatcagcagcctgattgacatcctggtggccctgagcatcctgatgggctacagcgtgaccacagccagctttgtgacctacgtggtgcgggagcaccagaccaaggccaagcagctgcagcacatctctggaattggagtgacctgctactgggtgaccaacttcatctatgacatggtgttctacctggtgcctgtggccttcagcatcggcatcatcgccatcttcaagctgcctgccttctacagcgagaacaacctgggcgctgtgtccctgctgctgctgctgtttggctacgccaccttctcctggatgtacctgctggccggcctcttccatgaaacaggcatggccttcatcacctacgtgtgtgtgaacctcttcttcggcatcaacagcatcgtgtccctgtctgtggtgtacttcctgagcaaggagaagcccaatgaccccaccctggagctgatcagcgagaccctgaagaggatcttcctgatcttcccccagttctgcttcggctacggcctgattgagctgagccagcagcagagcgtgctggacttcctgaaggcctacggcgtggagtacccaaatgagacctttgagatgaacaagctgggcgccatgtttgtggccctggtgtcccagggcaccatgttcttcagcctgcggctgctgatcaatgaaagcctcatcaagaagctgcggctcttcttcaggaagttcaacagcagccacgtgcgggagaccattgatgaagatgaagatgtgcgggcagagcggctgcgggtggagagcggggctgctgagtttgacctggtgcagctgtactgcctgaccaagacctaccagctgatccacaagaagatcatcgctgtgaacaacatcagcatcggcatcccagctggggagtgcttcggcctgctgggcgtgaatggagctgggaagaccaccatcttcaagatgctgaccggggacatcatccccagcagcggcaacatcctgatccggaacaagacaggcagcctgggccacgtggacagccacagcagcctggtgggctactgcccccaggaggatgccctggatgacctggtgacagtggaggagcacctgtacttctacgcccgggtgcacggcatccctgagaaggacatcaaggagaccgtgcacaagctgctgcggcggctgcacctgatgcccttcaaggaccgggccacctccatgtgcagctatggcaccaagaggaagctgagcacagccctggccctgattggcaagcccagcatcctgctgctggatgagcccagcagcggcatggaccccaagagcaagaggcacctgtggaagatcatcagcgaggaggtgcagaacaagtgcagcgtcatcctgaccagccacagcatggaggagtgtgaggccctgtgcacccggctggccatcatggtgaatggcaagttccagtgcatcggcagcctgcagcacatcaagagccgcttcggccggggcttcaccgtgaaggtgcacctgaagaacaacaaggtgaccatggagaccctgaccaagttcatgcagctgcacttccccaagacctacctgaaggaccagcacctgtccatgctggagtaccacgtgcctgtgacagctggaggagtggccaacatctttgacctgctggagaccaacaagacagccctgaacatcaccaacttcctggtgtcccagaccaccctggaggaggtgttcatcaactttgccaaggaccagaagagctatgaaacagctgacaccagcagccagggcagcaccatctctgtggacagccaggatgaccagatggagagctag

SEQ ID NO: 144549 - DNA, 15177 bp, Artificial Sequence
  Description of Artificial Sequence: Synthetic coding sequence
atgggccacgccggctgccagttcaaggccctgctgtggaagaactggctgtgccgcctgagaaatcctgtgctcttcctggccgagttcttctggccctgcatcctgtttgtgatcctgactgtgctgcgcttccaggagcccccacgctacagagacatctgctacctgcagccccgggacctgcccagctgtggggtcatcccctttgtgcagagcctgctgtgcaacacaggcagccgctgcaggaacttctcctatgagggctccatggagcaccacttccggctgagccgcttccagacagctgctgaccccaagaaggtgaacaacctggccttcctgaaggagatccaggacctggccgaggagatccacggcatgatggacaaggccaagaacctgaagaggctgtgggtggagaggagcaacaccccagacagcagctatggcagcagcttcttcaccatggacctgaacaagacagaggaggtgatcctgaagctggagagcctgcaccagcagccccacatctgggacttcctgctgctgctgccccggctgcacaccagccatgaccacgtggaggatggcatggatgtggccgtgaacctgctgcagaccatcctgaacagcctcatcagcctggaggacctggactggctgcccctgaaccagaccttcagccaggtgtctgagctggtgctgaatgtgaccatcagcaccctgaccttcctgcagcagcacggcgtggccgtgacagagcctgtgtaccacctgtccatgcagaacatcgtgtgggacccccagaaggtgcagtatgacctgaagagccagtttggatttgatgacctgcacacagagcagatcctgaacagcagcgctgagctgaaggagatccccacagacaccagcctggagaagatggtgtgcagcgtgctgagcagcaccagtgaagatgaggccgagaagtggggccacgtgggcggctgccaccccaagtggagcgaggccaagaactacctggtgcatgctgtgtcctggctgcgggtgtaccagcaggtgtttgtgcagtggcagcagggcagcctgctgcagaagaccctgaccggcatgggccacagcctggaggccctgaggaaccagtttgaggaggagagcaagccctggaaggtggtggaggccctgcacacagccctgctgctgctgaatgacagcctgtctgcagatggccccaaggacaaccacaccttccccaagatcctgcagcacctgtggaagctgcagagcctgctgcagaacctgccccagtggccagccctgaagcgcttcctgcagctggatggagccctgagaaatgccatcgcccagaacctgcactttgtgcaggaggtgctgatctgcctggagaccagcgccaatgacttcaagtggtttgagctgaaccagctgaagctggagaaggatgtgttcttctgggagctgaagcagatgctggccaagaatgctgtgtgccccaacggccgcttcagcgagaaggaggtgttcctgcccccaggcaacagcagcatctggggcggcctgcagggcctgctgtgctactgcaacagcagcgagacctctgtgctgaacaagctgctgggctctgtggaggatgctgaccgcatcctgcaggaggtgatcacctggcacaagaacatgtctgtgctgatccctgaggagtacctggactggcaggagctggagatgcagctgtctgaggccagcctgagctgcaccaggctcttcctgctgctgggcgctgaccccagcccagaaaatgatgtgttcagcagtgactgcaagcaccagctggtgtccaccgtcatcttccacaccctggagaagacccagttcttcctggagcaggcctactactggaaggccttcaagaagttcatcaggaagacctgtgaggtggcccagtatgtgaacatgcaggagagcttccagaaccggctgctggccttccctgaggagagcccctgctttgaggagaacatggactggaagatgatcagtgacaactacttccagttcctgaacaacctgctgaagagccccacagccagcatcagccgggccctgaacttcaccaagcacctgctgatgatggagaagaagctgcacaccctggaggatgagcagatgaacttcctgctgagctttgtggagttctttgagaagctgctgctgcccaacctgtttgacagcagcatcgtgcccagcttccacagcctgcccagcctgacagaggacatcctgaacatcagcagcctgtggaccaaccacctgaagagcctgaagagggaccccagcgccacagatgcccagaagctgctggagtttggaaatgaggtgatctggaagatgcagaccctgggcagccactggatcaggaaggagcccaagaacctgctgcgcttcatcgagctgatcctgtttgagatcaaccccaagctgctggagctgtgggcctacggcatcagcaagggcaagagggccaagctggagaacttcttcaccctgctgaacttctctgtgcctgaaaatgagatcctgagcaccagcttcaacttcagccagctgttccacagcgactggcccaagagccctgccatgaacatcgactttgtgcggctgtctgaggccatcatcaccagcctgcatgaatttggcttcctggagcaggagcagatcagcgaggccctgaacacagtgtatgccatcagaaatgccagtgacctcttcagcgccctgtctgagccccagaagcaggaggtggacaagatcctgacccacatccacctgaatgtgttccaggacaaggacagcgccctgctgctgcagatctacagcagcttctaccgctacatctatgagctgctgaacatccagagccggggcagcagcctgaccttcctgacccagatcagcaagcacatcctggacatcatcaagcagttcaacttccagaacatcagcaaggcctttgccttcctgttcaagacagctgaggtgctgggcggcatcagcaatgtgtcctactgccagcagctgctgagcatcttcaacttcctggagctgcaggcccagagcttcatgagcacagagggccaggagctggaggtgatccacaccaccctgaccggcctgaagcagctgctgatcattgatgaggacttccgcatcagcctcttccagtacatgagccagttcttcaacagctctgtggaggacctgctggacaacaagtgcctgatcagtgacaacaagcacatcagctctgtgaactacagcaccagcgaggagagcagctttgtgttccccctggcccagatcttcagcaacctgagcgccaacgtgtctgtgttcaacaagttcatgagcatccactgcaccgtgtcctggctgcagatgtggacagagatctgggagaccatcagccagctgttcaagtttgacatgaatgtgttcaccagcctgcaccacggcttcacccagctgctggatgagctggaggatgatgtgaaggtgtccaagagctgccagggcatcctgcccacccacaacgtggcccggctcatcctgaacctcttcaagaatgtgacccaggccaatgacttccacaactgggaggacttcctggacctgcgggacttcctggtggccctgggcaatgccctggtgtctgtgaagaagctgaacctggagcaggtggagaagagcctcttcaccatggaggccgccctgcaccagctgaagaccttccccttcaatgaaagcaccagccgggagttcctgaacagcctgctggaggtgttcatcgagttcagcagcaccagcgagtacatcgtgaggaacctggacagcatcaatgacttcctgagcaacaacctgaccaactacggggagaagtttgagaacatcatcacagagctgcgggaggccatcgtgttcctgagaaatgtgtcccatgaccgggacctcttcagctgtgccgacatcttccagaatgtgacagagtgcatcctggaggatggcttcctgtatgtgaacaccagccagaggatgctgcgcatcctggacaccctgaacagcaccttcagcagcgagaacaccatcagcagcctgaagggctgcatcgtgtggctggatgtgatcaaccacctgtacctgctgagcaacagcagcttcagccagggccacctgcagaacatcctgggcaacttccgggacatcgagaacaagatgaacagcatcctgaagatcgtgacctgggtgctgaacatcaagaagcccctgtgcagcagcaatggcagccacatcaactgtgtgaacatctacctgaaggatgtgacagacttcctgaacatcgtgctgaccaccgtgtttgagaaggagaagaagcccaagtttgagatcctgctggccctgctgaatgacagcaccaagcaggtgaggatgagcatcaacaacctgaccacagactttgattttgccagccagagcaactggagatacttcacagagctgatcctgcggcccatcgagatgtctgatgagatccccaaccagttccagaacatctggctgcacctgatcaccctgggcaaggagttccagaagctggtgaagggcatctacttcaacatcctggagaacaacagcagcagcaagacagagaacctgctgaacatctttgccaccagccccaaggagaaggatgtgaacagcgtgggcaacagcatctaccacctggccagctacctggccttcagcctgagccatgacctgcagaacagccccaagatcatcatcagccctgagatcatgaaggccaccggcctgggcatccagctgatcagagatgtgttcaacagcctgatgcctgtggtgcaccacaccagcccccagaatgccggctacatgcaggccctgaagaaggtgacctctgtgatgaggaccctgaagaaggctgacatcgacctgctggtggaccagctggagcaggtgtctgtgaacctgatggacttcttcaagaacatcagctctgtgggcactggaaacctggtggtgaacctgctggtgggcctgatggagaagtttgctgacagcagccacagctggaatgtgaaccacctgctgcagctgagccgcctcttccccaaggatgtggtggatgctgtgattgatgtgtactacgtgctgccccatgctgtgcggctgctgcagggcgtgcctgggaagaacatcacagagggcctgaaggatgtgtacagcttcaccctgctgcacggcatcaccatcagcaacatcaccaaggaggactttgccatcgtcatcaagatcctgctggacaccatcgagctggtgtctgacaagccagacatcatcagcgaggccctggcctgcttccctgtggtgtggtgctggaaccacaccaacagcggcttccggcagaacagcaagattgacccctgcaatgtgcacggcctgatgagcagcagcttctacggcaaggtggccagcatcctggaccacttccacctgagcccccagggcgaggacagcccctgcagcaatgaaagcagcaggatggagatcaccaggaaggtggtgtgcatcatccacgagctggtggactggaacagcatcctgctggagctgtctgaggtgttccacgtgaacatcagcctggtgaagacagtgcagaagttctggcacaagatcctgccctttgtgcccccatccatcaaccagacccgggacagcatcagcgagctgtgccccagcggcagcatcaagcaggtggccctgcagatcatcgagaagctgaagaatgtgaacttcaccaaggtgaccagcggggagaacatcctggacaagctgagcagcctgaacaagatcctgaacatcaatgaagacacagagacctctgtgcagaacatcatcagcagcaacctggagaggacagtgcagctgatcagcgaggactggagcctggagaagagcacccacaacctgctgagcctcttcatgatgctgcagaatgccaacgtgacaggcagcagcctggaggccctgagcagcttcatcgagaagtctgagaccccctacaactttgaggagctgtggcccaagttccagcagatcatgaaggacctgacccaggacttccgcatccgccacctgctgtctgagatgaacaagggcatcaagagcatcaacagcatggccctgcagaagatcaccctgcagtttgcccacttcctggagatcctggacagccccagcctgaagaccctggagatcatcgaggacttcctgctggtgaccaagaactggctgcaggagtatgccaatgaagactacagcaggatgattgagaccctcttcatccctgtgaccaatgaaagcagcacagaggacatcgccctgctggccaaggccatcgccaccttctggggcagcctgaagaacatcagccgggccggcaactttgatgtggccttcctgacccacctgctgaaccaggagcagctgaccaacttctctgtggtgcagctgctgtttgagaacatcctgatcaacctgatcaacaacctggccggcaacagccaggaggccgcctggaacctgaatgacacagacctgcagatcatgaacttcatcaacctgatcctgaaccacatgcagagcgagaccagcaggaagacagtgctgagcctgcggagcatcgtggacttcacagagcagttcctgaagaccttcttcagcctcttcctgaaggaggacagcgagaacaagatcagcctgctgctgaagtacttccacaaggatgtgattgctgagatgagctttgtgcccaaggacaagatcctggagatcctgaagctggaccagttcctgaccctgatgatccaggaccggctgatgaacatcttcagcagcctgaaggagaccatctaccacctgatgaagagcagcttcatcctggacaacggggagttctactttgacacccaccagggcctgaagttcatgcaggacctcttcaatgccctgctgcgggagacctccatgaagaacaagacagagaacaacatcgacttcttcaccgtggtgtcccagctgttcttccacgtgaacaagtctgaggacctcttcaagctgaaccaggacctgggcagcgccctgcacctggtgcgggagtgcagcacagagatggcccggctgctggacaccatcctgcacagccccaacaaggacttctacgccctgtaccccaccctgcaggaggtgatcctggccaacctgacagacctgctcttcttcatcaacaacagcttccccctgaggaacagagccaccctggagatcaccaagaggctggtgggcgccatcagccgggccagcgaggagagccacgtgctgaagcccctgctggagatgagcggcaccctggtgatgctgctgaatgattctgctgacctgcgggacctggccacctccatggacagcatcgtgaagctgctgaagctggtgaagaaggtgtctgggaagatgagcaccgtcttcaagacccacttcatcagcaacaccaaggacagcgtgaagttctttgacaccctgtacagcatcatgcagcagagcgtgcagaacctggtgaaggagatcgccaccctgaagaagattgaccacttcacctttgagaagatcaatgacctgctggtgcccttcctggacctggcctttgagatgattggagtggagccctacatcagcagcaacagcgacatcttctccatgagccccagcatcctgagctacatgaaccagagcaaggacttcagtgacatcctggaggagattgctgagttcctgacctctgtgaagatgaacctggaggacatgaggagcctggccgtggccttcaacaatgagacccagaccttctccatggacagcgtgaacctgcgggaggagatcctgggctgcctggtgcccatcaacaacatcaccaaccagatggacttcctgtaccccaaccccatcagcacccacagcggcccccaggacatcaagtgggagatcatccacgaggtgatccccttcctggacaagatcctgagccagaacagcacagaaattggcagcttcctgaagatggtgatctgcctgaccctggaggccctgtggaagaacctgaagaaggacaactggaatgtgtccaatgtgctgatgaccttcacccagcaccccaacaacctgctgaagaccattgaaacagtgctggaggccagcagcggcatcaagagtgactatgaaggagacctgaacaagagcctgtactttgacacccccctgagccagaacatcacccaccaccagctggagaaggccatccacaacgtgctgagcagaattgccctgtggaggaagggcctgctcttcaacaacagcgagtggatcaccagcaccaggaccctcttccagcccctgtttgagatcttcatcaaggccaccaccgggaagaatgtgaccagcgagaaggaggagaggaccaagaaggagatgattgacttcccctacagcttcaagcccttcttctgcctggagaagtacctgggcggcctgtttgtgctgaccaagtactggcagcagatccccctgacagaccagagcgtggtggagatctgtgaggtgttccagcagacagtgaagcccagcgaggccatggagatgctgcagaaggtgaagatgatggtggtgcgggtgctgaccatcgtggccgagaaccccagctggaccaaggacatcctgtgtgccaccctgagctgcaagcagaatggcatccgccacctgatcctgagcgccatccagggcgtgaccctggcccaggaccacttccaggagattgagaagatctggagcagccccaaccagctgaactgtgagagcctgagcaagaacctgagcagcaccctggagagcttcaagagcagcctggagaatgccaccggccaggactgcaccagccagccccggctggagaccgtgcagcagcacctgtacatgctggccaagagcctggaggagacctggagcagcggcaaccccatcatgaccttcctgagcaacttcaccgtgacagaagatgtgaagatcaaggacctgatgaagaacatcaccaagctgacagaggagctgcggagcagcatccagatcagcaatgagaccatccacagcatcctggaggccaacatcagccacagcaaggtgctcttcagcgccctgactgtggccctgagcgggaaatgtgaccaggagatcctgcacctgctgctgaccttccccaagggggagaagtcctggattgctgctgaggagctgtgcagcctgcccggcagcaaggtgtacagcctgattgtgctgctgagcaggaacctggatgtgcgggccttcatctacaagaccctgatgcccagcgaggccaacggcctgctgaacagcctgctggacatcgtgagcagcctgagcgccctgctggccaaggcccagcacgtgtttgagtacctgcctgagttcctgcacaccttcaagatcacagccctgctggagaccctggacttccagcaggtgtcccagaatgtgcaggcccggagcagcgccttcggcagcttccagtttgtgatgaagatggtgtgcaaggaccaggccagcttcctgagtgacagcaacatgttcatcaacctgccccgggtgaaggagctgctggaggatgacaaggagaagttcaacatccctgaggacagcacccccttctgcctgaagctgtaccaggagatcctgcagctgcccaacggggccctggtgtggaccttcctgaagcccatcctgcacggcaagatcctgtacacccccaacaccccagagatcaacaaggtgatccagaaggccaactacaccttctacatcgtggacaagctgaagaccctgtctgagaccctgctggagatgagcagcctcttccagaggagcggcagcggccagatgttcaaccagctgcaggaggccctgaggaacaagtttgtgaggaactttgtggagaaccagctgcacattgatgtggacaagctgacagagaagctgcagacctatggaggcctgctggatgagatgttcaaccacgccggggccggccgcttccgcttcctgggcagcatcctggtgaacctgagcagctgtgtggccctgaaccgcttccaggccctgcagagcgtggacatcctggagaccaaggcccacgagctgctgcagcagaacagcttcctggccagcatcatcttcagcaacagcctgtttgacaagaacttccgctctgagagcgtgaagctgccccctcatgtgtcctacaccatccgcaccaacgtgctgtacagcgtgaggacagatgtggtgaagaaccccagctggaagttccacccccagaacctgcctgcagatggcttcaagtacaactacgtgtttgcccccctgcaggacatgattgagcgggccatcatcctggtgcagacaggccaggaggccctggagcctgctgcccagacccaggccgccccctacccctgccacaccagtgacctcttcctgaacaacgtgggcttcttcttccccctcatcatgatgctgacctggatggtgtctgtggcctccatggtgaggaagctggtgtatgagcaggagatccagatcgaggagtacatgaggatgatgggcgtgcaccctgtgatccacttcctggcctggttcctggagaacatggctgtgctgaccatcagcagcgccaccctggccatcgtgctgaagaccagcggcatctttgcccacagcaacaccttcatcgtgttcctgttcctgctggactttggcatgtctgtggtgatgctgagctacctgctgagcgccttcttcagccaggccaacacagctgccctgtgcaccagcctggtgtacatgatctccttcctgccctacatcgtgctgctggtgctgcacaaccagctgagctttgtgaaccagaccttcctgtgcctgctgagcaccacagccttcggccagggcgtcttcttcatcaccttcctggagggccaggagaccggcatccagtggaacaacatgtaccaggccctggagcagggcggcatgaccttcggctgggtgtgctggatgatcctgtttgacagcagcctgtacttcctgtgtggctggtacctgagcaacctgatccctggcaccttcggcctgaggaagccctggtacttccccttcaccgccagctactggaagtctgtgggcttcctggtggagaagaggcagtacttcctgagcagcagcctcttcttcttcaatgaaaattttgacaacaagggcagcagcctgcagaaccgggagggggagctggagggcagcgcccctggggtgaccctggtgtctgtgaccaaggagtatgagggccacaaggctgtggtgcaggacctgagcctgaccttctacagagaccagatcacagccctgctgggcaccaatggagctgggaagaccaccatcatctccatgctgaccggcctgcacccccccaccagcggcaccatcatcatcaacgggaagaacctgcagacagacctgagccgggtgaggatggagctgggcgtgtgcccccagcaggacatcctgctggacaacctgactgtgcgggagcacctgctgctgtttgccagcatcaaggccccccagtggaccaagaaggagctgcaccagcaggtgaaccagaccctgcaggatgtggacctgacccagcaccagcacaagcagacccgggccctgagcggcggcctgaagaggaagctgagcctgggcatcgccttcatgggcatgagcaggacagtggtgctggatgagcccaccagcggcgtggacccctgcagccgccacagcctgtgggacatcctgctgaagtaccgggagggccgcaccatcatcttcaccacccaccacctggatgaagctgaggccctgagtgacagagtggccgtgctgcagcacggccgcctgcgctgctgcggcccccccttctgcctgaaggaggcctacggccagggcctgcggctgaccctgacccggcagcccagcgtgctggaggcccatgacctgaaggacatggcctgtgtgaccagcctcatcaagatctacatcccccaggccttcctgaaggacagcagcggcagcgagctgacctacaccatccccaaggacacagacaaggcctgcctgaagggcctcttccaggccctggatgagaacctgcaccagctgcacctgaccggctacggcatcagtgacaccaccctggaggaggtgttcctgatgctgctgcaggacagcaacaagaagagccacatcgccctgggcacagagagcgagctgcagaaccaccggcccaccggccacctgagcggctactgcggcagcctggcccggcctgccaccgtgcagggcgtgcagctgctgcgggcccaggtggccgccatcctggcccggcggctgcggaggaccctgcgggccggcaagagcaccctggccgacctgctgctgcctgtgctgtttgtggccctggccatgggcctcttcatggtgcggcccctggccacagagtacccacccctgcggctgaccccaggccactaccagagagctgagacctacttcttcagcagtggaggagacaacctggacctgaccagggtgctgctgaggaagttccgggaccaggacctgccctgtgccgacctgaacccccggcagaagaacagcagctgctggaggacagaccccttcagccaccctgagttccaggacagctgtggctgcctgaagtgccccaacagaagtgccagcgccccctacctgaccaaccacctgggccacaccctgctgaacctgagcggcttcaacatggaggagtacctgctggcccccagcgagaagccccggctgggcggctggagctttggcctgaagatccccagcgaggccggcggggccaatggaaacatcagcaagccacccaccctggccaaggtgtggtacaaccagaagggcttccacagcctgcccagctacctgaaccacctgaacaacctgatcctgtggcagcacctgccccccaccgtggactggaggcagtatggcatcaccctgtacagccacccctatggaggagccctgctgaacaaggacaagatcctggagagcatccggcagtgtggggtggccctgtgcatcgtgctgggcttcagcatcctgagcgccagcatcggcagctctgtggtgcgggacagagtgattggagccaagaggctgcagcacatcagcggcctgggctacaggatgtactggttcaccaacttcctgtatgacatgctgttctacctggtgtctgtgtgcctgtgtgtggccgtcatcgtggccttccagctgacagccttcaccttcaggaagaacctggccgccacagccctgctgctgagcctgtttggctacgccaccctgccctggatgtacctgatgagccgcatcttcagcagcagtgatgtggccttcatctcctatgtgtccctgaacttcatcttcggcctgtgcaccatgctgatcaccatcatgccccggctgctggccatcatcagcaaggccaagaacctgcagaacatctatgatgtgctgaagtgggtgttcaccatcttcccccagttctgcctgggccagggcctggtggagctgtgctacaaccagatcaagtatgacctgacccacaactttggcatcgacagctatgtgagcccctttgagatgaacttcctgggctggatctttgtgcagctggccagccagggcaccgtgctgctgctgctgcgggtgctgctgcactgggacctgctgcgctggccccggggccacagcaccctgcagggcaccgtgaagagcagcaaggacacagatgtggagaaggaggagaagagggtgtttgagggccgcaccaacggggacatcctggtgctgtacaacctgagcaagcactaccgccgcttcttccagaacatcatcgctgtgcaggacatcagcctgggcatccccaagggggagtgcttcggcctgctgggcgtgaatggagctgggaagagcaccaccttcaagatgctgaatggagaggtgtccctgaccagcggccacgccatcatccgcacccccatgggagatgctgtggacctgagcagcgctggaacagctggggtgctgattggctactgcccccagcaggatgccctggatgagctgctgaccggctgggagcacctgtactactactgcagcctgcggggcatcccccggcagtgcatccctgaggtggccggggacctgatccggcggctgcacctggaggcccacgccgacaagcctgtggccacctacagcggcggcaccaagaggaagctgagcacagccctggccctggtgggcaagccagacatcctgctgctggatgagcccagcagcggcatggacccctgcagcaagcgctacctgtggcagaccatcatgaaggaggtgcgggagggctgtgccgctgtgctgaccagccacagcatggaggagtgtgaggccctgtgcacccggctggccatcatggtgaatggcagcttcaagtgcctgggcagcccccagcacatcaagaacagatttggagatggctacacagtgaaggtgtggctgtgcaaggaggccaaccagcactgcaccgtgtctgaccacctgaagctgtacttccctggcatccagttcaagggccagcacctgaacctgctggagtaccacgtgcccaagcgctggggctgcctggccgacctcttcaaggtgattgagaacaacaagaccttcctgaacatcaagcactacagcatcaaccagaccaccctggagcaggtgttcatcaactttgccagcgagcagcagcagaccctgcagagcaccctggaccccagcacagacagccaccacacccaccacctgcccatctag

SEQ ID NO: 144550 - DNA, 2367 bp, Artificial Sequence
  Description of Artificial Sequence: Synthetic coding sequence
atgggcctcttcatggtgcggcccctggccacagagtacccacccctgcggctgaccccaggccactaccagagagctgagacctacttcttcaggaagaacagcagctgctggaggacagaccccttcagccaccctgagttccaggacagctgtggctgcctgaagtgccccaacagaagtgccagcgccccctacctgaccaaccacctgggccacaccctgctgaacctgagcggcttcaacatggaggagtacctgctggcccccagcgagaagccccggctgggcggctggagctttggcctgaagatccccagcgaggccggcggggccaatggaaacatcagcaagccacccaccctggccaaggtgtggtacaaccagaagggcttccacagcctgcccagctacctgaaccacctgaacaacctgatcctgtggcagcacctgccccccaccgtggactggaggcagtatggcatcaccctgtacagccacccctatggaggagccctgctgaacaaggacaagatcctggagagcatccggcagtgtggggtggccctgtgcatcgtgctgggcttcagcatcctgagcgccagcatcggcagctctgtggtgcgggacagagtgattggagccaagaggctgcagcacatcagcggcctgggctacaggatgtactggttcaccaacttcctgtatgacatgctgttctacctggtgtctgtgtgcctgtgtgtggccgtcatcgtggccttccagctgacagccttcaccttcaggaagaacctggccgccacagccctgctgctgagcctgtttggctacgccaccctgccctggatgtacctgatgagccgcatcttcagcagcagtgatgtggccttcatctcctatgtgtccctgaacttcatcttcggcctgtgcaccatgctgatcaccatcatgccccggctgctggccatcatcagcaaggccaagaacctgcagaacatctatgatgtgctgaagtgggtgttcaccatcttcccccagttctgcctgggccagggcctggtggagctgtgctacaaccagatcaagtatgacctgacccacaactttggcatcgacagctatgtgagcccctttgagatgaacttcctgggctggatctttgtgcagctggccagccagggcaccgtgctgctgctgctgcgggtgctgctgcactgggacctgctgcgctggccccggggccacagcaccctgcagggcaccgtgaagagcagcaaggacacagatgtggagaaggaggagaagagggtgtttgagggccgcaccaacggggacatcctggtgctgtacaacctgagcaagcactaccgccgcttcttccagaacatcatcgctgtgcaggacatcagcctgggcatccccaagggggagtgcttcggcctgctgggcgtgaatggagctgggaagagcaccaccttcaagatgctgaatggagaggtgtccctgaccagcggccacgccatcatccgcacccccatgggagatgctgtggacctgagcagcgctggaacagctggggtgctgattggctactgcccccagcaggatgccctggatgagctgctgaccggctgggagcacctgtactactactgcagcctgcggggcatcccccggcagtgcatccctgaggtggccggggacctgatccggcggctgcacctggaggcccacgccgacaagcctgtggccacctacagcggcggcaccaagaggaagctgagcacagccctggccctggtgggcaagccagacatcctgctgctggatgagcccagcagcggcatggacccctgcagcaagcgctacctgtggcagaccatcatgaaggaggtgcgggagggctgtgccgctgtgctgaccagccacagcatggaggagtgtgaggccctgtgcacccggctggccatcatggtgaatggcagcttcaagtgcctgggcagcccccagcacatcaagaacagatttggagatggctacacagtgaaggtgtggctgtgcaaggaggccaaccagcactgcaccgtgtctgaccacctgaagctgtacttccctggcatccagttcaagggccagcacctgaacctgctggagtaccacgtgcccaagcgctggggctgcctggccgacctcttcaaggtgattgagaacaacaagaccttcctgaacatcaagcactacagcatcaaccagaccaccctggagcaggtgttcatcaactttgccagcgagcagcagcagaccctgcagagcaccctggaccccagcacagacagccaccacacccaccacctgcccatctag

SEQ ID NO: 144551 - DNA, 7311 bp, Artificial Sequence
  Description of Artificial Sequence: Synthetic coding sequence
atgggcttcctgcaccagctgcagctgctgctgtggaagaatgtgaccctgaagagaagaagcccctgggtgctggcctttgagatcttcatccccctggtgctcttcttcatcctgctgggcctgcggcagaagaagcccaccatctctgtgaaggaggtggccttctacacagctgcccccctgaccagcgctggcatcctgcctgtgatgcagagcctgtgcccagatggccagagagatgaatttggcttcctgcagtatgccaacagcacagtgacccagctgctggagcggctggacagagtggtggaggagggcaacctgtttgatcctgcccggcccagcctgggcagcgagctggaggccctgcggcagcacctggaggccctgtctgctggccctggcaccagcggcagccacctggacaggagcacagtgtcctccttcagcctggacagcgtggccaggaacccccaggagctgtggaggttcctgacccagaacctgagcctgcccaacagcacagcccaggccctgctggccgcccgggtggaccccccagaggtgtaccacctgctgtttggccccagcagcgccctggacagccagagcggcctgcacaagggccaggagccctggagccggctgggcggcaaccccctcttcaggatggaggagctgctgctggccccagccctgctggagcagctgacctgcaccccaggcagcggggagctgggccgcatcctgactgtgcctgagagccagaagggggccctgcagggctacagagatgctgtgtgcagcggccaggccgccgcccgggcccggcgcttcagcggcctgtctgctgagctgaggaaccagctggatgtggccaaggtgtcccagcagctgggcctggatgcccccaacggcagtgacagcagcccccaggcccccccaccccggcggctgcaggccctgctgggggacctgctggatgcccagaaggtgctgcaggatgtggatgtgctgagcgccctggccctgctgctgccccagggcgcctgcaccggccgcaccccaggccccccagccagcggggccggcggggccgccaatggaactggagctggagctgtgatgggccccaatgccacagctgaggagggcgcccccagcgctgctgccctggccaccccagacaccctgcagggccagtgcagcgcctttgtgcagctgtgggccggcctgcagcccatcctgtgtggcaacaacagaaccatcgagcctgaggccctgcggcggggcaacatgagcagcctgggcttcaccagcaaggagcagaggaacctgggcctgctggtgcacctgatgaccagcaaccccaagatcctgtatgccccagctggcagcgaggtggacagagtcatcctgaaggccaatgagacctttgcctttgtgggcaatgtgacccactacgcccaggtgtggctgaacatctctgctgagatccgctccttcctggagcagggccgcctgcagcagcacctgcgctggctgcagcagtatgtggccgagctgcggctgcaccctgaggccctgaacctgagcctggatgagctgcccccagccctgcggcaggacaacttcagcctgcccagcggcatggccctgctgcagcagctggacaccatcgacaatgctgcctgtggctggatccagttcatgagcaaggtgtctgtggacatcttcaagggcttccatgatgaggagagcatcgtgaactacaccctgaaccaggcctaccaggacaacgtgacagtgtttgccagcgtcatcttccagaccaggaaggatggcagcctgccccctcatgtgcactacaagatccggcagaacagcagcttcacagagaagaccaatgagatccggcgggcctactggaggcctggccccaacacaggaggccgcttctacttcctgtatggctttgtgtggatccaggacatgatggagcgggccatcatcgacacctttgtgggccatgatgtggtggagcccggcagctatgtgcagatgttcccctacccctgctacaccagagatgacttcctgtttgtgattgagcacatgatgcccctgtgcatggtgatctcctgggtgtacagcgtggccatgaccatccagcacatcgtggccgagaaggagcaccggctgaaggaggtgatgaagaccatgggcctgaacaatgctgtgcactgggtggcctggttcatcaccggctttgtgcagctgagcatctctgtgacagccctgacagccatcctgaagtatggccaggtgctgatgcacagccacgtggtgatcatctggctgttcctggccgtgtatgctgtggccaccatcatgttctgcttcctggtgtctgtgctgtacagcaaggccaagctggccagcgcctgtggcggcatcatctacttcctgtcctatgtgccctacatgtatgtggccatccgggaggaggtggcccatgacaagatcacagcctttgagaagtgcatcgccagcctgatgagcaccacagccttcggcctgggcagcaagtactttgccctgtatgaggtggccggcgtgggcatccagtggcacaccttcagccagagccctgtggagggagatgacttcaacctgctgctggccgtgaccatgctgatggtggatgctgtggtgtatggcatcctgacctggtacatcgaggccgtgcaccctggcatgtatggcctgccccggccctggtacttccccctgcagaagagctactggctgggcagcggccgcacagaggcctgggagtggagctggccctgggcccggaccccccggctgtctgtgatggaggaggaccaggcctgtgccatggagagccgccgctttgaggagacccggggcatggaggaggagcccacccacctgcccctggtggtgtgtgtggacaagctgaccaaggtgtacaaggatgacaagaagctggccctgaacaagctgagcctgaacctgtatgagaaccaggtggtgtccttcctgggccacaatggagctgggaagaccaccaccatgagcatcctgaccggcctcttcccccccaccagcggcagcgccaccatctacggccatgacatcagaacagagatggatgagatcaggaagaacctgggcatgtgcccccagcacaacgtgctgtttgaccggctgactgtggaggagcacctgtggttctacagccggctgaagtccatggcccaggaggagatcagaagagagatggacaagatgattgaggacctggagctgagcaacaagaggcacagcctggtgcagaccctgagcggcggcatgaagaggaagctgtctgtggccatcgcctttgtgggcggcagccgggccatcatcctggatgagcccacagctggggtggacccctatgcccggcgggccatctgggacctgatcctgaagtacaagccaggccgcaccatcctgctgagcacccaccacatggatgaagctgacctgctgggggaccgcatcgccatcatcagccacggcaagctgaagtgctgcggcagccccctcttcctgaagggcacctatggagatggctaccgcctgaccctggtgaagaggcctgctgagcccggcggcccccaggagcccggcctggccagcagccccccaggccgggcccccctgagcagctgcagcgagctgcaggtgtcccagttcatcaggaagcacgtggccagctgcctgctggtgtctgacaccagcacagagctgagctacatcctgcccagcgaggccgccaagaagggggcctttgagcggctcttccagcacctggagaggagcctggatgccctgcacctgagcagctttggcctgatggacaccaccctggaggaggtgttcctgaaggtgtctgaggaggaccagagcctggagaacagcgaggctgatgtgaaggagagcaggaaggatgtgctgcctggagctgagggccctgccagcggggagggccatgctggcaacctggcccgctgcagcgagctgacccagagccaggccagcctgcagagcgccagctctgtgggcagcgcccggggagatgaaggagctggctacacagatgtgtatggagactaccggcccctgtttgacaacccccaggaccctgacaacgtgtccctgcaggaggtggaggccgaggccctgagccgggtgggccagggcagcaggaagctggatggcggctggctgaaggtgcggcagttccacggcctgctggtgaagcgcttccactgtgcccggaggaacagcaaggccctcttcagccagatcctgctgcctgccttctttgtgtgtgtggccatgacagtggccctgtctgtgcctgagatcggggacctgccccccctggtgctgagccccagccagtaccacaactacacccagccccggggcaacttcatcccctatgccaatgaggagcggcgggagtaccgcctgcggctgagcccagatgccagcccccagcagctggtgtccaccttccggctgcccagcggcgtgggcgccacctgtgtgctgaagagccctgccaacggcagcctgggccccaccctgaacctgagcagtggagagagccggctgctggccgcccgcttctttgacagcatgtgcctggagagcttcacccagggcctgcccctgagcaactttgtgcccccaccacccagccctgcccccagcgacagccctgccagcccagatgaggacctgcaggcctggaatgtgtccctgcccccaacagctggccctgagatgtggaccagcgcccccagcctgccccggctggtgcgggagcctgtgcgctgcacctgcagcgcccagggcaccggcttcagctgccccagctctgtgggcggccaccccccccagatgagggtggtgactggagacatcctgacagacatcaccggccacaacgtgtctgagtacctgctcttcaccagtgaccgcttccggctgcacagatatggagccatcacctttggaaatgtgctgaagagcatcccagccagctttggcacccgggccccacccatggtgaggaagattgctgtgagaagagctgcccaggtgttctacaacaacaagggctaccacagcatgcccacctacctgaacagcctgaacaatgccatcctgcgggccaacctgcccaagagcaagggcaacccagctgcctacggcatcaccgtgaccaaccaccccatgaacaagaccagcgccagcctgagcctggactacctgctgcagggcacagatgtggtgattgccatcttcatcatcgtggccatgagctttgtgcctgccagctttgtggtgttcctggtggccgagaagagcaccaaggccaagcacctgcagtttgtgtctggctgcaaccccatcatctactggctggccaactacgtgtgggacatgctgaactacctggtgcctgccacctgctgcgtcatcatcctgtttgtgtttgacctgcctgcctacaccagccccaccaacttccctgctgtgctgagcctcttcctgctgtatggctggagcatcacccccatcatgtacccagccagcttctggtttgaggtgcccagcagcgcctacgtgttcctgattgtcatcaacctcttcatcggcatcacagccaccgtggccaccttcctgctgcagctgtttgaacatgacaaggacctgaaggtggtgaacagctacctgaagagctgcttcctgatcttccccaactacaacctgggccacggcctgatggagatggcctacaatgagtacatcaatgagtactatgccaagattggccagtttgacaagatgaagagcccctttgagtgggacatcgtgacccggggcctggtggccatggctgtggagggcgtggtgggcttcctgctgaccatcatgtgccagtacaacttcctgcggcggccccagaggatgcctgtgtccaccaagcctgtggaggatgatgtggatgtggccagcgagcggcagagggtgctgcggggagatgctgacaatgacatggtgaagattgagaacctgaccaaggtgtacaagagcaggaagattggccgcatcctggccgtggaccggctgtgcctgggcgtgcggcctggagagtgcttcggcctgctgggcgtgaatggagctgggaagaccagcaccttcaagatgctgactggagatgagagcaccaccggcggggaggcctttgtgaatggccacagcgtgctgaaggagctgctgcaggtgcagcagagcctgggctactgcccccagtgtgatgccctgtttgatgagctgacagcccgggagcacctgcagctgtacacccggctgcggggcatctcctggaaggatgaggcccgggtggtgaagtgggccctggagaagctggagctgaccaagtatgctgacaagccagctggcacctacagcggcggcaacaagaggaagctgagcacagccatcgccctgattggctacccagccttcatcttcctggatgagcccaccaccggcatggaccccaaggcccggcgcttcctgtggaacctgatcctggacctgatcaagacaggccgctctgtggtgctgaccagccacagcatggaggagtgtgaggccctgtgcacccggctggccatcatggtgaatggccgcctgcgctgcctgggcagcatccagcacctgaagaacagatttggagatggctacatgatcaccgtgaggaccaagagcagccagagcgtgaaggatgtggtgcgcttcttcaacagaaacttccctgaggccatgctgaaggagcggcaccacaccaaggtgcagtaccagctgaagtctgagcacatcagcctggcccaggtgttcagcaagatggagcaggtgtctggagtgctgggcatcgaggactacagcgtgtcccagaccaccctggacaacgtgtttgtgaactttgccaagaagcagagcgacaacctggagcagcaggagacagagccccccagcgccctgcagagccccctgggctgcctgctgagcctgctgcggcccaggtctgcccccacagagctgcgggccctggtggctgatgagcctgaggacctggacacagaagatgagggcctcatcagctttgaggaggagcgggcccagctgtccttcaacacagacaccctgtgctag

SEQ ID NO: 144552 - DNA, 7311 bp, Artificial Sequence
  Description of Artificial Sequence: Synthetic coding sequence
atgggcttcctgcaccagctgcagctgctgctgtggaagaatgtgaccctgaagagaagaagcccctgggtgctggcctttgagatcttcatccccctggtgctcttcttcatcctgctgggcctgcggcagaagaagcccaccatctctgtgaaggaggtgtccttctacacagctgcccccctgaccagcgctggcatcctgcctgtgatgcagagcctgtgcccagatggccagagagatgaatttggcttcctgcagtatgccaacagcacagtgacccagctgctggagcggctggacagagtggtggaggagggcaacctgtttgatcctgcccggcccagcctgggcagcgagctggaggccctgcggcagcacctggaggccctgtctgctggccctggcaccagcggcagccacctggacaggagcacagtgtcctccttcagcctggacagcgtggccaggaacccccaggagctgtggaggttcctgacccagaacctgagcctgcccaacagcacagcccaggccctgctggccgcccgggtggaccccccagaggtgtaccacctgctgtttggccccagcagcgccctggacagccagagcggcctgcacaagggccaggagccctggagccggctgggcggcaaccccctcttcaggatggaggagctgctgctggccccagccctgctggagcagctgacctgcaccccaggcagcggggagctgggccgcatcctgactgtgcctgagagccagaagggggccctgcagggctacagagatgctgtgtgcagcggccaggccgccgcccgggcccggcgcttcagcggcctgtctgctgagctgaggaaccagctggatgtggccaaggtgtcccagcagctgggcctggatgcccccaacggcagtgacagcagcccccaggcccccccaccccggcggctgcaggccctgctgggggacctgctggatgcccagaaggtgctgcaggatgtggatgtgctgagcgccctggccctgctgctgccccagggcgcctgcaccggccgcaccccaggccccccagccagcggggccggcggggccgccaatggaactggagctggagctgtgatgggccccaatgccacagctgaggagggcgcccccagcgctgctgccctggccaccccagacaccctgcagggccagtgcagcgcctttgtgcagctgtgggccggcctgcagcccatcctgtgtggcaacaacagaaccatcgagcctgaggccctgcggcggggcaacatgagcagcctgggcttcaccagcaaggagcagaggaacctgggcctgctggtgcacctgatgaccagcaaccccaagatcctgtatgccccagctggcagcgaggtggacagagtcatcctgaaggccaatgagacctttgcctttgtgggcaatgtgacccactacgcccaggtgtggctgaacatctctgctgagatccgctccttcctggagcagggccgcctgcagcagcacctgcgctggctgcagcagtatgtggccgagctgcggctgcaccctgaggccctgaacctgagcctggatgagctgcccccagccctgcggcaggacaacttcagcctgcccagcggcatggccctgctgcagcagctggacaccatcgacaatgctgcctgtggctggatccagttcatgagcaaggtgtctgtggacatcttcaagggcttccatgatgaggagagcatcgtgaactacaccctgaaccaggcctaccaggacaacgtgacagtgtttgccagcgtcatcttccagaccaggaaggatggcagcctgccccctcatgtgcactacaagatccggcagaacagcagcttcacagagaagaccaatgagatccggcgggcctactggaggcctggccccaacacaggaggccgcttctacttcctgtatggctttgtgtggatccaggacatgatggagcgggccatcatcgacacctttgtgggccatgatgtggtggagcccggcagctatgtgcagatgttcccctacccctgctacaccagagatgacttcctgtttgtgattgagcacatgatgcccctgtgcatggtgatctcctgggtgtacagcgtggccatgaccatccagcacatcgtggccgagaaggagcaccggctgaaggaggtgatgaagaccatgggcctgaacaatgctgtgcactgggtggcctggttcatcaccggctttgtgcagctgagcatctctgtgacagccctgacagccatcctgaagtatggccaggtgctgatgcacagccacgtggtgatcatctggctgttcctggccgtgtatgctgtggccaccatcatgttctgcttcctggtgtctgtgctgtacagcaaggccaagctggccagcgcctgtggcggcatcatctacttcctgtcctatgtgccctacatgtatgtggccatccgggaggaggtggcccatgacaagatcacagcctttgagaagtgcatcgccagcctgatgagcaccacagccttcggcctgggcagcaagtactttgccctgtatgaggtggccggcgtgggcatccagtggcacaccttcagccagagccctgtggagggagatgacttcaacctgctgctggccgtgaccatgctgatggtggatgctgtggtgtatggcatcctgacctggtacatcgaggccgtgcaccctggcatgtatggcctgccccggccctggtacttccccctgcagaagagctactggctgggcagcggccgcacagaggcctgggagtggagctggccctgggcccggaccccccggctgtctgtgatggaggaggaccaggcctgtgccatggagagccgccgctttgaggagacccggggcatggaggaggagcccacccacctgcccctggtggtgtgtgtggacaagctgaccaaggtgtacaaggatgacaagaagctggccctgaacaagctgagcctgaacctgtatgagaaccaggtggtgtccttcctgggccacaatggagctgggaagaccaccaccatgagcatcctgaccggcctcttcccccccaccagcggcagcgccaccatctacggccatgacatcagaacagagatggatgagatcaggaagaacctgggcatgtgcccccagcacaacgtgctgtttgaccggctgactgtggaggagcacctgtggttctacagccggctgaagtccatggcccaggaggagatcagaagagagatggacaagatgattgaggacctggagctgagcaacaagaggcacagcctggtgcagaccctgagcggcggcatgaagaggaagctgtctgtggccatcgcctttgtgggcggcagccgggccatcatcctggatgagcccacagctggggtggacccctatgcccggcgggccatctgggacctgatcctgaagtacaagccaggccgcaccatcctgctgagcacccaccacatggatgaagctgacctgctgggggaccgcatcgccatcatcagccacggcaagctgaagtgctgcggcagccccctcttcctgaagggcacctatggagatggctaccgcctgaccctggtgaagaggcctgctgagcccggcggcccccaggagcccggcctggccagcagccccccaggccgggcccccctgagcagctgcagcgagctgcaggtgtcccagttcatcaggaagcacgtggccagctgcctgctggtgtctgacaccagcacagagctgagctacatcctgcccagcgaggccgccaagaagggggcctttgagcggctcttccagcacctggagaggagcctggatgccctgcacctgagcagctttggcctgatggacaccaccctggaggaggtgttcctgaaggtgtctgaggaggaccagagcctggagaacagcgaggctgatgtgaaggagagcaggaaggatgtgctgcctggagctgagggccctgccagcggggagggccatgctggcaacctggcccgctgcagcgagctgacccagagccaggccagcctgcagagcgccagctctgtgggcagcgcccggggagatgaaggagctggctacacagatgtgtatggagactaccggcccctgtttgacaacccccaggaccctgacaacgtgtccctgcaggaggtggaggccgaggccctgagccgggtgggccagggcagcaggaagctggatggcggctggctgaaggtgcggcagttccacggcctgctggtgaagcgcttccactgtgcccggaggaacagcaaggccctcttcagccagatcctgctgcctgccttctttgtgtgtgtggccatgacagtggccctgtctgtgcctgagatcggggacctgccccccctggtgctgagccccagccagtaccacaactacacccagccccggggcaacttcatcccctatgccaatgaggagcggcgggagtaccgcctgcggctgagcccagatgccagcccccagcagctggtgtccaccttccggctgcccagcggcgtgggcgccacctgtgtgctgaagagccctgccaacggcagcctgggccccaccctgaacctgagcagtggagagagccggctgctggccgcccgcttctttgacagcatgtgcctggagagcttcacccagggcctgcccctgagcaactttgtgcccccaccacccagccctgcccccagcgacagccctgccagcccagatgaggacctgcaggcctggaatgtgtccctgcccccaacagctggccctgagatgtggaccagcgcccccagcctgccccggctggtgcgggagcctgtgcgctgcacctgcagcgcccagggcaccggcttcagctgccccagctctgtgggcggccaccccccccagatgagggtggtgactggagacatcctgacagacatcaccggccacaacgtgtctgagtacctgctcttcaccagtgaccgcttccggctgcacagatatggagccatcacctttggaaatgtgctgaagagcatcccagccagctttggcacccgggccccacccatggtgaggaagattgctgtgagaagagctgcccaggtgttctacaacaacaagggctaccacagcatgcccacctacctgaacagcctgaacaatgccatcctgcgggccaacctgcccaagagcaagggcaacccagctgcctacggcatcaccgtgaccaaccaccccatgaacaagaccagcgccagcctgagcctggactacctgctgcagggcacagatgtggtgattgccatcttcatcatcgtggccatgagctttgtgcctgccagctttgtggtgttcctggtggccgagaagagcaccaaggccaagcacctgcagtttgtgtctggctgcaaccccatcatctactggctggccaactacgtgtgggacatgctgaactacctggtgcctgccacctgctgcgtcatcatcctgtttgtgtttgacctgcctgcctacaccagccccaccaacttccctgctgtgctgagcctcttcctgctgtatggctggagcatcacccccatcatgtacccagccagcttctggtttgaggtgcccagcagcgcctacgtgttcctgattgtcatcaacctcttcatcggcatcacagccaccgtggccaccttcctgctgcagctgtttgaacatgacaaggacctgaaggtggtgaacagctacctgaagagctgcttcctgatcttccccaactacaacctgggccacggcctgatggagatggcctacaatgagtacatcaatgagtactatgccaagattggccagtttgacaagatgaagagcccctttgagtgggacatcgtgacccggggcctggtggccatggctgtggagggcgtggtgggcttcctgctgaccatcatgtgccagtacaacttcctgcggcggccccagaggatgcctgtgtccaccaagcctgtggaggatgatgtggatgtggccagcgagcggcagagggtgctgcggggagatgctgacaatgacatggtgaagattgagaacctgaccaaggtgtacaagagcaggaagattggccgcatcctggccgtggaccggctgtgcctgggcgtgcggcctggagagtgcttcggcctgctgggcgtgaatggagctgggaagaccagcaccttcaagatgctgactggagatgagagcaccaccggcggggaggcctttgtgaatggccacagcgtgctgaaggagctgctgcaggtgcagcagagcctgggctactgcccccagtgtgatgccctgtttgatgagctgacagcccgggagcacctgcagctgtacacccggctgcggggcatctcctggaaggatgaggcccgggtggtgaagtgggccctggagaagctggagctgaccaagtatgctgacaagccagctggcacctacagcggcggcaacaagaggaagctgagcacagccatcgccctgattggctacccagccttcatcttcctggatgagcccaccaccggcatggaccccaaggcccggcgcttcctgtggaacctgatcctggacctgatcaagacaggccgctctgtggtgctgaccagccacagcatggaggagtgtgaggccctgtgcacccggctggccatcatggtgaatggccgcctgcgctgcctgggcagcatccagcacctgaagaacagatttggagatggctacatgatcaccgtgaggaccaagagcagccagagcgtgaaggatgtggtgcgcttcttcaacagaaacttccctgaggccatgctgaaggagcggcaccacaccaaggtgcagtaccagctgaagtctgagcacatcagcctggcccaggtgttcagcaagatggagcaggtgtctggagtgctgggcatcgaggactacagcgtgtcccagaccaccctggacaacgtgtttgtgaactttgccaagaagcagagcgacaacctggagcagcaggagacagagccccccagcgccctgcagagccccctgggctgcctgctgagcctgctgcggcccaggtctgcccccacagagctgcgggccctggtggctgatgagcctgaggacctggacacagaagatgagggcctcatcagctttgaggaggagcgggcccagctgtccttcaacacagacaccctgtgctag

SEQ ID NO: 144553 - DNA, 7401 bp, Artificial Sequence
  Description of Artificial Sequence: Synthetic coding sequence
atgggcaggaagaccagccgggtgcagcagggcccccccaggagccctgcctgcagcgcccatggagagaggtcctggggcctggagttcccccccttccgctggctgctgggcattgctggccgcacccacctggccgccctgccccccttccagtgggtgctggcctttgagatcttcatccccctggtgctcttcttcatcctgctgggcctgcggcagaagaagcccaccatctctgtgaaggaggtggccttctacacagctgcccccctgaccagcgctggcatcctgcctgtgatgcagagcctgtgcccagatggccagagagatgaatttggcttcctgcagtatgccaacagcacagtgacccagctgctggagcggctggacagagtggtggaggagggcaacctgtttgatcctgcccggcccagcctgggcagcgagctggaggccctgcggcagcacctggaggccctgtctgctggccctggcaccagcggcagccacctggacaggagcacagtgtcctccttcagcctggacagcgtggccaggaacccccaggagctgtggaggttcctgacccagaacctgagcctgcccaacagcacagcccaggccctgctggccgcccgggtggaccccccagaggtgtaccacctgctgtttggccccagcagcgccctggacagccagagcggcctgcacaagggccaggagccctggagccggctgggcggcaaccccctcttcaggatggaggagctgctgctggccccagccctgctggagcagctgacctgcaccccaggcagcggggagctgggccgcatcctgactgtgcctgagagccagaagggggccctgcagggctacagagatgctgtgtgcagcggccaggccgccgcccgggcccggcgcttcagcggcctgtctgctgagctgaggaaccagctggatgtggccaaggtgtcccagcagctgggcctggatgcccccaacggcagtgacagcagcccccaggcccccccaccccggcggctgcaggccctgctgggggacctgctggatgcccagaaggtgctgcaggatgtggatgtgctgagcgccctggccctgctgctgccccagggcgcctgcaccggccgcaccccaggccccccagccagcggggccggcggggccgccaatggaactggagctggagctgtgatgggccccaatgccacagctgaggagggcgcccccagcgctgctgccctggccaccccagacaccctgcagggccagtgcagcgcctttgtgcagctgtgggccggcctgcagcccatcctgtgtggcaacaacagaaccatcgagcctgaggccctgcggcggggcaacatgagcagcctgggcttcaccagcaaggagcagaggaacctgggcctgctggtgcacctgatgaccagcaaccccaagatcctgtatgccccagctggcagcgaggtggacagagtcatcctgaaggccaatgagacctttgcctttgtgggcaatgtgacccactacgcccaggtgtggctgaacatctctgctgagatccgctccttcctggagcagggccgcctgcagcagcacctgcgctggctgcagcagtatgtggccgagctgcggctgcaccctgaggccctgaacctgagcctggatgagctgcccccagccctgcggcaggacaacttcagcctgcccagcggcatggccctgctgcagcagctggacaccatcgacaatgctgcctgtggctggatccagttcatgagcaaggtgtctgtggacatcttcaagggcttccatgatgaggagagcatcgtgaactacaccctgaaccaggcctaccaggacaacgtgacagtgtttgccagcgtcatcttccagaccaggaaggatggcagcctgccccctcatgtgcactacaagatccggcagaacagcagcttcacagagaagaccaatgagatccggcgggcctactggaggcctggccccaacacaggaggccgcttctacttcctgtatggctttgtgtggatccaggacatgatggagcgggccatcatcgacacctttgtgggccatgatgtggtggagcccggcagctatgtgcagatgttcccctacccctgctacaccagagatgacttcctgtttgtgattgagcacatgatgcccctgtgcatggtgatctcctgggtgtacagcgtggccatgaccatccagcacatcgtggccgagaaggagcaccggctgaaggaggtgatgaagaccatgggcctgaacaatgctgtgcactgggtggcctggttcatcaccggctttgtgcagctgagcatctctgtgacagccctgacagccatcctgaagtatggccaggtgctgatgcacagccacgtggtgatcatctggctgttcctggccgtgtatgctgtggccaccatcatgttctgcttcctggtgtctgtgctgtacagcaaggccaagctggccagcgcctgtggcggcatcatctacttcctgtcctatgtgccctacatgtatgtggccatccgggaggaggtggcccatgacaagatcacagcctttgagaagtgcatcgccagcctgatgagcaccacagccttcggcctgggcagcaagtactttgccctgtatgaggtggccggcgtgggcatccagtggcacaccttcagccagagccctgtggagggagatgacttcaacctgctgctggccgtgaccatgctgatggtggatgctgtggtgtatggcatcctgacctggtacatcgaggccgtgcaccctggcatgtatggcctgccccggccctggtacttccccctgcagaagagctactggctgggcagcggccgcacagaggcctgggagtggagctggccctgggcccggaccccccggctgtctgtgatggaggaggaccaggcctgtgccatggagagccgccgctttgaggagacccggggcatggaggaggagcccacccacctgcccctggtggtgtgtgtggacaagctgaccaaggtgtacaaggatgacaagaagctggccctgaacaagctgagcctgaacctgtatgagaaccaggtggtgtccttcctgggccacaatggagctgggaagaccaccaccatgagcatcctgaccggcctcttcccccccaccagcggcagcgccaccatctacggccatgacatcagaacagagatggatgagatcaggaagaacctgggcatgtgcccccagcacaacgtgctgtttgaccggctgactgtggaggagcacctgtggttctacagccggctgaagtccatggcccaggaggagatcagaagagagatggacaagatgattgaggacctggagctgagcaacaagaggcacagcctggtgcagaccctgagcggcggcatgaagaggaagctgtctgtggccatcgcctttgtgggcggcagccgggccatcatcctggatgagcccacagctggggtggacccctatgcccggcgggccatctgggacctgatcctgaagtacaagccaggccgcaccatcctgctgagcacccaccacatggatgaagctgacctgctgggggaccgcatcgccatcatcagccacggcaagctgaagtgctgcggcagccccctcttcctgaagggcacctatggagatggctaccgcctgaccctggtgaagaggcctgctgagcccggcggcccccaggagcccggcctggccagcagccccccaggccgggcccccctgagcagctgcagcgagctgcaggtgtcccagttcatcaggaagcacgtggccagctgcctgctggtgtctgacaccagcacagagctgagctacatcctgcccagcgaggccgccaagaagggggcctttgagcggctcttccagcacctggagaggagcctggatgccctgcacctgagcagctttggcctgatggacaccaccctggaggaggtgttcctgaaggtgtctgaggaggaccagagcctggagaacagcgaggctgatgtgaaggagagcaggaaggatgtgctgcctggagctgagggccctgccagcggggagggccatgctggcaacctggcccgctgcagcgagctgacccagagccaggccagcctgcagagcgccagctctgtgggcagcgcccggggagatgaaggagctggctacacagatgtgtatggagactaccggcccctgtttgacaacccccaggaccctgacaacgtgtccctgcaggaggtggaggccgaggccctgagccgggtgggccagggcagcaggaagctggatggcggctggctgaaggtgcggcagttccacggcctgctggtgaagcgcttccactgtgcccggaggaacagcaaggccctcttcagccagatcctgctgcctgccttctttgtgtgtgtggccatgacagtggccctgtctgtgcctgagatcggggacctgccccccctggtgctgagccccagccagtaccacaactacacccagccccggggcaacttcatcccctatgccaatgaggagcggcgggagtaccgcctgcggctgagcccagatgccagcccccagcagctggtgtccaccttccggctgcccagcggcgtgggcgccacctgtgtgctgaagagccctgccaacggcagcctgggccccaccctgaacctgagcagtggagagagccggctgctggccgcccgcttctttgacagcatgtgcctggagagcttcacccagggcctgcccctgagcaactttgtgcccccaccacccagccctgcccccagcgacagccctgccagcccagatgaggacctgcaggcctggaatgtgtccctgcccccaacagctggccctgagatgtggaccagcgcccccagcctgccccggctggtgcgggagcctgtgcgctgcacctgcagcgcccagggcaccggcttcagctgccccagctctgtgggcggccaccccccccagatgagggtggtgactggagacatcctgacagacatcaccggccacaacgtgtctgagtacctgctcttcaccagtgaccgcttccggctgcacagatatggagccatcacctttggaaatgtgctgaagagcatcccagccagctttggcacccgggccccacccatggtgaggaagattgctgtgagaagagctgcccaggtgttctacaacaacaagggctaccacagcatgcccacctacctgaacagcctgaacaatgccatcctgcgggccaacctgcccaagagcaagggcaacccagctgcctacggcatcaccgtgaccaaccaccccatgaacaagaccagcgccagcctgagcctggactacctgctgcagggcacagatgtggtgattgccatcttcatcatcgtggccatgagctttgtgcctgccagctttgtggtgttcctggtggccgagaagagcaccaaggccaagcacctgcagtttgtgtctggctgcaaccccatcatctactggctggccaactacgtgtgggacatgctgaactacctggtgcctgccacctgctgcgtcatcatcctgtttgtgtttgacctgcctgcctacaccagccccaccaacttccctgctgtgctgagcctcttcctgctgtatggctggagcatcacccccatcatgtacccagccagcttctggtttgaggtgcccagcagcgcctacgtgttcctgattgtcatcaacctcttcatcggcatcacagccaccgtggccaccttcctgctgcagctgtttgaacatgacaaggacctgaaggtggtgaacagctacctgaagagctgcttcctgatcttccccaactacaacctgggccacggcctgatggagatggcctacaatgagtacatcaatgagtactatgccaagattggccagtttgacaagatgaagagcccctttgagtgggacatcgtgacccggggcctggtggccatggctgtggagggcgtggtgggcttcctgctgaccatcatgtgccagtacaacttcctgcggcggccccagaggatgcctgtgtccaccaagcctgtggaggatgatgtggatgtggccagcgagcggcagagggtgctgcggggagatgctgacaatgacatggtgaagattgagaacctgaccaaggtgtacaagagcaggaagattggccgcatcctggccgtggaccggctgtgcctgggcgtgcggcctggagagtgcttcggcctgctgggcgtgaatggagctgggaagaccagcaccttcaagatgctgactggagatgagagcaccaccggcggggaggcctttgtgaatggccacagcgtgctgaaggagctgctgcaggtgcagcagagcctgggctactgcccccagtgtgatgccctgtttgatgagctgacagcccgggagcacctgcagctgtacacccggctgcggggcatctcctggaaggatgaggcccgggtggtgaagtgggccctggagaagctggagctgaccaagtatgctgacaagccagctggcacctacagcggcggcaacaagaggaagctgagcacagccatcgccctgattggctacccagccttcatcttcctggatgagcccaccaccggcatggaccccaaggcccggcgcttcctgtggaacctgatcctggacctgatcaagacaggccgctctgtggtgctgaccagccacagcatggaggagtgtgaggccctgtgcacccggctggccatcatggtgaatggccgcctgcgctgcctgggcagcatccagcacctgaagaacagatttggagatggctacatgatcaccgtgaggaccaagagcagccagagcgtgaaggatgtggtgcgcttcttcaacagaaacttccctgaggccatgctgaaggagcggcaccacaccaaggtgcagtaccagctgaagtctgagcacatcagcctggcccaggtgttcagcaagatggagcaggtgtctggagtgctgggcatcgaggactacagcgtgtcccagaccaccctggacaacgtgtttgtgaactttgccaagaagcagagcgacaacctggagcagcaggagacagagccccccagcgccctgcagagccccctgggctgcctgctgagcctgctgcggcccaggtctgcccccacagagctgcgggccctggtggctgatgagcctgaggacctggacacagaagatgagggcctcatcagctttgaggaggagcgggcccagctgtccttcaacacagacaccctgtgctag

SEQ ID NO: 144554 - DNA, 7308 bp, Artificial Sequence
  Description of Artificial Sequence: Synthetic coding sequence
atgggcttcctgcaccagctgcagctgctgctgtggaagaatgtgaccctgaagagaagaagcccctgggtgctggcctttgagatcttcatccccctggtgctcttcttcatcctgctgggcctgcggcagaagaagcccaccatctctgtgaaggaggccttctacacagctgcccccctgaccagcgctggcatcctgcctgtgatgcagagcctgtgcccagatggccagagagatgaatttggcttcctgcagtatgccaacagcacagtgacccagctgctggagcggctggacagagtggtggaggagggcaacctgtttgatcctgcccggcccagcctgggcagcgagctggaggccctgcggcagcacctggaggccctgtctgctggccctggcaccagcggcagccacctggacaggagcacagtgagcagcttcagcctggacagcgtggccaggaacccccaggagctgtggaggttcctgacccagaacctgagcctgcccaacagcacagcccaggccctgctggccgcccgggtggaccccccagaggtgtaccacctgctgtttggccccagcagcgccctggacagccagagcggcctgcacaagggccaggagccctggagccggctgggcggcaaccccctcttcaggatggaggagctgctgctggccccagccctgctggagcagctgacctgcaccccaggcagcggggagctgggccgcatcctgactgtgcctgagagccagaagggggccctgcagggctacagagatgctgtgtgcagcggccaggccgccgcccgggcccggcgcttcagcggcctgtctgctgagctgaggaaccagctggatgtggccaaggtgtcccagcagctgggcctggatgccccaaatggaagtgacagcagcccccaggcccccccaccccggcggctgcaggccctgctgggggacctgctggatgcccagaaggtgctgcaggatgtggatgtgctgagcgccctggccctgctgctgccccagggcgcctgcaccggccgcaccccaggccccccagccagcggggccggcggggccgccaacggcaccggggccggggctgtgatgggccccaatgccacagctgaggagggcgcccccagcgctgctgccctggccaccccagacaccctgcagggccagtgcagcgcctttgtgcagctgtgggccggcctgcagcccatcctgtgtggcaacaacagaaccatcgagcctgaggccctgcggcggggcaacatgagcagcctgggcttcaccagcaaggagcagaggaacctgggcctgctggtgcacctgatgaccagcaaccccaagatcctgtatgccccagctggcagcgaggtggacagagtcatcctgaaggccaatgagacctttgcctttgtgggcaatgtgacccactacgcccaggtgtggctgaacatctctgctgagatccgctccttcctggagcagggccgcctgcagcagcacctgcgctggctgcagcagtatgtggccgagctgcggctgcaccctgaggccctgaacctgagcctggatgagctgcccccagccctgcggcaggacaacttcagcctgcccagcggcatggccctgctgcagcagctggacaccatcgacaatgctgcctgtggctggatccagttcatgagcaaggtgtctgtggacatcttcaagggcttccatgatgaggagagcatcgtgaactacaccctgaaccaggcctaccaggacaacgtgacagtgtttgccagcgtcatcttccagaccaggaaggatggcagcctgcccccccacgtgcactacaagatccggcagaacagcagcttcacagagaagaccaatgagatcagaagagcctactggaggcctggccccaacacaggaggccgcttctacttcctgtatggctttgtgtggatccaggacatgatggagcgggccatcatcgacacctttgtgggccatgatgtggtggagcccggcagctatgtgcagatgttcccctacccctgctacaccagagatgacttcctgtttgtgattgagcacatgatgcccctgtgcatggtgatctcctgggtgtacagcgtggccatgaccatccagcacatcgtggccgagaaggagcaccggctgaaggaggtgatgaagaccatgggcctgaacaatgctgtgcactgggtggcctggttcatcactggatttgtgcagctgagcatctctgtgacagccctgacagccatcctgaagtatggccaggtgctgatgcacagccacgtggtgatcatctggctgttcctggccgtgtatgctgtggccaccatcatgttctgcttcctggtgtctgtgctgtacagcaaggccaagctggccagcgcctgtggcggcatcatctacttcctgtcctatgtgccctacatgtatgtggccatccgggaggaggtggcccatgacaagatcacagcctttgagaagtgcatcgccagcctgatgagcaccacagccttcggcctgggcagcaagtactttgccctgtatgaggtggccggcgtgggcatccagtggcacaccttcagccagagccctgtggagggagatgacttcaacctgctgctggccgtgaccatgctgatggtggatgctgtggtgtatggcatcctgacctggtacattgaagctgtgcaccctggcatgtatggcctgccccggccctggtacttccccctgcagaagagctactggctgggcagcggccgcacagaggcctgggagtggagctggccctgggcccggaccccccggctgtctgtgatggaggaggaccaggcctgtgccatggagagcagaagatttgaggagacccggggcatggaggaggagcccacccacctgcccctggtggtgtgtgtggacaagctgaccaaggtgtacaaggatgacaagaagctggccctgaacaagctgagcctgaacctgtatgagaaccaggtggtgtccttcctgggccacaacggggccggcaagaccaccaccatgagcatcctgaccggcctcttcccccccaccagcggcagcgccaccatctacggccatgacatcagaacagagatggatgagatcaggaagaacctgggcatgtgcccccagcacaacgtgctgtttgaccggctgactgtggaggagcacctgtggttctacagccggctgaagtccatggcccaggaggagatccggcgggagatggacaagatgattgaggacctggagctgagcaacaagaggcacagcctggtgcagaccctgagcggcggcatgaagaggaagctgtctgtggccatcgcctttgtgggcggcagccgggccatcatcctggatgagcccacagctggggtggacccctatgcccggcgggccatctgggacctgatcctgaagtacaagccaggccgcaccatcctgctgagcacccaccacatggatgaggccgacctgctgggggacagaattgccatcatcagccacggcaagctgaagtgctgcggcagccccctcttcctgaagggcacctatggagatggctaccgcctgaccctggtgaagaggcctgctgagcccggcggcccccaggagcccggcctggccagcagccccccaggccgggcccccctgagcagctgcagcgagctgcaggtgtcccagttcatcaggaagcacgtggccagctgcctgctggtgtctgacaccagcacagagctgagctacatcctgcccagcgaggccgccaagaagggggcctttgagcggctcttccagcacctggagaggagcctggatgccctgcacctgagcagctttggcctgatggacaccaccctggaggaggtgttcctgaaggtgtctgaggaggaccagagcctggagaacagcgaggctgatgtgaaggagagcaggaaggatgtgctgcccggggctgagggccctgccagcggggagggccacgccggcaacctggcccgctgcagcgagctgacccagagccaggccagcctgcagagcgccagctctgtgggcagcgcccggggagatgagggcgccggctacacagatgtgtatggagactaccggcccctgtttgacaacccccaggaccctgacaacgtgtccctgcaggaggtggaggccgaggccctgagccgggtgggccagggcagcaggaagctggatggcggctggctgaaggtgcggcagttccacggcctgctggtgaagcgcttccactgtgcccggaggaacagcaaggccctcttcagccagatcctgctgcctgccttctttgtgtgtgtggccatgacagtggccctgtctgtgcctgagattggagacctgccccccctggtgctgagccccagccagtaccacaactacacccagccccggggcaacttcatcccctatgccaatgaggagcggcgggagtaccgcctgcggctgagcccagatgccagcccccagcagctggtgtccaccttccggctgcccagcggcgtgggcgccacctgtgtgctgaagagccctgccaacggcagcctgggccccaccctgaacctgagcagcggggagagccggctgctggccgcccgcttctttgacagcatgtgcctggagagcttcacccagggcctgcccctgagcaactttgtgcccccaccacccagccctgcccccagcgacagccctgccagcccagatgaggacctgcaggcctggaatgtgtccctgcccccaacagctggccctgagatgtggaccagcgcccccagcctgccccggctggtgcgggagcctgtgcgctgcacctgcagcgcccagggcaccggcttcagctgccccagctctgtgggcggccaccccccccagatgagggtggtgactggagacatcctgacagacatcaccggccacaacgtgtctgagtacctgctcttcaccagtgaccgcttccggctgcaccgctacggggccatcacctttggaaatgtgctgaagagcatcccagccagctttggcacccgggccccacccatggtgaggaagattgctgtgcggcgggccgcccaggtgttctacaacaacaagggctaccacagcatgcccacctacctgaacagcctgaacaatgccatcctgcgggccaacctgcccaagagcaaaggaaatcctgctgcctacggcatcaccgtgaccaaccaccccatgaacaagaccagcgccagcctgagcctggactacctgctgcagggcacagatgtggtgattgccatcttcatcatcgtggccatgagctttgtgcctgccagctttgtggtgttcctggtggccgagaagagcaccaaggccaagcacctgcagtttgtgtctggctgcaaccccatcatctactggctggccaactacgtgtgggacatgctgaactacctggtgcctgccacctgctgcgtcatcatcctgtttgtgtttgacctgcctgcctacaccagccccaccaacttccctgctgtgctgagcctcttcctgctgtatggctggagcatcacccccatcatgtacccagccagcttctggtttgaggtgcccagcagcgcctacgtgttcctgattgtcatcaacctcttcatcggcatcacagccaccgtggccaccttcctgctgcagctgtttgaacatgacaaggacctgaaggtggtgaacagctacctgaagagctgcttcctgatcttccccaactacaacctgggccacggcctgatggagatggcctacaatgagtacatcaatgagtactatgccaagattggccagtttgacaagatgaagagcccctttgagtgggacatcgtgacccggggcctggtggccatggctgtggagggcgtggtgggcttcctgctgaccatcatgtgccagtacaacttcctgcggcggccccagaggatgcctgtgtccaccaagcctgtggaggatgatgtggatgtggccagcgagcggcagagggtgctgcggggagatgctgacaatgacatggtgaagattgagaacctgaccaaggtgtacaagagcaggaagattggccgcatcctggccgtggaccggctgtgcctgggcgtgcggcctggagaatgttttggcctgctgggcgtgaatggagctgggaagaccagcaccttcaagatgctgactggagatgagagcaccactggaggagaggcctttgtgaatggccacagcgtgctgaaggagctgctgcaggtgcagcagagcctgggctactgcccccagtgtgatgccctgtttgatgagctgacagcccgggagcacctgcagctgtacacccggctgcggggcatctcctggaaggatgaggcccgggtggtgaagtgggccctggagaagctggagctgaccaagtatgctgacaagccagctggcacctacagcggcggcaacaagaggaagctgagcacagccatcgccctgattggctacccagccttcatcttcctggatgagcccaccaccggcatggaccccaaggcccggcgcttcctgtggaacctgatcctggacctgatcaagacaggccgctctgtggtgctgaccagccacagcatggaggagtgtgaggccctgtgcacccggctggccatcatggtgaatggccgcctgcgctgcctgggcagcatccagcacctgaagaacagatttggagatggctacatgatcaccgtgaggaccaagagcagccagagcgtgaaggatgtggtgcgcttcttcaacagaaacttccctgaggccatgctgaaggagcggcaccacaccaaggtgcagtaccagctgaagtctgagcacatcagcctggcccaggtgttcagcaagatggagcaggtgtctggagtgctgggcatcgaggactacagcgtgtcccagaccaccctggacaacgtgtttgtgaactttgccaagaagcagagcgacaacctggagcagcaggagacagagcccccatctgccctgcagagccccctgggctgcctgctgagcctgctgcggcccaggtctgcccccacagagctgcgggccctggtggctgatgagcctgaggacctggacacagaagatgagggcctcatcagctttgaggaggagcgggcccagctgtccttcaacacagacaccctgtgctag

SEQ ID NO: 144555 - DNA, 591 bp, Artificial Sequence
  Description of Artificial Sequence: Synthetic coding sequence
atgctgactggagatgagagcaccactggaggagaggcctttgtgaatggccacagcgtgctgaaggagctgctgcaggtgcagcagagcctgggctactgcccccagtgtgatgccctgtttgatgagctgacagcccgggagcacctgcagctgtacacccggctgcggggcatctcctggaaggatgaggcccgggtggtgaagtgggccctggagaagctggagctgaccaagtatgctgacaagccagctggcacctacagcggcggcaacaagaggaagctgagcacagccatcgccctgattggctacccagccttcatcttcctggatgagcccaccaccggcatggaccccaaggcccggcgcttcctgtggaacctgatcctggacctgatcaagacaggccgctctgtggtgctgaccagccacagcatggaggagtgtgaggccctgtgcacccggctggccatcatggagaggagccctgctgtgcccggccagcacccagcccctgaggagcctgtgtggcgctggctgcatgaccacggggctgaccaggagcagccagaatgtgagggccgctag

SEQ ID NO: 144556 - DNA, 5115 bp, Artificial Sequence
  Description of Artificial Sequence: Synthetic coding sequence
atggctgtgctgcggcagctggccctgctgctgtggaagaactacaccctgcagaagaggaaggtgctggtgacagtgctggagctgttcctgcccctgctcttcagcggcatcctgatctggctgcggctgaagatccagagtgaaaatgtgcccaatgccaccatctacccaggccagagcatccaggagctgcccctcttcttcaccttccccccacctggggacacctgggagctggcctacatccccagccacagtgatgctgccaagacagtgacagagaccgtgcggcgggccctggtgatcaacatgagggtgcggggcttccccagcgagaaggactttgaggactacatccgctatgacaactgcagcagctctgtgctggccgctgtggtgtttgagcaccccttcaaccacagcaaggagcccctgcccctggccgtgaagtaccacctgcgcttctcctacaccaggaggaactacatgtggacccagacaggcagcttcttcctgaaggagacagagggctggcacaccaccagcctcttccccctcttccccaaccctggcccccgggagcccaccagcccagatggaggagagcccggctacatccgggagggcttcctggccgtgcagcacgctgtggaccgggccatcatggagtaccacgcagatgctgccacccggcagctgttccagaggctgactgtgaccatcaagcgcttcccctacccacccttcatcgctgaccccttcctggtggccatccagtaccagctgcccctgctgctgctgctgtccttcacctacacagccctgaccatcgcccgggctgtggtgcaggagaaggagcggcggctgaaggagtacatgaggatgatgggcctgagctcctggctgcactggagcgcctggttcctgctcttcttcctgttcctgctgattgctgccagcttcatgaccctgctcttctgtgtgaaggtgaagcccaacgtggccgtgctgagcagaagtgaccccagcctggtgctggccttcctgctgtgctttgccatcagcaccatctccttctccttcatggtgtccaccttcttcagcaaggccaacatggctgctgcctttggaggcttcctgtacttcttcacctacatcccctacttctttgtggccccccgctacaactggatgaccctgagccagaagctgtgcagctgcctgctgagcaatgtggccatggccatgggcgcccagctgattggcaagtttgaggccaagggcatgggcatccagtggagggacctgctgagccctgtgaatgtggatgatgacttctgcttcggccaggtgctgggcatgctgctgctggacagcgtgctgtatggcctggtgacctggtacatggaggccgtgtttcctggccagtttggagtgccccagccctggtacttcttcatcatgcccagctactggtgtgggaagcccagggctgtggccggcaaggaggaggaggacagcgaccctgagaaggccctgagaaatgagtactttgaagctgagcctgaggacctggtggccggcatcaagatcaagcacctgagcaaggtgttccgggtgggcaacaaggacagagctgctgtgcgggacctgaacctgaacctgtatgagggccagatcaccgtgctgctgggccacaacggggccggcaagaccaccaccctgtccatgctgaccggcctcttcccccccaccagcggccgggcctacatcagcggctatgagatcagccaggacatggtgcagatcaggaagagcctgggcctgtgcccccagcacgacatcctgtttgacaacctgactgtggccgagcacctgtacttctacgcccagctgaagggcctgagccggcagaagtgcccagaggaggtgaagcagatgctgcacatcatcggcctggaggacaagtggaacagccgcagccgcttcctgagcggcggcatgaggaggaagctgagcattggaattgccctgattgctggcagcaaggtgctgatcctggatgagcccaccagcggcatggatgccatcagccggcgggccatctgggacctgctgcagaggcagaagagtgacaggaccatcgtgctgaccacccacttcatggatgaggccgacctgctgggggacagaattgccatcatggccaagggggagctgcagtgctgcggcagcagcctcttcctgaagcagaagtacggggccggctaccacatgaccctggtgaaggagccccactgcaaccctgaggacatcagccagctggtgcaccaccacgtgcccaatgccaccctggagagcagcgctggagctgagctgtccttcatcctgccccgggagagcacccacagatttgagggcctgtttgccaagctggagaagaagcagaaggagctgggcatcgccagctttggagccagcatcaccaccatggaggaggtgttcctgcgggtgggcaagctggtggacagctccatggacatccaggccatccagctgcctgccctgcagtaccagcatgaaagaagagccagtgactgggccgtggacagcaacctgtgtggggccatggaccccagtgatggcatcggggccctgattgaggaggagaggacagctgtgaagctgaacacaggcctggccctgcactgccagcagttctgggccatgttcctgaagaaggccgcctacagctggagggagtggaagatggtggccgcccaggtgctggtgcccctgacctgtgtgaccctggccctgctggccatcaactacagcagcgagctgtttgatgaccccatgctgcggctgaccctgggggagtatggccgcacagtggtgcccttctctgtgcccggcaccagccagctgggccagcagctgtctgagcacctgaaggatgccctgcaggccgagggccaggagccccgggaggtgctgggggacctggaggagttcctgatcttccgggcctctgtggagggcggcggcttcaatgaacgctgcctggtggccgccagcttcagagatgtgggggagaggacagtggtgaatgccctcttcaacaaccaggcctaccacagccctgccacagccctggccgtggtggacaacctgctcttcaagctgctgtgtggcccccacgccagcatcgtggtgagcaacttcccccagcccaggtctgccctgcaggccgccaaggaccagttcaatgaaggaaggaagggctttgacatcgccctgaacctgctgtttgccatggccttcctggccagcaccttcagcatcctggccgtgtctgaaagagctgtgcaggccaagcacgtgcagtttgtgtctggagtgcacgtggccagcttctggctgagcgccctgctgtgggacctgatctccttcctgatccccagcctgctgctgctggtggtgttcaaggcctttgatgtgcgggccttcaccagagatggccacatggctgacaccctgctgctgctgctgctgtatggctgggccatcatccccctgatgtacctgatgaacttcttcttcctgggcgccgccacagcctacacccggctgaccatcttcaacatcctgagcggcatcgccaccttcctgatggtgaccatcatgaggatcccagctgtgaagctggaggagctgagcaagaccctggaccacgtgttcctggtgctgcccaaccactgcctgggcatggctgtgtcctccttctatgagaactatgagacccggcgctactgcaccagcagcgaggtggccgcccactactgcaagaagtacaacatccagtaccaggagaacttctacgcctggagcgcccctggggtgggccgctttgtggcctccatggccgccagcggctgtgcctacctgatcctgctcttcctgattgagaccaacctgctgcagaggctgcggggcatcctgtgtgccctgcggcggcggaggaccctgacagagctgtacaccaggatgcctgtgctgcctgaggaccaggatgtggctgatgagaggacccgcatcctggcccccagcccagacagcctgctgcacacccccctcatcatcaaggagctgagcaaggtgtatgagcagagggtgcccctgctggccgtggaccggctgagcctggccgtgcagaagggggagtgcttcggcctgctgggcttcaacggggccggcaagaccaccaccttcaagatgctgaccggggaggagagcctgaccagcggagatgcctttgtgggcggccaccgcatcagcagtgatgtgggcaaggtgcggcagagaattggctactgcccccagtttgatgccctgctggaccacatgacaggccgggagatgctggtgatgtatgcccggctgcggggcatccctgagcggcacatcggggcctgtgtggagaacaccctgcggggcctgctgctggagccccacgccaacaagctggtgaggacctacagcggcggcaacaagaggaagctgagcactggaattgccctgattggagagcctgctgtgatcttcctggatgagcccagcacaggcatggaccctgtggcccggcggctgctgtgggacacagtggcccgggcccgggagagcggcaaggccatcatcatcaccagccacagcatggaggagtgtgaggccctgtgcacccggctggccatcatggtgcagggccagttcaagtgcctgggcagcccccagcacctgaagagcaagtttggaagtggctacagcctgcgggccaaggtgcagagcgagggccagcaggaggccctggaggagttcaaggcctttgtggacctgaccttccctggctctgtgctggaggatgagcaccagggcatggtgcactaccacctgcccggccgggacctgtcctgggccaaggtgtttggcatcctggagaaggccaaggagaagtatggagtggatgactacagcgtgtcccagatcagcctggagcaggtgttcctgagctttgcccacctgcagcccccaacagctgaggagggccgctag

SEQ ID NO: 144557 - DNA, 5127 bp, Artificial Sequence
  Description of Artificial Sequence: Synthetic coding sequence
acagcccccccacccagccccagcctgcccctgcaggacagagctgccaccagcgcccacctggccctcttcaccctgtccttccagagcaccttcctgctcttccctgctggctgcagcgcctacctgaacctgctgcggccccccaccagcctggccgccctgggcgtgcccttcagcaagaccatggctgtgctgcggcagctggccctgctgctgtggaagaactacaccctgcagaagaggaaggtgctggtgacagtgctggagctgttcctgcccctgctcttcagcggcatcctgatctggctgcggctgaagatccagagtgaaaatgtgcccaatgccaccatctacccaggccagagcatccaggagctgcccctcttcttcaccttccccccacctggggacacctgggagctggcctacatccccagccacagtgatgctgccaagacagtgacagagaccgtgcggcgggccctggtgatcaacatgagggtgcggggcttccccagcgagaaggactttgaggactacatccgctatgacaactgcagcagctctgtgctggccgctgtggtgtttgagcaccccttcaaccacagcaaggagcccctgcccctggccgtgaagtaccacctgcgcttctcctacaccaggaggaactacatgtggacccagacaggcagcttcttcctgaaggagacagagggctggcacaccaccagcctcttccccctcttccccaaccctggcccccgggagcccaccagcccagatggaggagagcccggctacatccgggagggcttcctggccgtgcagcacgctgtggaccgggccatcatggagtaccacgcagatgctgccacccggcagctgttccagaggctgactgtgaccatcaagcgcttcccctacccacccttcatcgctgaccccttcctggtggccatccagtaccagctgcccctgctgctgctgctgtccttcacctacacagccctgaccatcgcccgggctgtggtgcaggagaaggagcggcggctgaaggagtacatgaggatgatgggcctgagctcctggctgcactggagcgcctggttcctgctcttcttcctgttcctgctgattgctgccagcttcatgaccctgctcttctgtgtgaaggtgaagcccaacgtggccgtgctgagcagaagtgaccccagcctggtgctggccttcctgctgtgctttgccatcagcaccatctccttctccttcatggtgtccaccttcttcagcaagggcatgggcatccagtggagggacctgctgagccctgtgaatgtggatgatgacttctgcttcggccaggtgctgggcatgctgctgctggacagcgtgctgtatggcctggtgacctggtacatggaggccgtgtttcctggccagtttggagtgccccagccctggtacttcttcatcatgcccagctactggtgtgggaagcccagggctgtggccggcaaggaggaggaggacagcgaccctgagaaggccctgagaaatgagtactttgaagctgagcctgaggacctggtggccggcatcaagatcaagcacctgagcaaggtgttccgggtgggcaacaaggacagagctgctgtgcgggacctgaacctgaacctgtatgagggccagatcaccgtgctgctgggccacaacggggccggcaagaccaccaccctgtccatgctgaccggcctcttcccccccaccagcggccgggcctacatcagcggctatgagatcagccaggacatggtgcagatcaggaagagcctgggcctgtgcccccagcacgacatcctgtttgacaacctgactgtggccgagcacctgtacttctacgcccagctgaagggcctgagccggcagaagtgcccagaggaggtgaagcagatgctgcacatcatcggcctggaggacaagtggaacagccgcagccgcttcctgagcggcggcatgaggaggaagctgagcattggaattgccctgattgctggcagcaaggtgctgatcctggatgagcccaccagcggcatggatgccatcagccggcgggccatctgggacctgctgcagaggcagaagagtgacaggaccatcgtgctgaccacccacttcatggatgaggccgacctgctgggggacagaattgccatcatggccaagggggagctgcagtgctgcggcagcagcctcttcctgaagcagaagtacggggccggctaccacatgaccctggtgaaggagccccactgcaaccctgaggacatcagccagctggtgcaccaccacgtgcccaatgccaccctggagagcagcgctggagctgagctgtccttcatcctgccccgggagagcacccacagatttgagggcctgtttgccaagctggagaagaagcagaaggagctgggcatcgccagctttggagccagcatcaccaccatggaggaggtgttcctgcgggtgggcaagctggtggacagctccatggacatccaggccatccagctgcctgccctgcagtaccagcatgaaagaagagccagtgactgggccgtggacagcaacctgtgtggggccatggaccccagtgatggcatcggggccctgattgaggaggagaggacagctgtgaagctgaacacaggcctggccctgcactgccagcagttctgggccatgttcctgaagaaggccgcctacagctggagggagtggaagatggtggccgcccaggtgctggtgcccctgacctgtgtgaccctggccctgctggccatcaactacagcagcgagctgtttgatgaccccatgctgcggctgaccctgggggagtatggccgcacagtggtgcccttctctgtgcccggcaccagccagctgggccagcagctgtctgagcacctgaaggatgccctgcaggccgagggccaggagccccgggaggtgctgggggacctggaggagttcctgatcttccgggcctctgtggagggcggcggcttcaatgaacgctgcctggtggccgccagcttcagagatgtgggggagaggacagtggtgaatgccctcttcaacaaccaggcctaccacagccctgccacagccctggccgtggtggacaacctgctcttcaagctgctgtgtggcccccacgccagcatcgtggtgagcaacttcccccagcccaggtctgccctgcaggccgccaaggaccagttcaatgaaggaaggaagggctttgacatcgccctgaacctgctgtttgccatggccttcctggccagcaccttcagcatcctggccgtgtctgaaagagctgtgcaggccaagcacgtgcagtttgtgtctggagtgcacgtggccagcttctggctgagcgccctgctgtgggacctgatctccttcctgatccccagcctgctgctgctggtggtgttcaaggcctttgatgtgcgggccttcaccagagatggccacatggctgacaccctgctgctgctgctgctgtatggctgggccatcatccccctgatgtacctgatgaacttcttcttcctgggcgccgccacagcctacacccggctgaccatcttcaacatcctgagcggcatcgccaccttcctgatggtgaccatcatgaggatcccagctgtgaagctggaggagctgagcaagaccctggaccacgtgttcctggtgctgcccaaccactgcctgggcatggctgtgtcctccttctatgagaactatgagacccggcgctactgcaccagcagcgaggtggccgcccactactgcaagaagtacaacatccagtaccaggagaacttctacgcctggagcgcccctggggtgggccgctttgtggcctccatggccgccagcggctgtgcctacctgatcctgctcttcctgattgagaccaacctgctgcagaggctgcggggcatcctgtgtgccctgcggcggcggaggaccctgacagagctgtacaccaggatgcctgtgctgcctgaggaccaggatgtggctgatgagaggacccgcatcctggcccccagcccagacagcctgctgcacacccccctcatcatcaaggagctgagcaaggtgtatgagcagagggtgcccctgctggccgtggaccggctgagcctggccgtgcagaagggggagtgcttcggcctgctgggcttcaacggggccggcaagaccaccaccttcaagatgctgaccggggaggagagcctgaccagcggagatgcctttgtgggcggccaccgcatcagcagtgatgtgggcaaggtgcggcagagaattggctactgcccccagtttgatgccctgctggaccacatgacaggccgggagatgctggtgatgtatgcccggctgcggggcatccctgagcggcacatcggggcctgtgtggagaacaccctgcggggcctgctgctggagccccacgccaacaagctggtgaggacctacagcggcggcaacaagaggaagctgagcactggaattgccctgattggagagcctgctgtgatcttcctggatgagcccagcacaggcatggaccctgtggcccggcggctgctgtgggacacagtggcccgggcccgggagagcggcaaggccatcatcatcaccagccacagcatggaggagtgtgaggccctgtgcacccggctggccatcatggtgcagggccagttcaagtgcctgggcagcccccagcacctgaagagcaagtttggaagtggctacagcctgcgggccaaggtgcagagcgagggccagcaggaggccctggaggagttcaaggcctttgtggacctgaccttccctggctctgtgctggaggatgagcaccagggcatggtgcactaccacctgcccggccgggacctgtcctgggccaaggtgtttggcatcctggagaaggccaaggagaagtatggagtggatgactacagcgtgtcccagatcagcctggagcaggtgttcctgagctttgcccacctgcagcccccaacagctgaggagggccgctag

SEQ ID NO: 144558 - DNA, 6822 bp, Artificial Sequence
  Description of Artificial Sequence: Synthetic coding sequence
atgggctttgtgcggcagatccagctgctgctgtggaagaactggaccctgaggaagaggcagaagatccgctttgtggtggagctggtgtggcccctgagcctcttcctggtgctgatctggctgagaaatgccaaccccctgtacagccaccacgagtgccacttccccaacaaggccatgcccagcgctggcatgctgccctggctgcagggcatcttctgcaatgtgaacaacccctgcttccagagccccaccccaggagagagccctggcatcgtgagcaactacaacaacagcatcctggcccgggtgtacagagacttccaggagctgctgatgaatgcccctgagagccagcacctgggccgcatctggacagagctgcacatcctgagccagttcatggacaccctgcggacccaccctgagagaattgctggccggggcatccgcatccgggacatcctgaaggatgaggagaccctgaccctcttcctgatcaagaacatcggcctgagtgacagcgtggtgtacctgctgatcaacagccaggtgcggcctgagcagtttgcccatggagtgcctgacctggccctgaaggacatcgcctgcagcgaggccctgctggagcgcttcatcatcttcagccagaggagaggagccaagacagtgcgctatgccctgtgcagcctgagccagggcaccctgcagtggattgaggacaccctgtatgccaacgtggacttcttcaagctgttccgggtgctgcccaccctgctggacagccgcagccagggcatcaacctgcgctcctggggcggcatcctgagtgacatgagcccccgcatccaggagttcatccaccggcccagcatgcaggacctgctgtgggtgacccggcccctgatgcagaatggaggccctgagaccttcaccaagctgatgggcatcctgagtgacctgctgtgtggctacccagagggcggcggcagccgggtgctgtccttcaactggtatgaggacaacaactacaaggccttcctgggcatcgacagcaccaggaaggaccccatctacagctatgacaggaggaccaccagcttctgcaatgccctgatccagagcctggagagcaaccccctgaccaagatcgcctggagggctgccaagcccctgctgatgggcaagatcctgtacaccccagacagccctgctgcccggcgcatcctgaagaatgccaacagcacctttgaggagctggagcacgtgaggaagctggtgaaggcctgggaggaggtgggcccccagatctggtacttctttgacaacagcacccagatgaacatgatccgggacaccctgggcaaccccaccgtgaaggacttcctgaaccggcagctgggggaggagggcatcacagctgaggccatcctgaacttcctgtacaagggcccccgggagagccaggctgatgacatggccaactttgactggagggacatcttcaacatcacagacaggaccctgcggctggtgaaccagtacctggagtgcctggtgctggacaagtttgagagctacaatgatgagacccagctgacccagagggccctgagcctgctggaggagaacatgttctgggccggcgtggtgtttcctgacatgtacccctggaccagcagcctgcccccccacgtgaagtacaagatccgcatggacattgatgtggtggagaagaccaacaagatcaaggaccgctactgggacagcggccccagggctgaccctgtggaggacttccgctacatctggggcggctttgcctacctgcaggacatggtggagcagggcatcaccaggagccaggtgcaggccgaggcccctgtgggcatctacctgcagcagatgccctacccctgctttgtggatgacagcttcatgatcatcctgaaccgctgcttccccatcttcatggtgctggcctggatctacagcgtgtccatgacagtgaagagcatcgtgctggagaaggagctgcggctgaaggagaccctgaagaaccagggcgtgtccaatgctgtgatctggtgcacctggttcctggacagcttcagcatcatgtccatgagcatcttcctgctgaccatcttcatcatgcacggccgcatcctgcactacagcgaccccttcatcctcttcctgttcctgctggccttcagcacagccaccatcatgctgtgcttcctgctgagcaccttcttcagcaaggccagcctggccgccgcctgcagcggggtcatctacttcaccctgtacctgccccacatcctgtgctttgcctggcaggacaggatgacagctgagctgaagaaggctgtgtccctgctgagccctgtggccttcggcttcggcacagagtacctggtgcgctttgaggagcagggcctgggcctgcagtggagcaacatcggcaacagccccacagaaggagatgagttctccttcctgctgtccatgcagatgatgctgctggatgctgctgtgtatggcctgctggcctggtacctggaccaggtgtttcctggggactatggcacccccctgccctggtacttcctgctgcaggagagctactggctgggcggggagggctgcagcacccgggaggagcgggccctggagaagacagagcccctgacagaggagacagaagatcctgagcaccctgagggcatccatgacagcttctttgagcgggagcaccctggctgggtgcctggggtgtgtgtgaagaacctggtgaagatctttgagccctgtggccggcctgctgtggaccggctgaacatcaccttctatgagaaccagatcacagccttcctgggccacaatggagctgggaagaccaccaccctgagcatcctgaccggcctgctgccccccaccagcggcaccgtgctggtgggcggccgggacatcgagaccagcctggatgctgtgcggcagagcctgggcatgtgcccccagcacaacatcctcttccaccacctgactgtggccgagcacatgctgttctacgcccagctgaagggcaagagccaggaggaggcccagctggagatggaggccatgctggaggacaccggcctgcaccacaagagaaatgaggaggcccaggacctgagcggcggcatgcagaggaagctgtctgtggccatcgcctttgtgggagatgccaaggtggtgatcctggatgagcccaccagcggcgtggacccctacagcagaagaagcatctgggacctgctgctgaagtacagaagtggccgcaccatcatcatgagcacccaccacatggatgaagctgacctgctgggggaccgcatcgccatcatcgcccagggccgcctgtactgcagcggcacccccctcttcctgaagaactgctttggaacaggcctgtacctgaccctggtgaggaagatgaagaacatccagagccagaggaaaggaagtgagggcacctgcagctgcagcagcaagggcttcagcaccacctgcccagcccacgtggatgacctgaccccagagcaggtgctggatggagatgtgaatgagctgatggatgtggtgctgcaccacgtgcctgaggccaagctggtggagtgcatcggccaggagctgatcttcctgctgcccaacaagaacttcaagcaccgggcctatgccagcctcttccgggagctggaggagaccctggccgacctgggcctgagcagctttggcatcagtgacacccccctggaggagatcttcctgaaggtgacagaggacagcgacagcggccccctgtttgctggaggagcccagcagaagagagaaaatgtgaaccccaggcacccctgcctgggcccccgggagaaggccggccagaccccccaggacagcaatgtgtgcagccctggggccccagctgcccaccctgagggccagcccccacctgagcctgagtgccccggcccccagctgaacacaggcacccagctggtgctgcagcacgtgcaggccctgctggtgaagcgcttccagcacaccatccgcagccacaaggacttcctggcccagatcgtgctgcctgccacctttgtgttcctggccctgatgctgagcatcgtcatccccccatttggagagtacccagccctgaccctgcacccctggatctacggccagcagtacaccttcttctccatggatgagcccggcagcgagcagttcaccgtgctggctgatgtgctgctgaacaagccaggcttcggcaaccgctgcctgaaggagggctggctgcctgagtacccctgtggcaacagcaccccctggaagaccccatctgtgagccccaacatcacccagctgttccagaagcagaagtggacccaggtgaaccccagccccagctgccgctgcagcacccgggagaagctgaccatgctgcctgaatgtcctgagggcgctgggggcctgcccccaccccagaggacccagaggagcacagagatcctgcaggacctgacagacaggaacatcagtgacttcctggtgaagacctacccagccctgatccgcagcagcctgaagagcaagttctgggtgaatgagcagagatatggaggcatcagcatcggcggcaagctgcctgtggtgcccatcaccggggaggccctggtgggcttcctgagtgacctgggccgcatcatgaatgtgtctgggggccccatcacccgggaggccagcaaggagatcccagacttcctgaagcacctggagacagaggacaacatcaaggtgtggttcaacaacaagggctggcacgccctggtgtccttcctgaatgtggcccacaatgccatcctgcgggccagcctgcccaaggacaggagccctgaggagtatggcatcaccgtcatcagccagcccctgaacctgaccaaggagcagctgtctgagatcaccgtgctgaccacctctgtggatgctgtggtggccatctgtgtgatcttctccatgagctttgtgcctgccagctttgtgctgtacctgatccaggagcgggtgaacaagagcaagcacctgcagttcatcagcggcgtgagccccaccacctactgggtgaccaacttcctgtgggacatcatgaactacagcgtgtctgctggcctggtggtgggcatcttcatcggcttccagaagaaggcctacaccagccctgagaacctgcctgccctggtggccctgctgctgctgtatggctgggccgtcatccccatgatgtacccagccagcttcctgtttgatgtgcccagcacagcctacgtggccctgagctgtgccaacctcttcatcggcatcaacagcagcgccatcaccttcatcctggagctgtttgagaacaacagaaccctgctgcgcttcaatgctgtgctgaggaagctgctgattgtgttcccccacttctgcctgggccggggcctgattgacctggccctgagccaggccgtgacagatgtgtatgccaggtttggagaggagcacagcgccaaccccttccactgggacctgattggcaagaacctgtttgccatggtggtggagggcgtggtgtacttcctgctgaccctgctggtgcagaggcacttcttcctgagccagtggattgctgagcccaccaaggagcccatcgtggatgaagatgatgatgtggccgaggagcggcagaggatcatcaccggcggcaacaagacagacatcctgcggctgcacgagctgaccaagatctacccaggcaccagcagccctgctgtggaccggctgtgtgtgggcgtgcggcctggagagtgcttcggcctgctgggcgtgaatggagctgggaagaccaccaccttcaagatgctgaccggggacaccaccgtgaccagcggagatgccaccgtggccggcaagagcatcctgaccaacatcagcgaggtgcaccagaacatgggctactgcccccagtttgatgccattgatgagctgctgaccggccgggagcacctgtacctgtatgcccggctgcggggcgtgcctgctgaggagattgagaaggtggccaactggagcatcaagagcctgggcctgactgtgtatgctgactgcctggccggcacctacagcggcggcaacaagaggaagctgagcacagccatcgccctgattggctgcccccccctggtgctgctggatgagcccaccaccggcatggacccccaggcccggaggatgctgtggaatgtgattgtgtccatcatccgggagggccgggctgtggtgctgaccagccacagcatggaggagtgtgaggccctgtgcacccggctggccatcatggtgaagggggccttccgctgcatgggcaccatccagcacctgaagagcaagtttggagatggctacatcgtgaccatgaagatcaagagccccaaggatgacctgctgcctgacctgaaccctgtggagcagttcttccagggcaacttccctggctctgtgcagcgggagcggcactacaacatgctgcagttccaggtgagcagcagcagcctggcccgcatcttccagctgctgctgagccacaaggacagcctgctgattgaggagtacagcgtgacccagaccaccctggaccaggtgtttgtgaactttgccaagcagcagacagagagccatgacctgcccctgcaccccagggctgctggggccagccggcaggcccaggactag

SEQ ID NO: 144559 - DNA, 2940 bp, Artificial Sequence
  Description of Artificial Sequence: Synthetic coding sequence
atgggctttgtgcggcagatccagctgctgctgtggaagaactggaccctgaggaagaggcagaagatccgctttgtggtggagctggtgtggcccctgagcctcttcctggtgctgatctggctgagaaatgccaaccccctgtacagccaccacgagtgccacttccccaacaaggccatgcccagcgctggcatgctgccctggctgcagggcatcttctgcaatgtgaacaacccctgcttccagagccccaccccaggagagagccctggcatcgtgagcaactacaacaacagcatcctggcccgggtgtacagagacttccaggagctgctgatgaatgcccctgagagccagcacctgggccgcatctggacagagctgcacatcctgagccagttcatggacaccctgcggacccaccctgagagaattgctggccggggcatccgcatccgggacatcctgaaggatgaggagaccctgaccctcttcctgatcaagaacatcggcctgagtgacagcgtggtgtacctgctgatcaacagccaggtgcggcctgagcagtttgcccatggagtgcctgacctggccctgaaggacatcgcctgcagcgaggccctgctggagcgcttcatcatcttcagccagaggagaggagccaagacagtgcgctatgccctgtgcagcctgagccagggcaccctgcagtggattgaggacaccctgtatgccaacgtggacttcttcaagctgttccgggtgctgcccaccctgctggacagccgcagccagggcatcaacctgcgctcctggggcggcatcctgagtgacatgagcccccgcatccaggagttcatccaccggcccagcatgcaggacctgctgtgggtgacccggcccctgatgcagaatggaggccctgagaccttcaccaagctgatgggcatcctgagtgacctgctgtgtggctacccagagggcggcggcagccgggtgctgtccttcaactggtatgaggacaacaactacaaggccttcctgggcatcgacagcaccaggaaggaccccatctacagctatgacaggaggaccaccagcttctgcaatgccctgatccagagcctggagagcaaccccctgaccaagatcgcctggagggctgccaagcccctgctgatgggcaagatcctgtacaccccagacagccctgctgcccggcgcatcctgaagaatgccaacagcacctttgaggagctggagcacgtgaggaagctggtgaaggcctgggaggaggtgggcccccagatctggtacttctttgacaacagcacccagatgaacatgatccgggacaccctgggcaaccccaccgtgaaggacttcctgaaccggcagctgggggaggagggcatcacagctgaggccatcctgaacttcctgtacaagggcccccgggagagccaggctgatgacatggccaactttgactggagggacatcttcaacatcacagacaggaccctgcggctggtgaaccagtacctggagtgcctggtgctggacaagtttgagagctacaatgatgagacccagctgacccagagggccctgagcctgctggaggagaacatgttctgggccggcgtggtgtttcctgacatgtacccctggaccagcagcctgcccccccacgtgaagtacaagatccgcatggacattgatgtggtggagaagaccaacaagatcaaggaccgctactgggacagcggccccagggctgaccctgtggaggacttccgctacatctggggcggctttgcctacctgcaggacatggtggagcagggcatcaccaggagccaggtgcaggccgaggcccctgtgggcatctacctgcagcagatgccctacccctgctttgtggatgacagcttcatgatcatcctgaaccgctgcttccccatcttcatggtgctggcctggatctacagcgtgtccatgacagtgaagagcatcgtgctggagaaggagctgcggctgaaggagaccctgaagaaccagggcgtgtccaatgctgtgatctggtgcacctggttcctggacagcttcagcatcatgtccatgagcatcttcctgctgaccatcttcatcatgagcctgctgagccctgtggccttcggcttcggcacagagtacctggtgcgctttgaggagcagggcctgggcctgcagtggagcaacatcggcaacagccccacagaaggagatgagttctccttcctgctgtccatgcagatgatgctgctggatgctgctgtgtatggcctgctggcctggtacctggaccaggtgtttcctggggactatggcacccccctgccctggtacttcctgctgcaggagagctactggctgggcggggagggctgcagcacccgggaggagcgggccctggagaagacagagcccctgacagaggagacagaagatcctgagcaccctgagggcatccatgacagcttctttgagcgggagcaccctggctgggtgcctggggtgtgtgtgaagaacctggtgaagatctttgagccctgtggccggcctgctgtggaccggctgaacatcaccttctatgagaaccagatcacagccttcctgggccacaatggagctgggaagaccaccaccttctctgctggggcccccctgagcagcaagggccctgagcggcacctgctgcggggggagcacggccccccctggttccccaaggagcagcagaccaggaccagccagggcgccgccaacccccgggacaccgtcttcaagagctttggagagccccaggagggcaccacagcctgcaccccctgtgatggcatgttcagcagagctgtgcagtgtgagtggaatgtgggccctgtgcccttctag

SEQ ID NO: 144560 - DNA, 1179 bp, Artificial Sequence
  Description of Artificial Sequence: Synthetic coding sequence
atggtggtggagggcgtggtgtacttcctgctgaccctgctggtgcagaggcacttcttcctgagccagtggattgctgagcccaccaaggagcccatcgtggatgaagatgatgatgtggccgaggagcggcagaggatcatcactggaggcaacaagacagacatcctgcggctgcacgagctgaccaagatctacccaggcaccagcagccctgctgtggaccggctgtgtgtgggcgtgcggcctggagaatgttttggcctgctgggcgtgaatggagctgggaagaccaccaccttcaagatgctgactggagacaccaccgtgaccagcggagatgccaccgtggccggcaagagcatcctgaccaacatcagcgaggtgcaccagaacatgggctactgcccccagtttgatgccattgatgagctgctgaccggccgggagcacctgtacctgtatgcccggctgcggggcgtgcctgctgaggagattgagaaggtggccaactggagcatcaagagcctgggcctgactgtgtatgctgactgcctggccggcacctacagcggcggcaacaagaggaagctgagcacagccatcgccctgattggctgcccccccctggtgctgctggatgagcccaccaccggcatggacccccaggcccggaggatgctgtggaatgtcatcgtgtccatcatccgggagggccgggctgtggtgctgaccagccacagcatggaggagtgtgaggccctgtgcacccggctggccatcatggtgaagggggccttccgctgcatgggcaccatccagcacctgaagagcaagtttggagatggctacatcgtgaccatgaagatcaagagccccaaggatgacctgctgcctgacctgaaccctgtggagcagttcttccagggcaacttccctggctctgtgcagcgggagcggcactacaacatgctgcagttccaggtgagcagcagcagcctggcccgcatcttccagctgctgctgagccacaaggacagcctgctgattgaggagtacagcgtgacccagaccaccctggaccaggtgtttgtgaactttgccaagcagcagacagagagccatgacctgcccctgcaccccagggctgctggggccagccggcaggcccaggactag

SEQ ID NO: 144561 - DNA, 1632 bp, Artificial Sequence
  Description of Artificial Sequence: Synthetic coding sequence
atgatgatgaactacagcgtgtctgctggcctggtggtgggcatcttcatcggcttccagaagaaggcctacaccagccctgagaacctgcctgccctggtggccctgctgctgctgtatggctgggccgtcatccccatgatgtacccagccagcttcctgtttgatgtgcccagcacagcctacgtggccctgagctgtgccaacctcttcatcggcatcaacagcagcgccatcaccttcatcctggagctgtttgagaacaacagaaccctgctgcgcttcaatgctgtgctgaggaagctgctgattgtgttcccccacttctgcctgggccggggcctgattgacctggccctgagccaggccgtgacagatgtgtatgccaggtttggagaggagcacagcgccaaccccttccactgggacctgattggcaagaacctgtttgccatggtggtggagggcgtggtgtacttcctgctgaccctgctggtgcagaggcacttcttcctgagccagtggattgctgagcccaccaaggagcccatcgtggatgaagatgatgatgtggccgaggagcggcagaggatcatcaccggcggcaacaagacagacatcctgcggctgcacgagctgaccaagatctacccaggcaccagcagccctgctgtggaccggctgtgtgtgggcgtgcggcctggagagtgcttcggcctgctgggcgtgaatggagctgggaagaccaccaccttcaagatgctgaccggggacaccaccgtgaccagcggagatgccaccgtggccggcaagagcatcctgaccaacatcagcgaggtgcaccagaacatgggctactgcccccagtttgatgccattgatgagctgctgaccggccgggagcacctgtacctgtatgcccggctgcggggcgtgcctgctgaggagattgagaaggtggccaactggagcatcaagagcctgggcctgactgtgtatgctgactgcctggccggcacctacagcggcggcaacaagaggaagctgagcacagccatcgccctgattggctgcccccccctggtgctgctggatgagcccaccaccggcatggacccccaggcccggaggatgctgtggaatgtgattgtgtccatcatccgggagggccgggctgtggtgctgaccagccacagcatggaggagtgtgaggccctgtgcacccggctggccatcatggtgaagggggccttccgctgcatgggcaccatccagcacctgaagagcaagtttggagatggctacatcgtgaccatgaagatcaagagccccaaggatgacctgctgcctgacctgaaccctgtggagcagttcttccagggcaacttccctggctctgtgcagcgggagcggcactacaacatgctgcagttccaggtgagcagcagcagcctggcccgcatcttccagctgctgctgagccacaaggacagcctgctgattgaggagtacagcgtgacccagaccaccctggaccaggtgtttgtgaactttgccaagcagcagacagagagccatgacctgcccctgcaccccagggctgctggggccagccggcaggcccaggactag

SEQ ID NO: 144562 - DNA, 3198 bp, Artificial Sequence
  Description of Artificial Sequence: Synthetic coding sequence
atggatgtggtgctgcaccacgtgcctgaggccaagctggtggagtgcatcggccaggagctgatcttcctgctgcccaacaagaacttcaagcaccgggcctatgccagcctcttccgggagctggaggagaccctggccgacctgggcctgagcagctttggcatcagtgacacccccctggaggagatcttcctgaaggtgacagaggacagcgacagcggccccctgtttgctggaggagcccagcagaagagagaaaatgtgaaccccaggcacccctgcctgggcccccgggagaaggccggccagaccccccaggacagcaatgtgtgcagccctggggccccagctgcccaccctgagggccagcccccacctgagcctgagtgccccggcccccagctgaacacaggcacccagctggtgctgcagcacgtgcaggccctgctggtgaagcgcttccagcacaccatccgcagccacaaggacttcctggcccagatcgtgctgcctgccacctttgtgttcctggccctgatgctgagcatcgtcatccccccatttggagagtacccagccctgaccctgcacccctggatctacggccagcagtacaccttcttctccatggatgagcccggcagcgagcagttcaccgtgctggctgatgtgctgctgaacaagccaggcttcggcaaccgctgcctgaaggagggctggctgcctgagtacccctgtggcaacagcaccccctggaagaccccatctgtgagccccaacatcacccagctgttccagaagcagaagtggacccaggtgaaccccagccccagctgccgctgcagcacccgggagaagctgaccatgctgcctgaatgtcctgagggcgctgggggcctgcccccaccccagaggacccagaggagcacagagatcctgcaggacctgacagacaggaacatcagtgacttcctggtgaagacctacccagccctgatccgcagcagcctgaagagcaagttctgggtgaatgagcagagatatggaggcatcagcatcggcggcaagctgcctgtggtgcccatcaccggggaggccctggtgggcttcctgagtgacctgggccgcatcatgaatgtgtctgggggccccatcacccgggaggccagcaaggagatcccagacttcctgaagcacctggagacagaggacaacatcaaggtgtggttcaacaacaagggctggcacgccctggtgtccttcctgaatgtggcccacaatgccatcctgcgggccagcctgcccaaggacaggagccctgaggagtatggcatcaccgtcatcagccagcccctgaacctgaccaaggagcagctgtctgagatcaccgtgctgaccacctctgtggatgctgtggtggccatctgtgtgatcttctccatgagctttgtgcctgccagctttgtgctgtacctgatccaggagcgggtgaacaagagcaagcacctgcagttcatcagcggcgtgagccccaccacctactgggtgaccaacttcctgtgggacatcatgaactacagcgtgtctgctggcctggtggtgggcatcttcatcggcttccagaagaaggcctacaccagccctgagaacctgcctgccctggtggccctgctgctgctgtatggctgggccgtcatccccatgatgtacccagccagcttcctgtttgatgtgcccagcacagcctacgtggccctgagctgtgccaacctcttcatcggcatcaacagcagcgccatcaccttcatcctggagctgtttgagaacaacagaaccctgctgcgcttcaatgctgtgctgaggaagctgctgattgtgttcccccacttctgcctgggccggggcctgattgacctggccctgagccaggccgtgacagatgtgtatgccaggtttggagaggagcacagcgccaaccccttccactgggacctgattggcaagaacctgtttgccatggtggtggagggcgtggtgtacttcctgctgaccctgctggtgcagaggcacttcttcctgagccagtggattgctgagcccaccaaggagcccatcgtggatgaagatgatgatgtggccgaggagcggcagaggatcatcaccggcggcaacaagacagacatcctgcggctgcacgagctgaccaagatctacccaggcaccagcagccctgctgtggaccggctgtgtgtgggcgtgcggcctggagagtgcttcggcctgctgggcgtgaatggagctgggaagaccaccaccttcaagatgctgaccggggacaccaccgtgaccagcggagatgccaccgtggccggcaagagcatcctgaccaacatcagcgaggtgcaccagaacatgggctactgcccccagtttgatgccattgatgagctgctgaccggccgggagcacctgtacctgtatgcccggctgcggggcgtgcctgctgaggagattgagaaggtggccaactggagcatcaagagcctgggcctgactgtgtatgctgactgcctggccggcacctacagcggcggcaacaagaggaagctgagcacagccatcgccctgattggctgcccccccctggtgctgctggatgagcccaccaccggcatggacccccaggcccggaggatgctgtggaatgtgattgtgtccatcatccgggagggccgggctgtggtgctgaccagccacagcatggaggagtgtgaggccctgtgcacccggctggccatcatggtgaagggggccttccgctgcatgggcaccatccagcacctgaagagcaagtttggagatggctacatcgtgaccatgaagatcaagagccccaaggatgacctgctgcctgacctgaaccctgtggagcagttcttccagggcaacttccctggctctgtgcagcgggagcggcactacaacatgctgcagttccaggtgagcagcagcagcctggcccgcatcttccagctgctgctgagccacaaggacagcctgctgattgaggagtacagcgtgacccagaccaccctggaccaggtgtttgtgaactttgccaagcagcagacagagagccatgacctgcccctgcaccccagggctgctggggccagccggcaggcccaggactag

SEQ ID NO: 144563 - DNA, 4929 bp, Artificial Sequence
  Description of Artificial Sequence: Synthetic coding sequence
atgagcacagccatccgggaggtgggcgtgtggaggcagaccaggaccctgctgctgaagaactacctgatcaagtgcaggaccaagaagagctctgtgcaggagatcctcttccccctcttcttcctgttctggctgatcctgatctccatgatgcaccccaacaagaagtatgaggaggtgcccaacatcgagctgaaccccatggacaagttcaccctgagcaacctgatcctgggctacacccctgtgaccaacatcaccagcagcatcatgcagaaggtgtccacagaccacctgcctgatgtgatcatcacagaggagtacaccaatgagaaggagatgctgaccagcagcctgagcaagcccagcaactttgtgggcgtggtgttcaaggacagcatgtcctatgagctgcgcttcttcccagacatgatccctgtgagcagcatctacatggacagcagagctggctgcagcaagagctgtgaggccgcccagtactggagcagcggcttcaccgtgctgcaggccagcattgatgctgccatcatccagctgaagaccaacgtgtccctgtggaaggagctggagagcaccaaggccgtcatcatgggagaaacagctgtggtggagattgacaccttcccccggggcgtcatcctgatctacctggtgattgccttcagccccttcggctacttcctggccatccacatcgtggccgagaaggagaagaagatcaaggagttcctgaagatcatgggcctgcatgacacagccttctggctgtcctgggtgctgctgtacaccagcctcatcttcctgatgagcctgctgatggccgtcatcgccacagccagcctgctcttcccccagagcagcagcatcgtcatcttcctgctcttcttcctgtatggcctgagcagcgtcttctttgccctgatgctgacccccctcttcaagaagagcaagcacgtgggcatcgtggagttctttgtgacagtggccttcggcttcatcggcctgatgatcatcctgattgagagcttccccaagagcctggtgtggctgttcagccccttctgccactgcacctttgtgattggaattgcccaggtgatgcacctggaggacttcaatgaaggagccagcttcagcaacctgacagctggcccctaccccctcatcatcaccatcatcatgctgaccctgaacagcatcttctacgtgctgctggccgtgtacctggaccaggtgattcctggagaatttggcctgcggcgcagcagcctgtacttcctgaagcccagctactggagcaagagcaagagaaattatgaggagctgtctgagggcaatgtgaatggaaacatctccttcagcgagatcatcgagcctgtgagcagcgagtttgtgggcaaggaggccatccgcatcagcggcatccagaagacctacaggaagaagggggagaatgtggaggccctgaggaacctgagctttgacatctatgagggccagatcacagccctgctgggccacagcggcaccgggaagagcaccctgatgaacatcctgtgtggcctgtgccccccatctgatggctttgccagcatctacggccaccgggtgtctgaaattgatgagatgtttgaggccaggaagatgattggcatctgcccccagctggacatccactttgatgtgctgactgtggaggagaacctgagcatcctggccagcatcaagggcatcccagccaacaacatcatccaggaggtgcagaaggtgctgctggacctggacatgcagaccatcaaggacaaccaggccaagaagctgagcggcggccagaagaggaagctgagcctgggcattgctgtgctgggcaaccccaagatcctgctgctggatgagcccacagctggcatggacccctgcagccgccacatcgtgtggaacctgctgaagtacaggaaggccaacagagtgaccgtcttcagcacccacttcatggatgaggccgacatcctggccgacaggaaggccgtcatcagccagggcatgctgaagtgtgtgggcagctccatgttcctgaagagcaagtggggcatcggctaccgcctgtccatgtacatcgacaagtactgtgccacagagagcctgagcagcctggtgaagcagcacatccctggggccaccctgctgcagcagaatgaccagcagctggtgtacagcctgcccttcaaggacatggacaagttcagcggcctcttcagcgccctggacagccacagcaacctgggcgtcatctcctatggagtgtccatgaccaccctggaggatgtgttcctgaagctggaggtggaggccgagattgaccaggccgactacagcgtcttcacccagcagcccctggaggaggagatggacagcaagagctttgatgagatggagcagagcctgctgatcctgtctgagaccaaggccgccctggtgtccaccatgagcctgtggaagcagcagatgtacaccatcgccaagttccacttcttcaccctgaagcgggagagcaagtctgtgcgctctgtgctgctgctgctgctgatcttcttcaccgtgcagatcttcatgttcctggtgcaccacagcttcaagaatgctgtggtgcccatcaagctggtgcctgacctgtacttcctgaagccaggggacaagccccacaagtacaagaccagcctgctgctgcagaacagcgctgacagcgacatcagtgacctgatctccttcttcaccagccagaacatcatggtgaccatgatcaatgacagcgactatgtgtctgtggccccccacagcgctgccctgaatgtgatgcacagcgagaaggactatgtgtttgctgctgtgttcaacagcaccatggtgtacagcctgcccatcctggtgaacatcatcagcaactactacctgtaccacctgaatgtgacagagaccatccagatctggagcacccccttcttccaggagatcacagacatcgtgttcaagattgagctgtacttccaggccgccctgctgggcatcatcgtgacagccatgccaccctactttgccatggagaatgctgagaaccacaagatcaaggcctacacccagctgaagctgagcggcctgctgcccagcgcctactggattggccaggccgtggtggacatccccctcttcttcatcatcctgatcctgatgctgggcagcctgctggccttccactacggcctgtacttctacacagtgaagttcctggccgtggtgttctgcctgattggctacgtgcccagcgtcatcctcttcacctacatcgccagcttcaccttcaagaagatcctgaacaccaaggagttctggagcttcatctacagcgtggccgccctggcctgcatcgccatcacagagatcaccttcttcatgggctacaccatcgccaccatcctgcactacgccttctgcatcatcatccccatctaccccctgctgggctgcctgatctccttcatcaagatctcctggaagaatgtgaggaagaatgtggacacctacaacccctgggaccggctgtctgtggccgtcatcagcccctacctgcagtgtgtgctgtggatcttcctgctgcagtactatgagaagaagtatggaggccgcagcatcaggaaggaccccttcttcaggaacctgagcaccaagagcaagaacaggaagctgcctgagcccccagacaatgaagatgaagatgaagatgtgaaggccgagcggctgaaggtgaaggagctgatgggctgccagtgctgtgaggagaagcccagcatcatggtgagcaacctgcacaaggagtatgatgacaagaaggacttcctgctgagcaggaaggtgaagaaggtggccaccaagtacatctccttctgtgtgaagaagggggagatcctgggcctgctgggccccaatggagctgggaagagcaccatcatcaacatcctggtgggggacatcgagcccaccagcggccaggtgttcctgggggactacagcagcgagaccagtgaagatgatgacagcctgaagtgcatgggctactgcccccagatcaaccccctgtggccagacaccaccctgcaggagcactttgagatctacggggctgtgaagggcatgtctgccagtgacatgaaggaggtgatcagccgcatcacccacgccctggacctgaaggagcacctgcagaagacagtgaagaagctgcctgctggcatcaagaggaagctgtgctttgccctgtccatgctgggcaacccccagatcaccctgctggatgagcccagcacaggcatggaccccaaggccaagcagcacatgtggagggccatcagaacagccttcaagaacaggaagagagctgccatcctgaccacccactacatggaggaggccgaggccgtgtgtgacagagtggccatcatggtgtctggccagctgcgctgcatcggcaccgtgcagcacctgaagagcaagtttgggaagggctacttcctggagatcaagctgaaggactggattgagaacctggaggtggaccggctgcagcgggagatccagtacatcttccccaatgccagccggcaggagagcttcagcagcatcctggcctacaagatccccaaggaggatgtgcagagcctgagccagagcttcttcaagctggaggaggccaagcacgcctttgccatcgaggagtacagcttcagccaggccaccctggagcaggtgtttgtggagctgaccaaggagcaggaggaggaggacaacagctgtggcaccctgaacagcaccctgtggtgggagaggacccaggaggacagagtggtgttctag

SEQ ID NO: 144564 - DNA, 4932 bp, Artificial Sequence
  Description of Artificial Sequence: Synthetic coding sequence
atgagcacagccatccgggaggtgggcgtgtggaggcagaccaggaccctgctgctgaagaactacctgatcaagtgcaggaccaagaagagctctgtgcaggagatcctcttccccctcttcttcctgttctggctgatcctgatctccatgatgcaccccaacaagaagtatgaggaggtgcccaacatcgagctgaaccccatggacaagttcaccctgagcaacctgatcctgggctacacccctgtgaccaacatcaccagcagcatcatgcagaaggtgtccacagaccacctgcctgatgtgatcatcacagaggagtacaccaatgagaaggagatgctgaccagcagcctgagcaagcccagcaactttgtgggcgtggtgttcaaggacagcatgtcctatgagctgcgcttcttcccagacatgatccctgtgagcagcatctacatggacagcagagctggctgcagcaagagctgtgaggccgcccagtactggagcagcggcttcaccgtgctgcaggccagcattgatgctgccatcatccagctgaagaccaacgtgtccctgtggaaggagctggagagcaccaaggccgtcatcatgggagaaacagctgtggtggagattgacaccttcccccggggcgtcatcctgatctacctggtgattgccttcagccccttcggctacttcctggccatccacatcgtggccgagaaggagaagaagatcaaggagttcctgaagatcatgggcctgcatgacacagccttctggctgtcctgggtgctgctgtacaccagcctcatcttcctgatgagcctgctgatggccgtcatcgccacagccagcctgctcttcccccagagcagcagcatcgtcatcttcctgctcttcttcctgtatggcctgagcagcgtcttctttgccctgatgctgacccccctcttcaagaagagcaagcacgtgggcatcgtggagttctttgtgacagtggccttcggcttcatcggcctgatgatcatcctgattgagagcttccccaagagcctggtgtggctgttcagccccttctgccactgcacctttgtgattggaattgcccaggtgatgcacctggaggacttcaatgaaggagccagcttcagcaacctgacagctggcccctaccccctcatcatcaccatcatcatgctgaccctgaacagcatcttctacgtgctgctggccgtgtacctggaccaggtgattcctggagaatttggcctgcggcgcagcagcctgtacttcctgaagcccagctactggagcaagagcaagagaaattatgaggagctgtctgagggcaatgtgaatggaaacatctccttcagcgagatcatcgagcctgtgagcagcgagtttgtgggcaaggaggccatccgcatcagcggcatccagaagacctacaggaagaagggggagaatgtggaggccctgaggaacctgagctttgacatctatgagggccagatcacagccctgctgggccacagcggcaccgggaagagcaccctgatgaacatcctgtgtggcctgtgccccccatctgatggctttgccagcatctacggccaccgggtgtctgaaattgatgagatgtttgaggccaggaagatgattggcatctgcccccagctggacatccactttgatgtgctgactgtggaggagaacctgagcatcctggccagcatcaagggcatcccagccaacaacatcatccaggaggtgcagaaggtgctgctggacctggacatgcagaccatcaaggacaaccaggccaagaagctgagcggcggccagaagaggaagctgagcctgggcattgctgtgctgggcaaccccaagatcctgctgctggatgagcccacagctggcatggacccctgcagccgccacatcgtgtggaacctgctgaagtacaggaaggccaacagagtgaccgtcttcagcacccacttcatggatgaggccgacatcctggccgacaggaaggccgtcatcagccagggcatgctgaagtgtgtgggcagctccatgttcctgaagagcaagtggggcatcggctaccgcctgtccatgtacatcgacaagtactgtgccacagagagcctgagcagcctggtgaagcagcacatccctggggccaccctgctgcagcagaatgaccagcagctggtgtacagcctgcccttcaaggacatggacaagttcagcggcctcttcagcgccctggacagccacagcaacctgggcgtcatctcctatggagtgtccatgaccaccctggaggatgtgttcctgaagctggaggtggaggccgagattgaccaggccgactacagcgtcttcacccagcagcccctggaggaggagatggacagcaagagctttgatgagatggagcagagcctgctgatcctgtctgagaccaaggccgccctggtgtccaccatgagcctgtggaagcagcagatgtacaccatcgccaagttccacttcttcaccctgaagcgggagagcaagtctgtgcgctctgtgctgctgctgctgctgatcttcttcaccgtgcagatcttcatgttcctggtgcaccacagcttcaagaatgctgtggtgcccatcaagctggtgcctgacctgtacttcctgaagccaggggacaagccccacaagtacaagaccagcctgctgctgcagaacagcgctgctgacagcgacatcagtgacctgatctccttcttcaccagccagaacatcatggtgaccatgatcaatgacagcgactatgtgtctgtggccccccacagcgctgccctgaatgtgatgcacagcgagaaggactatgtgtttgctgctgtgttcaacagcaccatggtgtacagcctgcccatcctggtgaacatcatcagcaactactacctgtaccacctgaatgtgacagagaccatccagatctggagcacccccttcttccaggagatcacagacatcgtgttcaagattgagctgtacttccaggccgccctgctgggcatcatcgtgacagccatgccaccctactttgccatggagaatgctgagaaccacaagatcaaggcctacacccagctgaagctgagcggcctgctgcccagcgcctactggattggccaggccgtggtggacatccccctcttcttcatcatcctgatcctgatgctgggcagcctgctggccttccactacggcctgtacttctacacagtgaagttcctggccgtggtgttctgcctgattggctacgtgcccagcgtcatcctcttcacctacatcgccagcttcaccttcaagaagatcctgaacaccaaggagttctggagcttcatctacagcgtggccgccctggcctgcatcgccatcacagagatcaccttcttcatgggctacaccatcgccaccatcctgcactacgccttctgcatcatcatccccatctaccccctgctgggctgcctgatctccttcatcaagatctcctggaagaatgtgaggaagaatgtggacacctacaacccctgggaccggctgtctgtggccgtcatcagcccctacctgcagtgtgtgctgtggatcttcctgctgcagtactatgagaagaagtatggaggccgcagcatcaggaaggaccccttcttcaggaacctgagcaccaagagcaagaacaggaagctgcctgagcccccagacaatgaagatgaagatgaagatgtgaaggccgagcggctgaaggtgaaggagctgatgggctgccagtgctgtgaggagaagcccagcatcatggtgagcaacctgcacaaggagtatgatgacaagaaggacttcctgctgagcaggaaggtgaagaaggtggccaccaagtacatctccttctgtgtgaagaagggggagatcctgggcctgctgggccccaacggggccggcaagagcaccatcatcaacatcctggtgggggacatcgagcccaccagcggccaggtgttcctgggggactacagcagcgagaccagtgaagatgatgacagcctgaagtgcatgggctactgcccccagatcaaccccctgtggccagacaccaccctgcaggagcactttgagatctatggagctgtgaagggcatgtctgccagtgacatgaaggaggtgatcagccgcatcacccacgccctggacctgaaggagcacctgcagaagacagtgaagaagctgcctgctggcatcaagaggaagctgtgctttgccctgtccatgctgggcaacccccagatcaccctgctggatgagcccagcacaggcatggaccccaaggccaagcagcacatgtggagggccatcagaacagccttcaagaacaggaagagagctgccatcctgaccacccactacatggaggaggccgaggccgtgtgtgacagagtggccatcatggtgtctggccagctgcgctgcattggaacagtgcagcacctgaagagcaagtttgggaagggctacttcctggagatcaagctgaaggactggattgagaacctggaggtggaccggctgcagcgggagatccagtacatcttccccaatgccagccggcaggagagcttcagcagcatcctggcctacaagatccccaaggaggatgtgcagagcctgagccagagcttcttcaagctggaggaggccaagcacgcctttgccatcgaggagtacagcttcagccaggccaccctggagcaggtgtttgtggagctgaccaaggagcaggaggaggaggacaacagctgtggcaccctgaacagcaccctgtggtgggagaggacccaggaggacagagtggtgttctag

SEQ ID NO: 144565 - DNA, 4854 bp, Artificial Sequence
  Description of Artificial Sequence: Synthetic coding sequence
atgaacatgaagcagaagtctgtgtaccagcagaccaaggccctgctgtgcaagaacttcctgaagaagtggaggatgaagcgggagagcctgctggagtggggcctgagcatcctgctgggcctgtgcatcgccctcttcagcagctccatgagaaatgtgcagtttcctggcatggccccccagaacctgggccgggtggacaagttcaacagcagcagcctgatggtggtgtacacccccatcagcaacctgacccagcagatcatgaacaagacagccctggcccccctgctgaagggcacctctgtgattggagcccccaacaagacccacatggatgagatcctgctggagaacctgccctatgccatgggcatcatcttcaatgagaccttctcctacaagctgatcttcttccagggctacaacagccccctgtggaaggaggacttcagcgcccactgctgggatggctacggggagttcagctgcaccctgaccaagtactggaacagaggatttgtggccctgcagacagccatcaacacagccatcatcgagatcaccaccaaccaccctgtgatggaggagctgatgtctgtgacagccatcaccatgaagaccctgcccttcatcaccaagaacctgctgcacaatgagatgttcatcctcttcttcctgctgcacttcagccccctggtgtacttcatcagcctgaatgtgaccaaggagaggaagaagagcaagaacctgatgaagatgatgggcctgcaggacagcgccttctggctgtcctggggcctcatctatgccggcttcatcttcatcatcagcatctttgtgaccatcatcatcaccttcacccagatcatcgtgatgacaggcttcatggtgatcttcatcctcttcttcctgtatggcctgagcctggtggccctggtgttcctgatgtctgtgctgctgaagaaggctgtgctgaccaacctggtggtgttcctgctgaccctcttctggggctgcctgggcttcaccgtcttctatgagcagctgcccagcagcctggagtggatcctgaacatctgcagcccctttgccttcaccaccggcatgatccagatcatcaagctggactacaacctgaatggagtcatcttcccagaccccagcggggacagctacaccatgattgccaccttctccatgctgctgctggatggcctcatctacctgctgctggccctgtactttgacaagatcctgccctatggagatgagcggcactacagccccctcttcttcctgaacagcagcagctgcttccagcaccagaggaccaatgccaaggtgattgagaaggagattgatgctgagcaccccagtgatgactactttgagcctgtggcccctgagttccagggcaaggaggccatccgcatcagaaatgtgaagaaggagtacaagggcaagagcggcaaggtggaggccctgaagggcctgctgtttgacatctatgagggccagatcacagccatcctgggccacagcggggccggcaagagcagcctgctgaacatcctgaatggcctgtctgtgcccacagagggctctgtgaccatctacaacaagaacctgtctgagatgcaggacctggaggagatcaggaagatcaccggggtgtgcccccagttcaacgtgcagtttgacatcctgactgtgaaggagaacctgagcctgtttgccaagatcaagggcatccacctgaaggaggtggagcaggaggtgcagaggatcctgctggagctggacatgcagaacatccaggacaacctggccaagcacctgtctgagggccagaagaggaagctgaccttcggcatcaccatcctgggggacccccagatcctgctgctggatgagcccaccaccggcctggaccccttcagccgggaccaggtgtggagcctgctgcgggagcggcgggctgaccacgtgatcctcttcagcacccagagcatggatgaggccgacatcctggccgacaggaaggtgatcatgagcaatggccgcctgaagtgtgccggcagctccatgttcctgaagaggcgctggggcctgggctaccacctgagcctgcacagaaatgagatctgcaaccctgagcagatcaccagcttcatcacccaccacatcccagatgccaagctgaagacagagaacaaggagaagctggtgtacaccctgcccctggagaggaccaacaccttcccagacctcttcagtgacctggacaagtgcagcgaccagggcgtgacaggctatgacatctccatgagcaccctgaatgaggtgttcatgaagctggagggccagagcaccatcgagcaggactttgagcaggtggagatgatccgggacagcgagagcctgaatgagatggagctggcccacagcagcttcagcgagatgcagacagctgtgtctgacatgggcctgtggaggatgcaggtgtttgccatggcccggctgcgcttcctgaagctgaagaggcagaccaaggtgctgctgaccctgctgctggtgtttggcatcgccatcttccccctcatcgtggagaacatcatgtatgccatgctgaatgagaagattgactgggagttcaagaatgagctgtacttcctgagccctggccagctgccccaggagcccaggaccagcctgctgatcatcaacaacacagagagcaacatcgaggacttcatcaagagcctgaagcaccagaacatcctgctggaggtggatgactttgaaaatagaaatggaacagatggcctgagctacaacggggccatcatcgtgtctgggaagcagaaggactaccgcttctctgtggtgtgcaacaccaagaggctgcactgcttccccatcctgatgaacatcatcagcaatggcctgctgcagatgttcaaccacacccagcacatcagaattgagagcagccccttccccctgagccacatcggcctgtggacaggcctgcctgatggcagcttcttcctgttcctggtgctgtgcagcatcagcccctacatcaccatgggcagcatcagtgactacaagaagaatgccaagagccagctgtggatcagcggcctgtacaccagcgcctactggtgtggccaggccctggtggatgtgtccttcttcatcctgatcctgctgctgatgtacctgatcttctacatcgagaacatgcagtacctgctgatcaccagccagatcgtgtttgccctggtgattgtgaccccaggctacgccgccagcctggtgttcttcatctacatgatctccttcatcttcaggaagaggaggaagaacagcggcctgtggagcttctacttcttctttgccagcaccatcatgttcagcatcaccctcatcaaccactttgacctgagcatcctgatcaccaccatggtgctggtgcccagctacaccctgctgggcttcaagaccttcctggaggtgcgggaccaggagcactaccgggagttccctgaggccaactttgagctgagcgccacagacttcctggtgtgcttcatcccctacttccagaccctgctgtttgtgtttgtgctgcgctgcatggagctgaagtgtgggaagaagaggatgaggaaggaccccgtcttccgcatcagcccccagagcagagatgccaagcccaaccctgaggagcccattgatgaagatgaggacatccagacagagcgcatcagaacagccacagccctgaccaccagcatcctggatgagaagcctgtgatcatcgccagctgcctgcacaaggagtatgccggccagaagaagagctgcttcagcaagaggaagaagaagattgctgccaggaacatctccttctgtgtgcaggagggggagatcctgggcctgctgggccccaacggggccggcaagagcagcagcatccgcatgatcagcggcatcaccaagcccacagctggggaggtggagctgaagggctgcagctctgtgctgggccacctgggctactgcccccaggagaatgtgctgtggcccatgctgaccctgcgggagcacctggaggtgtatgctgctgtgaagggcctgaggaaggcagatgcccggctggccatcgcccggctggtgtctgccttcaagctgcacgagcagctgaatgtgcctgtgcagaagctgacagctggcatcaccaggaagctgtgctttgtgctgagcctgctgggcaacagccctgtgctgctgctggatgagcccagcactggaattgaccccaccggccagcagcagatgtggcaggccatccaggccgtggtgaagaacacagagcggggcgtgctgctgaccacccacaacctggccgaggccgaggccctgtgtgacagagtggccatcatggtgtctggccgcctgcgctgcatcggcagcatccagcacctgaagaacaagctgggcaaggactacatcctggagctgaaggtgaaggagaccagccaggtgaccctggtgcacacagagatcctgaagctgttcccccaggccgccggccaggagcgctacagcagcctgctgacctacaagctgcctgtggctgatgtgtaccccctgagccagaccttccacaagctggaggccgtgaagcacaacttcaacctggaggagtacagcctgagccagtgcaccctggagaaggtgttcctggagctgagcaaggagcaggaggtgggcaactttgatgaggagattgacaccaccatgcgctggaagctgctgccccacagtgatgagccctag

SEQ ID NO: 144566 - DNA, 1434 bp, Artificial Sequence
  Description of Artificial Sequence: Synthetic coding sequence
atgttcagcatcaccctcatcaaccactttgacctgagcatcctgatcaccaccatggtgctggtgcccagctacaccctgctgggcttcaagaccttcctggaggtgcgggaccaggagcactaccgggagttccctgaggccaactttgagctgagcgccacagacttcctggtgtgcttcatcccctacttccagaccctgctgtttgtgtttgtgctgcgctgcatggagctgaagtgtgggaagaagaggatgaggaaggaccccgtcttccgcatcagcccccagagcagagatgccaagcccaaccctgaggagcccattgatgaagatgaggacatccagacagagcgcatcagaacagccacagccctgaccaccagcatcctggatgagaagcctgtgatcatcgccagctgcctgcacaaggagtatgccggccagaagaagagctgcttcagcaagaggaagaagaagattgctgccaggaacatctccttctgtgtgcaggagggggagatcctgggcctgctgggccccaacggggccggcaagagcagcagcatccgcatgatcagcggcatcaccaagcccacagctggggaggtggagctgaagggctgcagctctgtgctgggccacctgggctactgcccccaggagaatgtgctgtggcccatgctgaccctgcgggagcacctggaggtgtatgctgctgtgaagggcctgaggaaggcagatgcccggctggccatcgcccggctggtgtctgccttcaagctgcacgagcagctgaatgtgcctgtgcagaagctgacagctggcatcaccaggaagctgtgctttgtgctgagcctgctgggcaacagccctgtgctgctgctggatgagcccagcactggaattgaccccaccggccagcagcagatgtggcaggccatccaggccgtggtgaagaacacagagcggggcgtgctgctgaccacccacaacctggccgaggccgaggccctgtgtgacagagtggccatcatggtgtctggccgcctgcgctgcatcggcagcatccagcacctgaagaacaagctgggcaaggactacatcctggagctgaaggtgaaggagaccagccaggtgaccctggtgcacacagagatcctgaagctgttcccccaggccgccggccaggagcgctacagcagcctgctgacctacaagctgcctgtggctgatgtgtaccccctgagccagaccttccacaagctggaggccgtgaagcacaacttcaacctggaggagtacagcctgagccagtgcaccctggagaaggtgttcctggagctgagcaaggagcaggaggtgggcaactttgatgaggagattgacaccaccatgcgctggaagctgctgccccacagtgatgagccctag

SEQ ID NO: 144567 - DNA, 6441 bp, Artificial Sequence
  Description of Artificial Sequence: Synthetic coding sequence
atggccttctggacccagctgatgctgctgctgtggaagaacttcatgtacagaagacggcagcctgtgcagctgctggtggagctgctgtggcccctcttcctgttcttcatcctggtggccgtgcgccacagccacccccccctggagcaccacgagtgccacttccccaacaagcccctgcccagcgctggcaccgtgccctggctgcagggcctcatctgcaatgtgaacaacacctgcttcccccagctgaccccaggagaggagcccggccgcctgagcaacttcaatgacagcctggtgtcccggctgctggctgatgccaggacagtgctgggcggggccagcgcccacaggaccctggccggcctgggcaagctgattgccaccctgcgggccgcccggagcacagcccagccccagcccaccaagcagagccccctggagccccccatgctggatgtggccgagctgctgaccagcctgctgaggacagagagcctgggcctggccctgggccaggcccaggagcccctgcacagcctgctggaggccgctgaggacctggcccaggagctgctggccctgcggagcctggtggagctgcgggccctgctgcagaggccccggggcaccagcggccccctggagctgctgtctgaggccctgtgcagcgtgcggggccccagcagcacagtgggccccagcctgaactggtatgaggccagtgacctgatggagctggtgggccaggagcctgagagcgccctgcctgacagcagcctgagccctgcctgcagcgagctgattggagccctggacagccaccccctgagccggctgctgtggaggcggctgaagcccctcatcctgggcaagctgctgtttgccccagacacccccttcaccaggaagctgatggcccaggtgaacagaacatttgaggagctgaccctgctgagagatgtgcgggaggtgtgggagatgctgggcccccgcatcttcaccttcatgaatgacagcagcaatgtggccatgctgcagaggctgctgcagatgcaggatgagggccggcggcagcccaggcctgggggccgggaccacatggaggccctgcgctccttcctggaccccggcagcggcggctacagctggcaggatgcccatgctgatgtgggccacctggtgggcaccctgggccgggtgacagaatgtctgagcctggacaagctggaggccgcccccagcgaggccgccctggtgtcccgggccctgcagctgctggccgagcaccgcttctgggccggcgtggtgttcctgggccctgaggacagcagtgaccccacagagcaccccaccccagacctgggccctggccacgtgcgcatcaagatccgcatggacattgatgtggtgaccaggaccaacaagatccgggaccgcttctgggaccccggccctgctgctgaccccctgacagacctgcgctacgtgtggggcggctttgtgtacctgcaggacctggtggagagagctgctgtgcgggtgctgagcggggccaaccccagggctggcctgtacctgcagcagatgccctacccctgctacgtggatgatgtgttcctgcgggtgctgagccgcagcctgcccctcttcctgaccctggcctggatctacagcgtgaccctgactgtgaaggctgtggtgcgggagaaggagacccggctgcgggacaccatgagggccatgggcctgagcagagctgtgctgtggctgggctggttcctgagctgcctgggccccttcctgctgtctgctgccctgctggtgctggtgctgaagctgggggacatcctgccctacagccaccctggggtggtgttcctgttcctggccgcctttgctgtggccaccgtgacccagagcttcctgctgagcgccttcttcagccgggccaacctggccgccgcctgtggcggcctggcctacttcagcctgtacctgccctacgtgctgtgtgtggcctggagggaccggctgcctgctgggggccgggtggccgccagcctgctgagccctgtggcctttggatttggctgtgagagcctggccctgctggaggagcagggcgagggcgcccagtggcacaacgtgggcacccggcccacagcagatgtgttcagcctggcccaggtgtctggcctgctgctgctggatgctgccctgtatggcctggccacctggtacctggaggccgtgtgccccggccagtatggcatccctgagccctggaacttccccttccgccgcagctactggtgtggccccaggcctcccaagagccctgccccctgccccacccccctggaccccaaggtgctggtggaggaggcccctcctggcctgagccctggggtgtctgtgcgcagcctggagaagcgcttccctggcagcccccagcctgccctgcggggcctgagcctggacttctaccagggccacatcacagccttcctgggccacaatggagctgggaagaccaccaccctgagcatcctgagcggcctcttccccccatctgggggcagcgccttcatcctgggccatgatgtgcgcagctccatggccgccatccggccccacctgggcgtgtgcccccagtacaacgtgctgtttgacatgctgactgtggatgaacatgtgtggttctacggccgcctgaagggcctgtctgctgctgtggtgggccctgagcaggaccggctgctgcaggatgtgggcctggtgtccaagcagagcgtgcagaccaggcacctgagcggcggcatgcagaggaagctgtctgtggccatcgcctttgtgggcggcagccaggtggtgatcctggatgagcccacagctggggtggaccctgccagcagaagaggcatctgggagctgctgctgaagtaccgggagggccgcaccctcatcctgagcacccaccacctggatgaagctgagctgctgggggacagagtggccgtggtggccggcggccgcctgtgctgctgcggcagccccctcttcctgcggcggcacctgggcagcggctactacctgaccctggtgaaggcccggctgcccctgaccaccaatgagaaggctgacacagacatggagggctctgtggacacccggcaggagaagaagaatggcagccagggcagccgggtgggcaccccccagctgctggccctggtgcagcactgggtgcctggggcccggctggtggaggagctgccccatgagctggtgctggtgctgccctacaccggggcccatgatggcagctttgccaccctcttccgggagctggacacccggctggccgagctgcggctgaccggctacggcatcagtgacaccagcctggaggagatcttcctgaaggtggtggaggagtgtgccgctgacacagacatggaggatggcagctgtggccagcacctgtgcacaggaattgctggcctggatgtgaccctgcggctgaagatgccaccccaggagacagccctggagaatggagagcctgctggcagcgcccctgagacagaccagggcagcggcccagatgctgtgggccgggtgcagggctgggccctgacccggcagcagctgcaggccctgctgctgaagcgcttcctgctggcccggcgcagccggcggggcctgtttgcccagatcgtgctgcctgccctgtttgtgggcctggccctggtgttcagcctgattgtgcccccatttggccactacccagccctgcggctgagccccaccatgtacggggcccaggtgtccttcttctctgaagatgcccctggggaccccggccgggcccggctgctggaggccctgctgcaggaggccggcctggaggagccccctgtgcagcacagcagccaccgcttcagcgcccctgaggtgcctgctgaggtggccaaggtgctggccagcggcaactggaccccagagagccccagccctgcctgccagtgcagcaggcctggggcccggcggctgctgcctgactgcccagctgctgctgggggccccccaccaccccaggccgtgactggaagtggagaggtggtgcagaacctgactggaagaaacctgagtgacttcctggtgaagacctacccccggctggtgcggcagggcctgaagaccaagaagtgggtgaatgaggtgcgctatggaggcttcagcctgggcggccgggaccccggcctgcccagcggccaggagctgggccgctctgtggaggagctgtgggccctgctgagccccctgcctggaggagccctggacagagtgctgaagaacctgacagcctgggcccacagcctggatgcccaggacagcctgaagatctggttcaacaacaagggctggcacagcatggtggcctttgtgaacagagccagcaatgccatcctgcgggcccacctgcccccaggccctgcccggcatgcccacagcatcaccaccctgaaccaccccctgaacctgaccaaggagcagctgtctgagggcgccctgatggccagctctgtggatgtgctggtgtccatctgtgtggtgtttgccatgagctttgtgcctgccagcttcaccctggtgctgattgaggagcgggtgacccgggccaagcacctgcagctgatgggcggcctgagccccaccctgtactggctgggcaacttcctgtgggacatgtgcaactacctggtgcctgcctgcatcgtggtgctgatcttcctggccttccagcagagggcctacgtggccccagccaacctgcctgccctgctgctgctgctgctgctgtatggctggagcatcacccccctgatgtacccagccagcttcttcttctctgtgcccagcacagcctacgtggtgctgacctgcatcaacctcttcatcggcatcaatggctccatggccacctttgtgctggagctgttcagtgaccagaagctgcaggaggtgagccgcatcctgaagcaggtgttcctgatcttcccccacttctgcctgggccggggcctgattgacatggtgaggaaccaggccatggctgatgcctttgagcggctgggggaccggcagttccagagccccctgcgctgggaggtggtgggcaagaacctgctggccatggtgatccagggccccctcttcctgctcttcaccctgctgctgcagcacaggagccagctgctgccccagccccgggtgcgcagcctgcccctgctgggggaggaggatgaagatgtggcccgggagcgggagcgggtggtgcagggcgccacccagggagatgtgctggtgctgaggaacctgaccaaggtgtaccggggccagaggatgcctgctgtggaccggctgtgcctgggcatccccccaggagaatgttttggcctgctgggcgtgaatggagctgggaagaccagcaccttcaggatggtgactggagacaccctggccagcagaggagaggccgtgctggccggccacagcgtggcccgggagcccagcgctgcccacctgtccatgggctactgcccccagagtgatgccatctttgagctgctgaccggccgggagcacctggagctgctggcccggctgcggggcgtgcctgaggcccaggtggcccagacagctggcagcggcctggcccggctgggcctgtcctggtatgctgacaggcctgctggcacctacagcggcggcaacaagaggaagctggccacagccctggccctggtgggggaccctgctgtggtgttcctggatgagcccaccaccggcatggaccccagcgcccggcgcttcctgtggaacagcctgctggccgtggtgcgggagggccgctctgtgatgctgaccagccacagcatggaggagtgtgaggccctgtgcagccggctggccatcatggtgaatggccgcttccgctgcctgggcagcccccagcacctgaagggccgctttgctgctggccacaccctgaccctgcgggtgcctgctgcccggagccagcctgctgctgcctttgtggccgctgagttccctggagctgagctgcgggaggcccatggaggccgcctgcgcttccagctgcccccaggcggccgctgtgccctggcccgggtgtttggagagctggccgtgcatggagctgagcacggcgtggaggacttctctgtgtcccagaccatgctggaggaggtgttcctgtacttcagcaaggaccagggcaaggatgaggacacagaggagcagaaggaggccggcgtgggcgtggaccctgcccctggcctgcagcaccccaagagggtgtcccagttcctggatgaccccagcacagctgagaccgtgctgtag

SEQ ID NO: 144568 - DNA, 6441 bp, Artificial Sequence; identical to SEQ ID NO: 144567
  Description of Artificial Sequence: Synthetic coding sequence

SEQ ID NO: 144569 - DNA, 495 bp, Artificial Sequence
  Description of Artificial Sequence: Synthetic coding sequence
atggccttctggacccagctgatgctgctgctgtggaagaacttcatgtacagaagacggcagcctgtgcagctgctggtggagctgctgtggcccctcttcctgttcttcatcctggtggccgtgcgccacagccacccccccctggagcaccacgagtgccacttccccaacaagcccctgcccagcgctggcaccgtgccctggctgcagggcctcatctgcaatgtgaacaacacctgcttcccccagctgaccccaggagaggagcccggccgcctgagcaacttcaatgacagcctggtgtcccggctgctggctgatgccaggacagtgctgggcggggccagcgcccacaggaccctggccggcctgggcaagctgattgccaccctgcgggccgcccggagcacagcccagccccagcccaccaagcagagccccctggagccccccatgctggatgtggccgagctgctgaccagcctgctgtag

SEQ ID NO: 144570 - DNA, 4746 bp, Artificial Sequence
  Description of Artificial Sequence: Synthetic coding sequence
atgaggaagaggaagatctctgtgtgccagcagacctgggccctgctgtgcaagaacttcctgaagaagtggaggatgaagcgggagagcctgatggagtggctgaacagcctgctgctgctgctgtgcctgtacatctacccccacagccaccaggtgaatgacttcagcagcctgctgaccatggacctgggccgggtggacaccttcaatgaaagccgcttctctgtggtgtacacccctgtgaccaacaccacccagcagatcatgaacaaggtggccagcacccccttcctggccggcaaggaggtgctgggcctgcctgatgaggagagcatcaaggagttcaccgccaactacccagaggagatcgtgcgggtgaccttcaccaacacctacagctaccacctgaagttcctgctgggccacggcatgcctgccaagaaggagcacaaggaccacacagcccactgctatgagaccaatgaagatgtgtactgtgaggtgtctgtgttctggaaggagggctttgtggccctgcaggccgccatcaatgctgccatcatcgagatcaccaccaaccacagcgtgatggaggagctgatgtctgtgacaggcaagaacatgaagatgcacagcttcatcggccagagcggggtcatcacagacctgtacctgttcagctgcatcatctccttcagcagcttcatctactatgcctctgtgaatgtgacccgggagaggaagaggatgaaggccctgatgaccatgatgggcctgcgggacagcgccttctggctgtcctggggcctgctgtatgccggcttcatcttcatcatggccctcttcctggccctggtgatccgcagcacccagttcatcatcctgagcggcttcatggtggtgttcagcctcttcctgctgtatggcctgagcctggtggccctggccttcctgatgagcatcctggtgaagaagagcttcctgaccggcctggtggtgttcctgctgaccgtcttctggggctgcctgggcttcaccagcctgtaccgccacctgcctgccagcctggagtggatcctgagcctgctgagcccctttgccttcatgctgggcatggcccagctgctgcacctggactatgacctgaacagcaatgccttcccccaccccagtgatggcagcaacctgattgtggccaccaacttcatgctggcctttgacacctgcctgtacctggccctggccatctactttgagaagatcctgcccaatgaatatggccaccggcggcccccactcttcttcctgaagagcagcttctggagccagacccagaagacagaccacgtggccctggaggatgagatggatgctgaccccagcttccatgacagctttgagcaggcccctcctgagttccagggcaaggaggccatccgcatcagaaatgtgaccaaggagtacaagggcaagccagacaagattgaggccctgaaggacctggtgtttgacatctatgagggccagatcacagccatcctgggccacagcggggccggcaagagcaccctgctgaacatcctgagcggcctgtctgtgcccaccaagggctctgtgaccatctacaacaacaagctgtctgagatggctgacctggagaacctgagcaagctgactggagtgtgcccccagagcaatgtgcagtttgacttcctgactgtgcgggagaacctgcggctgtttgccaagatcaagggcatcctgccccaggaggtggacaaggagatcttcctgctggatgagcccacagctggcctggaccccttcagccgccaccaggtgtggaacctgctgaaggagaggaagacagacagagtcatcctcttcagcacccagttcatggatgaggccgacatcctggccgacaggaaggtgttcctgagccagggcaagctgaagtgtgccggcagcagcctcttcctgaagaagaagtggggcatcggctaccacctgagcctgcagctgaatgagatctgtgtggaggagaacatcaccagcctggtgaagcagcacatcccagatgccaagctgagcgccaagtctgagggcaagctgatctacaccctgcccctggagaggaccaacaagtttcctgagctgtacaaggacctggacagctacccagacctgggcatcgagaactacggcgtgtccatgaccaccctgaatgaggtgttcctgaagctggagggcaagagcaccatcaatgaaagtgacatcgccatcctgggggaggtgcaggccgagaaggcagatgacacagagcggctggtggagatggagcaggtgctgagcagcctgaacaagatgaggaagaccatcggcggcgtggccctgtggaggcagcagatctgtgccatcgcccgggtgcggctgctgaagctgaagcatgagaggaaggccctgctggccctgctgctgatcctgatggccggcttctgccccctgctggtggagtacaccatggtgaagatctaccagaacagctacacctgggagctgagcccccacctgtacttcctggcccctggccagcagccccatgaccccctgacccagctgctgatcatcaacaagacaggagccagcattgatgacttcatccagagcgtggagcaccagaacatcgccctggaggtggatgccttcggcaccagaaatggaacagatgaccccagctacaacggggccatcaccgtgtgctgcaatgagaagaactacagcttcagcctggcctgcaatgccaagaggctgaactgcttccctgtgctgatggacatcgtgtccaatggcctgctgggcatggtgaagcccagcgtgcacatcagaacagagaggagcaccttcctggagaatggccaggacaaccccatcggcttcctggcctacatcatgttctggctggtgctgaccagcagctgccccccctacatcgccatgagcagcattgatgactacaagaacagagcccggagccagctgcgcatcagcggcctgagccccagcgcctactggtttggccaggccctggtggatgtgtccctgtacttcctggtgtttgtgttcatctacctgatgagctacatcagcaactttgaggacatgctgctgaccatcatccacatcatccagatcccctgtgctgtgggctacagcttcagcctcatcttcatgacctacgtgatctccttcatcttcagaaaaggaaggaagaacagcggcatctggagcttctgcttctacgtggtgacagtgttttctgtggccggctttgccttcagcatctttgaaagtgacatccccttcatcttcaccttcctgatccccccagccaccatgattggctgcctcttcctgagcagccacctgctcttcagcagcctcttcagcgaggagaggatggatgtgcagcccttcctggtgttcctgatccccttcctgcacttcatcatcttcctgttcaccctgcgctgcctggagtggaagtttgggaagaagtccatgaggaaggaccccttcttccgcatcagccccaggagcagtgatgtgtgccagaaccctgaggagcctgagggggaggatgaagatgtgcagatggagcgggtgaggacagccaatgccctgaacagcaccaactttgatgagaagcctgtgatcatcgccagctgcctgaggaaggagtatgctgggaagaggaagggctgcttcagcaagaggaagaacaagatcgccaccagaaatgtgtccttctgtgtgaggaaaggagaggtgctgggcctgctgggccacaatggagctgggaagagcaccagcatcaaggtgatcactggagacaccaagcccacagctggccaggtgctgctgaagggcagcggcggcggagatgccctggagttcctgggctactgcccccaggagaatgccctgtggcccaacctgactgtgcggcagcacctggaggtgtatgctgctgtgaagggcctgaggaaaggagatgctgaggtggccatcacccggctggtggatgccctgaagctgcaggaccagctgaagagccctgtgaagaccctgtctgagggcatcaagaggaagctgtgctttgtgctgagcatcctgggcaaccccagcgtggtgctgctggatgagcccagcacaggcatggaccctgagggccagcagcagatgtggcaggccatccgggccaccttcaggaacacagagcggggggccctgctgaccacccactacatggccgaggccgaggccgtgtgtgacagagtggccatcatggtgtctggccgcctgcgctgcatcggcagcatccagcacctgaagagcaagtttgggaaggactacctgctggagatgaaggtgaagaacctggcccaggtggagcccctgcacgccgagatcctgcggctcttcccccaggccgcccggcaggagcgctacagcagcctgatggtgtacaagctgcctgtggaggatgtgcagcccctggcccaggccttcttcaagctggagaaggtgaagcagagctttgacctggaggagtacagcctgagccagagcaccctggagcaggtgttcctggagctgagcaaggagcaggagctgggggactttgaagaagattttgaccccagcgtgaagtggaagctgctgccccaggaggagccctag

SEQ ID NO: 144571 - DNA, 801 bp, Artificial Sequence
  Description of Artificial Sequence: Synthetic coding sequence
atgaggaagaggaagatctctgtgtgccagcagacctgggccctgctgtgcaagaacttcctgaagaagtggaggatgaagcgggagagcctgatggagtggctgaacagcctgctgctgctgctgtgcctgtacatctacccccacagccaccaggtgaatgacttcagcagcctgctgaccatggacctgggccgggtggacaccttcaatgaaagccgcttctctgtggtgtacacccctgtgaccaacaccacccagcagatcatgaacaaggtggccagcacccccttcctggccggcaaggaggtgctgggcctgcctgatgaggagagcatcaaggagttcaccgccaactacccagaggagatcgtgcgggtgaccttcaccaacacctacagctaccacctgaagttcctgctgggccacggcatgcctgccaagaaggagcacaaggaccacacagcccactgctatgagaccaatgaagatgtgtactgtgaggtgtctgtgttctggaaggagggctttgtggccctgcaggccgccatcaatgctgccatcatcgagatcaccaccaaccacagcgtgatggaggagctgatgtctgtgacaggcaagaacatgaagatgcacagcttcatcggccagagcggggtcatcacagacctgtacctgttcagctgcatcatctccttcagcagcttcatctactatgcctctgtgaatgtgacccgggagaggaagaggatgaaggccctgatgaccatgatgggcctgcgggacagcgccttctggtag

SEQ ID NO: 144572 - DNA, 4866 bp, Artificial Sequence
  Description of Artificial Sequence: Synthetic coding sequence
atgaggaagaggaagatctctgtgtgccagcagacctgggccctgctgtgcaagaacttcctgaagaagtggaggatgaagcgggagagcctgatggagtggctgaacagcctgctgctgctgctgtgcctgtacatctacccccacagccaccaggtgaatgacttcagcagcctgctgaccatggacctgggccgggtggacaccttcaatgaaagccgcttctctgtggtgtacacccctgtgaccaacaccacccagcagatcatgaacaaggtggccagcacccccttcctggccggcaaggaggtgctgggcctgcctgatgaggagagcatcaaggagttcaccgccaactacccagaggagatcgtgcgggtgaccttcaccaacacctacagctaccacctgaagttcctgctgggccacggcatgcctgccaagaaggagcacaaggaccacacagcccactgctatgagaccaatgaagatgtgtactgtgaggtgtctgtgttctggaaggagggctttgtggccctgcaggccgccatcaatgctgccatcatcgagatcaccaccaaccacagcgtgatggaggagctgatgtctgtgacaggcaagaacatgaagatgcacagcttcatcggccagagcggggtcatcacagacctgtacctgttcagctgcatcatctccttcagcagcttcatctactatgcctctgtgaatgtgacccgggagaggaagaggatgaaggccctgatgaccatgatgggcctgcgggacagcgccttctggctgtcctggggcctgctgtatgccggcttcatcttcatcatggccctcttcctggccctggtgatccgcagcacccagttcatcatcctgagcggcttcatggtggtgttcagcctcttcctgctgtatggcctgagcctggtggccctggccttcctgatgagcatcctggtgaagaagagcttcctgaccggcctggtggtgttcctgctgaccgtcttctggggctgcctgggcttcaccagcctgtaccgccacctgcctgccagcctggagtggatcctgagcctgctgagcccctttgccttcatgctgggcatggcccagctgctgcacctggactatgacctgaacagcaatgccttcccccaccccagtgatggcagcaacctgattgtggccaccaacttcatgctggcctttgacacctgcctgtacctggccctggccatctactttgagaagatcctgcccaatgaatatggccaccggcggcccccactcttcttcctgaagagcagcttctggagccagacccagaagacagaccacgtggccctggaggatgagatggatgctgaccccagcttccatgacagctttgagcaggcccctcctgagttccagggcaaggaggccatccgcatcagaaatgtgaccaaggagtacaagggcaagccagacaagattgaggccctgaaggacctggtgtttgacatctatgagggccagatcacagccatcctgggccacagcggggccggcaagagcaccctgctgaacatcctgagcggcctgtctgtgcccaccaagggctctgtgaccatctacaacaacaagctgtctgagatggctgacctggagaacctgagcaagctgactggagtgtgcccccagagcaatgtgcagtttgacttcctgactgtgcgggagaacctgcggctgtttgccaagatcaagggcatcctgccccaggaggtggacaaggagatccagagggtgctgctggagctggagatgaagaacatccaggatgtgctggcccagaacctgagcggcggccagaagaggaagctgacctttggaattgccatcctgggggacccccagatcttcctgctggatgagcccacagctggcctggaccccttcagccgccaccaggtgtggaacctgctgaaggagaggaagacagacagagtcatcctcttcagcacccagttcatggatgaggccgacatcctggccgacaggaaggtgttcctgagccagggcaagctgaagtgtgccggcagcagcctcttcctgaagaagaagtggggcatcggctaccacctgagcctgcagctgaatgagatctgtgtggaggagaacatcaccagcctggtgaagcagcacatcccagatgccaagctgagcgccaagtctgagggcaagctgatctacaccctgcccctggagaggaccaacaagtttcctgagctgtacaaggacctggacagctacccagacctgggcatcgagaactacggcgtgtccatgaccaccctgaatgaggtgttcctgaagctggagggcaagagcaccatcaatgaaagtgacatcgccatcctgggggaggtgcaggccgagaaggcagatgacacagagcggctggtggagatggagcaggtgctgagcagcctgaacaagatgaggaagaccatcggcggcgtggccctgtggaggcagcagatctgtgccatcgcccgggtgcggctgctgaagctgaagcatgagaggaaggccctgctggccctgctgctgatcctgatggccggcttctgccccctgctggtggagtacaccatggtgaagatctaccagaacagctacacctgggagctgagcccccacctgtacttcctggcccctggccagcagccccatgaccccctgacccagctgctgatcatcaacaagacaggagccagcattgatgacttcatccagagcgtggagcaccagaacatcgccctggaggtggatgccttcggcaccagaaatggaacagatgaccccagctacaacggggccatcaccgtgtgctgcaatgagaagaactacagcttcagcctggcctgcaatgccaagaggctgaactgcttccctgtgctgatggacatcgtgtccaatggcctgctgggcatggtgaagcccagcgtgcacatcagaacagagaggagcaccttcctggagaatggccaggacaaccccatcggcttcctggcctacatcatgttctggctggtgctgaccagcagctgccccccctacatcgccatgagcagcattgatgactacaagaacagagcccggagccagctgcgcatcagcggcctgagccccagcgcctactggtttggccaggccctggtggatgtgtccctgtacttcctggtgtttgtgttcatctacctgatgagctacatcagcaactttgaggacatgctgctgaccatcatccacatcatccagatcccctgtgctgtgggctacagcttcagcctcatcttcatgacctacgtgatctccttcatcttcagaaaaggaaggaagaacagcggcatctggagcttctgcttctacgtggtgacagtgttttctgtggccggctttgccttcagcatctttgaaagtgacatccccttcatcttcaccttcctgatccccccagccaccatgattggctgcctcttcctgagcagccacctgctcttcagcagcctcttcagcgaggagaggatggatgtgcagcccttcctggtgttcctgatccccttcctgcacttcatcatcttcctgttcaccctgcgctgcctggagtggaagtttgggaagaagtccatgaggaaggaccccttcttccgcatcagccccaggagcagtgatgtgtgccagaaccctgaggagcctgagggggaggatgaagatgtgcagatggagcgggtgaggacagccaatgccctgaacagcaccaactttgatgagaagcctgtgatcatcgccagctgcctgaggaaggagtatgctgggaagaggaagggctgcttcagcaagaggaagaacaagatcgccaccagaaatgtgtccttctgtgtgaggaaaggagaggtgctgggcctgctgggccacaatggagctgggaagagcaccagcatcaaggtgatcactggagacaccaagcccacagctggccaggtgctgctgaagggcagcggcggcggagatgccctggagttcctgggctactgcccccaggagaatgccctgtggcccaacctgactgtgcggcagcacctggaggtgtatgctgctgtgaagggcctgaggaaaggagatgctgaggtggccatcacccggctggtggatgccctgaagctgcaggaccagctgaagagccctgtgaagaccctgtctgagggcatcaagaggaagctgtgctttgtgctgagcatcctgggcaaccccagcgtggtgctgctggatgagcccagcacaggcatggaccctgagggccagcagcagatgtggcaggccatccgggccaccttcaggaacacagagcggggggccctgctgaccacccactacatggccgaggccgaggccgtgtgtgacagagtggccatcatggtgtctggccgcctgcgctgcatcggcagcatccagcacctgaagagcaagtttgggaaggactacctgctggagatgaaggtgaagaacctggcccaggtggagcccctgcacgccgagatcctgcggctcttcccccaggccgcccggcaggagcgctacagcagcctgatggtgtacaagctgcctgtggaggatgtgcagcccctggcccaggccttcttcaagctggagaaggtgaagcagagctttgacctggaggagtacagcctgagccagagcaccctggagcaggtgttcctggagctgagcaaggagcaggagctgggggactttgaagaagattttgaccccagcgtgaagtggaagctgctgccccaggaggagccctag

SEQ ID NO: 144573 - DNA, 3312 bp, Artificial Sequence
  Description of Artificial Sequence: Synthetic coding sequence
atggacctgggccgggtggacaccttcaatgaaagccgcttctctgtggtgtacacccctgtgaccaacaccacccagcagatcatgaacaaggtggccagcacccccttcctggccggcaaggaggtgctgggcctgcctgatgaggagagcatcaaggagttcaccgccaactacccagaggagatcgtgcgggtgaccttcaccaacacctacagctaccacctgaagttcctgctgggccacggcatgcctgccaagaaggagcacaaggaccacacagcccactgctatgagaccaatgaagatgtgtactgtgaggtgtctgtgttctggaaggagggctttgtggccctgcaggccgccatcaatgctgccatcatcgagatcaccaccaaccacagcgtgatggaggagctgatgtctgtgacaggcaagaacatgaagatgcacagcttcatcggccagagcggggtcatcacagacctgtacctgttcagctgcatcatctccttcagcagcttcatctactatgcctctgtgaatgtgacccgggagaggaagaggatgaaggccctgatgaccatgatgggcctgcgggacagcgccttctggctgtcctggggcctgctgtatgccggcttcatcttcatcatggccctcttcctggccctggtgatccgcagcacccagttcatcatcctgagcggcttcatggtggtgttcagcctcttcctgctgtatggcctgagcctggtggccctggccttcctgatgagcatcctggtgaagaagagcttcctgaccggcctggtggtgttcctgctgactgtgttctggggctgcctgggcttcaccagcctgtaccgccacctgcctgccagcctggagtggatcctgagcctgctgagcccctttgccttcatgctgggcatggcccagctgctgcacctggactatgacctgaacagcaatgccttcccccaccccagtgatggcagcaacctgattgtggccaccaacttcatgctggcctttgacacctgcctgtacctggccctggccatctactttgagaagatcctgcccaatgaatatggccacagaagacctcctctcttcttcctgaagagcagcttctggagccagacccagaagacagaccacgtggccctggaggatgagatggatgctgaccccagcttccatgacagctttgagcaggcccctcctgagttccagggcaaggaggccatccgcatcagaaatgtgaccaaggagtacaagggcaagccagacaagattgaggccctgaaggacctggtgtttgacatctatgagggccagatcacagccatcctgggccacagcggggccggcaagagcaccctgctgaacatcctgagcggcctgtctgtgcccaccaagggctctgtgaccatctacaacaacaagctgtctgagatggctgacctggagaacctgagcaagctgactggagtgtgcccccagagcaatgtgcagtttgacttcctgactgtgcgggagaacctgcggctgtttgccaagatcaagggcatcctgccccaggaggtggacaaggagatccagagggtgctgctggagctggagatgaagaacatccaggatgtgctggcccagaacctgagcggcggccagaagaggaagctgaccttcggcatcgccatcctgggggacccccagatcttcctgctggatgagcccacagctggcctggaccccttcagccgccaccaggtgtggaacctgctgaaggagaggaagacagacagagtcatcctcttcagcacccagttcatggatgaagctgacatcctggccgacaggaaggtgttcctgagccagggcaagctgaagtgtgccggcagcagcctcttcctgaagaagaagtggggcatcggctaccacctgagcctgcagctgaatgagatctgtgtggaggagaacatcaccagcctggtgaagcagcacatcccagatgccaagctgagcgccaagtctgagggcaagctgatctacaccctgcccctggagaggaccaacaagtttcctgagctgtacaaggacctggacagctacccagacctgggcattgaaaattatggagtgtccatgaccaccctgaatgaggtgttcctgaagctggagggcaagagcaccatcaatgaaagtgacatcgccatcctgggggaggtgcaggccgagaaggcagatgacacagagcggctggtggagatggagcaggtgctgagcagcctgaacaagatgaggaagaccatcggcggcgtggccctgtggaggcagcagatctgtgccatcgcccgggtgcggctgctgaagctgaagcatgagaggaaggccctgctggccctgctgctgatcctgatggccggcttctgccccctgctggtggagtacaccatggtgaagatctaccagaacagctacacctgggagctgagcccccacctgtacttcctggcccctggccagcagccccatgaccccctgacccagctgctgatcatcaacaagacaggagccagcattgatgacttcatccagagcgtggagcaccagaacatcgccctggaggtggatgccttcggcaccagaaatggaacagatgaccccagctacaatggagccatcaccgtgtgctgcaatgagaagaactacagcttcagcctggcctgcaatgccaagaggctgaactgcttccctgtgctgatggacatcgtgtccaatggcctgctgggcatggtgaagcccagcgtgcacatcagaacagagaggagcaccttcctggagaatggccaggacaaccccatcggcttcctggcctacatcatgttctggctggtgctgaccagcagctgccccccctacatcgccatgagcagcattgatgactacaagaacagagcccggagccagctgcgcatcagcggcctgagccccagcgcctactggtttggccaggccctggtggatgtgtccctgtacttcctggtgtttgtgttcatctacctgatgagctacatcagcaactttgaggacatgctgctgaccatcatccacatcatccagatcccctgtgctgtgggctacagcttcagcctcatcttcatgacctacgtgatctccttcatcttcaggaagggcaggaagaacagcggcatctggagcttctgcttctacgtggtgtccatcttcctggtggatgtgtactgcatctacctgatctacaacagcgagctgatcctgtag

SEQ ID NO: 144574 - DNA, 471 bp, Artificial Sequence
  Description of Artificial Sequence: Synthetic coding sequence
atgctgggcatggcccagctgctgcacctggactatgacctgaacagcaatgccttcccccaccccagtgatggcagcaacctgattgtggccaccaacttcatgctggcctttgacacctgcctgtacctggccctggccatctactttgagaagatcctgcccaatgaatatggccacagaagacctcctctcttcttcctgaagagcagcttctggagccagacccagaagacagaccacgtggccctggaggatgagatggatgctgaccccagcttccatgacagctttgagcaggcccctcctgagttccagggcaaggaggccatccgcatcagaaatgtgaccaaggagtacaagggcaagccagacaagattgaggccctgaaggacctggtgtttgacatctatgagggccagatcacagccatcctggtgacagtggagctggagagccagcactgctag

SEQ ID NO: 144575 - DNA, 4875 bp, Artificial Sequence
  Description of Artificial Sequence: Synthetic coding sequence
atgagcaagaggaggatgtctgtgggccagcagacctgggccctgctgtgcaagaactgcctgaagaagtggaggatgaagaggcagaccctgctggagtggctgttctccttcctgctggtgctcttcctgtacctgttcttcagcaacctgcaccaggtgcatgacaccccccagatgagctccatggacctgggccgggtggacagcttcaatgacaccaactacgtgattgcctttgcccctgagagcaagaccacccaggagatcatgaacaaggtggccagcgcccccttcctgaagggccgcaccatcatgggctggccagatgagaagtccatggatgagctggacctgaactacagcattgatgctgtgcgggtcatcttcacagacaccttctcctaccacctgaagttctcctggggccaccgcatccccatgatgaaggagcaccgggaccacagcgcccactgccaggccgtgaatgagaagatgaagtgtgagggcagcgagttctgggagaagggctttgtggccttccaggccgccatcaatgctgccatcatcgagatcgccaccaaccacagcgtgatggagcagctgatgtctgtgactggagtgcacatgaagatcctgccctttgtggcccagggcggcgtggccacagacttcttcatcttcttctgcatcatctccttcagcaccttcatctactacgtgtctgtgaatgtgacccaggagcggcagtacatcaccagcctgatgaccatgatgggcctgcgggagagcgccttctggctgtcctggggcctgatgtatgccggcttcatcctgatcatggccaccctgatggccctgattgtgaagagcgcccagatcgtggtgctgaccggctttgtgatggtgttcaccctcttcctgctgtatggcctgagcctcatcaccctggccttcctgatgtctgtgctgatcaagaagcccttcctgaccggcctggtggtgttcctgctgattgtgttctggggcatcctgggcttccctgccctgtacacccggctgcctgccttcctggagtggaccctgtgcctgctgagcccctttgccttcaccgtgggcatggcccagctgatccacctggactatgatgtgaacagcaatgcccacctggacagcagccagaacccctacctgatcatcgccaccctcttcatgctggtgtttgacaccctgctgtacctggtgctgaccctgtactttgacaagatcctgcctgcagaatatggccaccgctgcagccccctcttcttcctgaagagctgcttctggttccagcacggccgggccaaccacgtggtgctggagaatgaaacagacagcgaccccaccccaaatgactgctttgagcctgtgtccccagagttctgtgggaaggaggccatccgcatcaagaacctgaagaaggagtatgctggaaaatgtgagcgggtggaggccctgaagggcgtggtgtttgacatctatgagggccagatcacagccctgctgggccacagcggggccggcaagaccaccctgctgaacatcctgagcggcctgtctgtgcccaccagcggctctgtgacagtgtacaaccacaccctgagcaggatggctgacatcgagaacatcagcaagttcaccggcttctgcccccagagcaatgtgcagtttggcttcctgactgtgaaggagaacctgcggctgtttgccaagatcaagggcatcctgccccatgaggtggagaaggaggtgcagagggtggtgcaggagctggagatggagaacatccaggacatcctggcccagaacctgagcggcggccagaacaggaagctgaccttcggcatcgccatcctgggggacccccaggtgctgctgctggatgagcccacagctggcctggaccccctgagccgccaccgcatctggaacctgctgaaggagggcaagagtgacagagtcatcctcttcagcacccagttcattgatgaagctgacatcctggccgacaggaaggtgttcatcagcaatggcaagctgaagtgtgccggcagcagcctcttcctgaagaagaagtggggcatcggctaccacctgagcctgcacctgaatgaaagatgtgaccctgagagcatcaccagcctggtgaagcagcacatcagtgatgccaagctgacagcccagagcgaggagaagctggtgtacatcctgcccctggagaggaccaacaagtttcctgagctgtacagagacctggaccgctgcagcaaccagggcattgaagattatggagtgtccatcaccaccctgaatgaggtgttcctgaagctggagggcaagagcaccattgatgaaagtgacatcggcatctggggccagctgcagacagatggagccaaggacatcggcagcctggtggagctggagcaggtgctgagcagcttccacgagaccaggaagaccatctctggagtggccctgtggaggcagcaggtgtgtgccatcgccaaggtgcgcttcctgaagctgaagaaggagaggaagagcctgtggaccatcctgctgctgtttggcatctccttcatcccccagctgctggagcacctgttctatgagagctaccagaagagctacccctgggagctgagccccaacacctacttcctgagccctggccagcagccccaggaccccctgacccacctgctggtgatcaacaagacaggcagcaccatcgacaacttcctgcacagcctgcggcggcagaacatcgccatcgaggtggatgccttcggcaccagaaatggaacagatgaccccagctacaatggagccatcatcgtgtctggagatgagaaggaccaccgcttcagcatcgcctgcaacaccaagaggctgaactgcttccctgtgctgctggatgtgatcagcaatggcctgctgggcatcttcaacagcagcgagcacatccagacagacaggagcaccttctttgaggagcacatggactatgaatatggctaccgcagcaacaccttcttctggatccccatggccgccagcttcaccccctacatcgccatgagcagcattggagactacaagaagaaggcccacagccagctgcgcatcagcggcctgtaccccagcgcctactggtttggccaggccctggtggatgtgtccctgtacttcctgatcctgctgctgatgcagatcatggactacatcttcagccctgaggagatcatcttcatcatccagaacctgctgatccagatcctgtgcagcatcggctacgtgagcagcctggtgttcctgacctacgtgatctccttcatcttcagaaatggaaggaagaacagcggcatctggagcttcttcttcctgattgtggtgatcttcagcatcgtggccacagacctgaatgaatatggcttcctgggcctcttcttcggcaccatgctgatcccccccttcaccctgattggcagcctcttcatcttcagcgagatcagcccagacagcatggactacctgggcgccagcgagagcgagatcgtgtacctggccctgctgatcccctacctgcacttcctgatcttcctgttcatcctgcgctgcctggagatgaactgcaggaagaagctgatgaggaaggaccccgtcttccgcatcagccccaggagcaatgccatcttccccaaccctgaggagcctgagggggaggaggaggacatccagatggagaggatgaggacagtgaatgccatggctgtgcgggactttgatgagacccctgtgatcatcgccagctgcctgaggaaggagtatgccggcaagaagaagaactgcttcagcaagaggaagaagaagatcgccaccagaaatgtgtccttctgtgtgaagaagggggaggtgattggcctgctgggccacaacggggccggcaagagcaccaccatcaagatgatcaccggggacaccaagcccacagctggccaggtgatcctgaagggcagcggcggcggggagcccctgggcttcctgggctactgcccccaggagaatgccctgtggcccaacctgactgtgcggcagcacctggaggtgtatgctgctgtgaagggcctgaggaaaggagatgccatgattgccatcacccggctggtggatgccctgaagctgcaggaccagctgaaggcccctgtgaagaccctgtctgagggcatcaagaggaagctgtgctttgtgctgagcatcctgggcaaccccagcgtggtgctgctggatgagcccagcacaggcatggaccctgagggccagcagcagatgtggcaggtgatccgggccaccttcaggaacacagagcggggggccctgctgaccacccactacatggccgaggccgaggccgtgtgtgacagagtggccatcatggtgtctggccgcctgcgctgcatcggcagcatccagcacctgaagagcaagtttgggaaggactacctgctggagatgaagctgaagaacctggcccagatggagcccctgcatgctgagatcctgcggctcttcccccaggccgcccagcaggagcgcttcagcagcctgatggtgtacaagctgcctgtggaggatgtgcggcccctgagccaggccttcttcaagctggagatcgtgaagcagagctttgacctggaggagtacagcctgagccagagcaccctggagcaggtgttcctggagctgagcaaggagcaggagctgggggacctggaggaggactttgaccccagcgtgaagtggaagctgctgctgcaggaggagccctag

SEQ ID NO: 144576 - DNA, 4308 bp, Artificial Sequence
  Description of Artificial Sequence: Synthetic coding sequence
atgagcaagaggaggatgtctgtgggccagcagacctgggccctgctgtgcaagaactgcctgaagaagtggaggatgaagaggcagaccctgctggagtggctgttctccttcctgctggtgctcttcctgtacctgttcttcagcaacctgcaccaggtgcatgacaccccccagatgagctccatggacctgggccgggtggacagcttcaatgacaccaactacgtgattgcctttgcccctgagagcaagaccacccaggagatcatgaacaaggtggccagcgcccccttcctgaagggccgcaccatcatgggctggccagatgagaagtccatggatgagctggacctgaactacagcattgatgctgtgcgggtcatcttcacagacaccttctcctaccacctgaagttctcctggggccaccgcatccccatgatgaaggagcaccgggaccacagcgcccactgccaggccgtgaatgagaagatgaagtgtgagggcagcgagttctgggagaagggctttgtggccttccaggccgccatcaatgctgccatcatcgagatcgccaccaaccacagcgtgatggagcagctgatgtctgtgactggagtgcacatgaagatcctgccctttgtggcccagggcggcgtggccacagacttcttcatcttcttctgcatcatctccttcagcaccttcatctactacgtgtctgtgaatgtgacccaggagcggcagtacatcaccagcctgatgaccatgatgggcctgcgggagagcgccttctggctgtcctggggcctgatgtatgccggcttcatcctgatcatggccaccctgatggccctgattgtgaagagcgcccagatcgtggtgctgaccggctttgtgatggtgttcaccctcttcctgctgtatggcctgagcctcatcaccctggccttcctgatgtctgtgctgatcaagaagcccttcctgaccggcctggtggtgttcctgctgattgtgttctggggcatcctgggcttccctgccctgtacacccggctgcctgccttcctggagtggaccctgtgcctgctgagcccctttgccttcaccgtgggcatggcccagctgatccacctggactatgatgtgaacagcaatgcccacctggacagcagccagaacccctacctgatcatcgccaccctcttcatgctggtgtttgacaccctgctgtacctggtgctgaccctgtactttgacaagatcctgcctgcagaatatggccaccgctgcagccccctcttcttcctgaagagctgcttctggttccagcacggccgggccaaccacgtggtgctggagaatgaaacagacagcgaccccaccccaaatgactgctttgagcctgtgtccccagagttctgtgggaaggaggccatccgcatcaagaacctgaagaaggagtatgctggaaaatgtgagcgggtggaggccctgaagggcgtggtgtttgacatctatgagggccagatcacagccctgctgggccacagcggggccggcaagaccaccctgctgaacatcctgagcggcctgtctgtgcccaccagcggctctgtgacagtgtacaaccacaccctgagcaggatggctgacatcgagaacatcagcaagttcaccggcttctgcccccagagcaatgtgcagtttggcttcctgactgtgaaggagaacctgcggctgtttgccaagatcaagggcatcctgccccatgaggtggagaaggaggtgcagagggtggtgcaggagctggagatggagaacatccaggacatcctggcccagaacctgagcggcggccagaacaggaagctgaccttcggcatcgccatcctgggggacccccaggtgctgctgctggatgagcccacagctggcctggaccccctgagccgccaccgcatctggaacctgctgaaggagggcaagagtgacagagtcatcctcttcagcacccagttcattgatgaagctgacatcctggccgacaggaaggtgttcatcagcaatggcaagctgaagtgtgccggcagcagcctcttcctgaagaagaagtggggcatcggctaccacctgagcctgcacctgaatgaaagatgtgaccctgagagcatcaccagcctggtgaagcagcacatcagtgatgccaagctgacagcccagagcgaggagaagctggtgtacatcctgcccctggagaggaccaacaagtttcctgagctgtacagagacctggaccgctgcagcaaccagggcattgaagattatggagtgtccatcaccaccctgaatgaggtgttcctgaagctggagggcaagagcaccattgatgaaagtgacatcggcatctggggccagctgcagacagatggagccaaggacatcggcagcctggtggagctggagcaggtgctgagcagcttccacgagaccaggaagaccatctctggagtggccctgtggaggcagcaggtgtgtgccatcgccaaggtgcgcttcctgaagctgaagaaggagaggaagagcctgtggaccatcctgctgctgtttggcatctccttcatcccccagctgctggagcacctgttctatgagagctaccagaagagctacccctgggagctgagccccaacacctacttcctgagccctggccagcagccccaggaccccctgacccacctgctggtgatcaacaagacaggcagcaccatcgacaacttcctgcacagcctgcggcggcagaacatcgccatcgaggtggatgccttcggcaccagaaatggaacagatgaccccagctacaatggagccatcatcgtgtctggagatgagaaggaccaccgcttcagcatcgcctgcaacaccaagaggctgaactgcttccctgtgctgctggatgtgatcagcaatggcctgctgggcatcttcaacagcagcgagcacatccagacagacaggagcaccttctttgaggagcacatggactatgaatatggctaccgcagcaacaccttcttctggatccccatggccgccagcttcaccccctacatcgccatgagcagcattggagactacaagaagaaggcccacagccagctgcgcatcagcggcctgtaccccagcgcctactggtttggccaggccctggtggatgtgtccctgtacttcctgatcctgctgctgatgcagatcatggactacatcttcagccctgaggagatcatcttcatcatccagaacctgctgatccagatcctgtgcagcatcggctacgtgagcagcctggtgttcctgacctacgtgatctccttcatcttcagaaatggaaggaagaacagcggcatctggagcttcttcttcctgattgtggtgatcttcagcatcgtggccacagacctgaatgaatatggcttcctgggcctcttcttcggcaccatgctgatcccccccttcaccctgattggcagcctcttcatcttcagcgagatcagcccagacagcatggactacctgggcgccagcgagagcgagatcgtgtacctggccctgctgatcccctacctgcacttcctgatcttcctgttcatcctgcgctgcctggagatgaactgcaggaagaagctgatgaggaaggaccccgtcttccgcatcagccccaggagcaatgccatcttccccaaccctgaggagcctgagggggaggaggaggacatccagatggagaggatgaggacagtgaatgccatggctgtgcgggactttgatgagacccctgtgatcatcgccagctgcctgaggaaggagtatgccggcaagaagaagaactgcttcagcaagaggaagaagaagatcgccaccagaaatgtgtccttctgtgtgaagaagggggaggtgattggcctgctgggccacaacggggccggcaagagcaccaccatcaagatgatcaccggggacaccaagcccacagctggccaggtgatcctgaagggcagcggcggcggggagcccctgggcttcctgggctactgcccccaggagaatgccctgtggcccaacctgactgtgcggcagcacctggaggtgtatgctgctgtgaagggcctgaggaaaggagatgccatgattgccatcacccggctggtggatgccctgaagctgcaggaccagctgaaggcccctgtgaagaccctgtctgagggcatcaagaggaaggccggggacagcggccacctgtag

SEQ ID NO: 144577 - DNA, 3423 bp, Artificial Sequence
  Description of Artificial Sequence: Synthetic coding sequence
atgtctgtgggccagcagacctgggccctgctgtgcaagaactgcctgaagaagtggaggatgaagaggcagaccctgctggagtggctgttctccttcctgctggtgctcttcctgtacctgttcttcagcaacctgcaccaggtgcatgacaccccccagatgagctccatggacctgggccgggtggacagcttcaatgacaccaactacgtgattgcctttgcccctgagagcaagaccacccaggagatcatgaacaaggtggccagcgcccccttcctgaagggccgcaccatcatgggctggccagatgagaagtccatggatgagctggacctgaactacagcattgatgctgtgcgggtcatcttcacagacaccttctcctaccacctgaagttctcctggggccaccgcatccccatgatgaaggagcaccgggaccacagcgcccactgccaggccgtgaatgagaagatgaagtgtgagggcagcgagttctgggagaagggctttgtggccttccaggccgccatcaatgctgccatcattgaaattgccaccaaccacagcgtgatggagcagctgatgtctgtgactggagtgcacatgaagatcctgccctttgtggcccagggcggcgtggccacagacttcttcatcttcttctgcatcatctccttcagcaccttcatctactacgtgtctgtgaatgtgacccaggagcggcagtacatcaccagcctgatgaccatgatgggcctgcgggagagcgccttctggctgtcctggggcctgatgtatgccggcttcatcctgatcatggccaccctgatggccctgattgtgaagagcgcccagatcgtggtgctgactggatttgtgatggtgttcaccctcttcctgctgtatggcctgagcctcatcaccctggccttcctgatgtctgtgctgatcaagaagcccttcctgaccggcctggtggtgttcctgctgattgtgttctggggcatcctgggcttccctgccctgtacacccggctgcctgccttcctggagtggaccctgtgcctgctgagcccctttgccttcaccgtgggcatggcccagctgatccacctggactatgatgtgaacagcaatgcccacctggacagcagccagaacccctacctgatcatcgccaccctcttcatgctggtgtttgacaccctgctgtacctggtgctgaccctgtactttgacaagatcctgcctgcagaatatggccaccgctgcagccccctcttcttcctgaagagctgcttctggttccagcacggccgggccaaccacgtggtgctggagaatgaaacagacagcgaccccaccccaaatgactgctttgagcctgtgtccccagagttctgtgggaaggaggccatccgcatcaagaacctgaagaaggagtatgctggaaaatgtgagcgggtggaggccctgaagggcgtggtgtttgacatctatgagggccagatcacagccctgctgggccacagcggggccggcaagaccaccctgctgaacatcctgagcggcctgtctgtgcccaccagcggctctgtgacagtgtacaaccacaccctgagcaggatggctgacatcgagaacatcagcaagttcaccggcttctgcccccagagcaatgtgcagtttggcttcctgactgtgaaggagaacctgcggctgtttgccaagatcaagggcatcctgccccatgaggtggagaaggaggtgcagagggtggtgcaggagctggagatggagaacatccaggacatcctggcccagaacctgagcggcggccagaacaggaagctgacctttggaattgccatcctgggggacccccaggtgctgctgctggatgagcccacagctggcctggaccccctgagccgccaccgcatctggaacctgctgaaggagggcaagagtgacagagtcatcctcttcagcacccagttcattgatgaggccgacatcctggccgacaggaaggtgttcatcagcaatggcaagctgaagtgtgccggcagcagcctcttcctgaagaagaagtggggcatcggctaccacctgagcctgcacctgaatgaaagatgtgaccctgagagcatcaccagcctggtgaagcagcacatcagtgatgccaagctgacagcccagagcgaggagaagctggtgtacatcctgcccctggagaggaccaacaagtttcctgagctgtacagagacctggaccgctgcagcaaccagggcatcgaggactatggagtgtccatcaccaccctgaatgaggtgttcctgaagctggagggcaagagcaccattgatgaaagtgacatcggcatctggggccagctgcagacagatggagccaaggacatcggcagcctggtggagctggagcaggtgctgagcagcttccacgagaccaggaagaccatcagcggcgtggccctgtggaggcagcaggtgtgtgccatcgccaaggtgcgcttcctgaagctgaagaaggagaggaagagcctgtggaccatcctgctgctgtttggcatctccttcatcccccagctgctggagcacctgttctatgagagctaccagaagagctacccctgggagctgagccccaacacctacttcctgagccctggccagcagccccaggaccccctgacccacctgctggtgatcaacaagacaggcagcaccatcgacaacttcctgcacagcctgcggcggcagaacatcgccatcgaggtggatgccttcggcaccagaaatggaacagatgaccccagctacaacggggccatcatcgtgtctggagatgagaaggaccaccgcttcagcatcgcctgcaacaccaagaggctgaactgcttccctgtgctgctggatgtgatcagcaatggcctgctgggcatcttcaacagcagcgagcacatccagacagacaggagcaccttctttgaggagcacatggactatgaatatggctaccgcagcaacaccttcttctggatccccatggccgccagcttcaccccctacatcgccatgagcagcatcggggactacaagaagaaggcccacagccagctgcgcatcagcggcctgtaccccagcgcctactggtttggccaggccctggtggatgtgtccctgtacttcctgatcctgctgctgatgcagatcatggactacatcttcagccctgaggagatcatcttcatcatccagaacctgctgatccaggtggtgatcttcagcatcgtggccacagacctgaatgaatatggcttcctgggcctcttctggcaccacgtgaacaccagcctgcacatcgactggctgagcatccacttcttctag

SEQ ID NO: 144578 - DNA, 2217 bp, Artificial Sequence
  Description of Artificial Sequence: Synthetic coding sequence
atgaggggccccccagcctggcccctgcggctgctggagccccccagccctgctgagcccggccgcctgctgcctgtggcctgtgtgtgggccgccgccagccgggtgcccggcagcctgagccccttcaccggcctgcggcctgcccggctgtggggcgccggccctgccctgctgtggggcgtgggcgccgcccggcgctggaggagcggctgccggggcggcggccctggggccagccggggcgtgctgggcctggcccggctgctgggcctgtgggcccggggccctggcagctgccgctgtggggcctttgctggccctggggccccccggctgccccgggcccgcttccctgggggccctgctgctgctgcctgggccggagatgaggcctggaggcggggccctgctgcccctcctggggacaagggccgcctgcggcctgctgctgctggcctgcctgaggccaggaagctgctgggcctggcctacccagagcggcggcggctggccgctgctgtgggcttcctgaccatgagcagcgtcatctccatgtctgcccccttcttcctgggcaagatcattgatgtgatctacaccaaccccaccgtggactacagcgacaacctgacccggctgtgcctgggcctgtctgctgtgttcctgtgtggggctgctgccaatgccatccgggtgtacctgatgcagaccagcggccagagaattgtgaaccggctgcggaccagcctcttcagcagcatcctgcggcaggaggtggccttctttgacaagaccaggactggagagctgatcaaccggctgagcagtgacacagccctgctgggccgctctgtgacagagaacctgagtgatggcctgcgggccggggcccaggcctctgtgggcatctccatgatgttctttgtgagccccaacctggccacctttgtgctgtctgtggtgccccctgtgtccatcatcgctgtgatctacggccgctacctgaggaagctgaccaaggtgacccaggacagcctggcccaggccacccagctggccgaggagagaattggaaatgtgaggacagtgcgggccttcggcaaggagatgacagaaattgagaagtatgccagcaaggtggaccacgtgatgcagctggccaggaaggaggcctttgcccgggccggcttctttggagccaccggcctgagcggcaacctgattgtgctgtctgtgctgtacaagggcggcctgctgatgggcagcgcccacatgacagtgggggagctgagcagcttcctgatgtatgccttctgggtgggcatcagcattggaggcctgagcagcttctacagcgagctgatgaagggcctgggcgccggcggccgcctgtgggagctgctggagcgggagcccaagctgcccttcaatgaaggagtcatcctgaatgagaagagcttccagggcgccctggagttcaagaatgtgcactttgcctacccagcccggcctgaggtgcccatcttccaggacttcagcctgagcatccccagcggctctgtgacagccctggtgggccccagcggcagcggcaagagcacagtgctgagcctgctgctgcggctgtatgaccctgccagcggcaccatcagcctggatggccatgacatccggcagctgaaccctgtgtggctgcggagcaagattggcaccgtgtcccaggagcccatcctcttcagctgcagcattgctgagaacatcgcctacggggctgatgaccccagctctgtgacagctgaggagatccagagggtggccgaggtggccaatgctgtggccttcatccggaacttcccccagggcttcaacacagtggtgggggagaagggcgtgctgctgagcggcggccagaagcagagaattgccatcgcccgggccctgctgaagaaccccaagatcctgctgctggatgaggccaccagcgccctggatgctgaaaatgagtacctggtgcaggaggccctggaccggctgatggatggccgcacagtgctggtgattgcccaccggctgagcaccatcaagaatgccaacatggtggccgtgctggaccagggcaagatcacagaatatggcaagcatgaggagctgctgagcaagcccaacggcatctacaggaagctgatgaacaagcagagcttcatcagcgcctag

SEQ ID NO: 144579 - DNA, 2529 bp, Artificial Sequence
  Description of Artificial Sequence: Synthetic coding sequence
atggtgacagtgggcaactactgtgaggccgagggccctgtgggccctgcctggatgcaggacggcctgagcccctgcttcttcttcaccctggtgcccagcaccaggatggccctgggcaccctggccctggtgctggccctgccctgcagaagaagagagaggcctgctggagctgacagcctgtcctggggcgccggcccccgcatcagcccctacgtgctgcagctgctgctggccaccctgcaggccgccctgcccctggccggcctggccggccgggtgggcacagcccggggggcccccctgcccagctacctgctgctggcctctgtgctggagagcctggccggggcctgtggcctgtggctgctggtggtggagaggagccaggcccggcagaggctggccatgggcatctggatcaagttccgccacagccctggcctgctgctgctgtggacagtggcctttgctgctgagaacctggccctggtgtcctggaacagcccccagtggtggtgggcccgggctgacctgggccagcaggtgcagttcagcctgtgggtgctgcgctacgtggtgtctgggggcctgtttgtgctgggcctgtgggcccctggcctgcggccccagagctacaccctgcaggtgcatgaggaggaccaggatgtggagaggagccaggtgcgctctgctgcccagcagagcacctggagggactttggaaggaagctgcggctgctgagcggctacctgtggccccggggcagccctgccctgcagctggtggtgctgatctgcctgggcctgatgggcctggagcgggccctgaatgtgctggtgcccatcttctacagaaatattgtgaacctgctgacagagaaggccccctggaacagcctggcctggacagtgaccagctatgtgttcctgaagttcctgcagggcggcggcaccggcagcactggatttgtgagcaacctgcggaccttcctgtggatccgggtgcagcagttcaccagcagaagagtggagctgctgatcttcagccacctgcacgagctgagcctgcgctggcacctgggccgcaggactggagaggtgctgagaattgctgaccggggcaccagctctgtgacaggcctgctgagctacctggtgttcaacgtcatccccaccctggccgacatcatcatcggcatcatctacttctccatgttcttcaatgcctggtttggcctcatcgtgttcctgtgcatgagcctgtacctgaccctgaccatcgtggtgacagagtggaggaccaagttcagaagagccatgaacacccaggagaatgccacccgggcccgggctgtggacagcctgctgaactttgagaccgtgaagtactacaatgctgagagctatgaggtggagcgctaccgggaggccatcatcaagtaccagggcctggagtggaagagcagcgccagcctggtgctgctgaaccagacccagaacctggtgattggcctgggcctgctggccggcagcctgctgtgtgcctactttgtgacagagcagaagctgcaggtgggggactatgtgctgtttggcacctacatcatccagctgtacatgcccctgaactggtttggcacctactacaggatgatccagaccaacttcatcgacatggagaacatgtttgacctgctgaaggaggagacagaggtgaaggacctgcccggggccggccccctgcgcttccagaagggccgcatcgagtttgaaaatgtgcacttctcctatgcagatggccgggagaccctgcaggatgtgtccttcaccgtgatgcctggccagaccctggccctggtgggccccagcggggccggcaagagcaccatcctgcggctgctcttccgcttctatgacatcagcagcggctgcatcagaattgatggccaggacatcagccaggtgacccaggccagcctgcggagccacatcggcgtggtgccccaggacacagtgctcttcaatgacaccatcgctgacaacatccgctatggccgggtgacagctggaaatgatgaggtggaggccgccgcccaggccgccggcatccatgatgccatcatggccttccctgagggctaccgcacccaggtgggggagcggggcctgaagctgagcggcggggagaagcagagggtggccatcgcccggaccatcctgaaggcccctggcatcatcctgctggatgaggccaccagcgccctggacaccagcaatgaaagagccatccaggccagcctggccaaggtgtgtgccaacagaaccaccatcgtggtggcccaccggctgagcacagtggtgaatgctgaccagatcctggtgatcaaggatggctgcatcgtggagcggggcagacatgaggccctgctgagcagaggaggagtgtatgctgacatgtggcagctgcagcagggccaggaggagaccagcgaggacaccaagccccagaccatggagaggtag

SEQ ID NO: 144580 - DNA, 636 bp, Artificial Sequence
  Description of Artificial Sequence: Synthetic coding sequence
atggtgacagtgggcaactactgtgaggccgagggccctgtgggccctgcctggatgcaggacggcctgagcccctgcttcttcttcaccctggtgcccagcaccaggatggccctgggcaccctggccctggtgctggccctgccctgcagaagaagagagaggcctgctggagctgacagcctgtcctggggcgccggcccccgcatcagcccctatgccctgcccggcggcccccactgccaggccatctacttctggccaccctgctggagggtgtggccagcccctgtggcctgtggctgcctgtcctggagcggggcccggcacggctctgtgtggcagtgggccagcggcagcagcagcggcacagccctggtgtcctgcagcagcggcctgtggaggctgcagctgcggacctggccctggtgcctgggcacagcccacagcggcggcggccagggccagacctgggccagccgcttcagcctggcctgtggctgctgcggcatgtggagcctggagggctgcctgtcctgggtgtctggccccctggactttgtgcccagccccatccactgccgcttcatgaagaggaccaagatgtggaagggggccagcgagctggccgactag

SEQ ID NO: 144581 - DNA, 2391 bp, Artificial Sequence
  Description of Artificial Sequence: Synthetic coding sequence
atggtgacagtgggcaactactgtgaggccgagggccctgtgggccctgcctggatgcaggacggcctgagcccctgcttcttcttcaccctggtgcccagcaccaggatggccctgggcaccctggccctggtgctggccctgccctgcagaagaagagagaggcctgctggagctgacagcctgtcctggggcgccggcccccgcatcagcccctacgtgctgcagctgctgctggccaccctgcaggccgccctgcccctggccggcctggccggccgggtgggcacagcccggggggcccccctgcccagctacctgctgctggcctctgtgctggagagcctggccggggcctgtggcctgtggctgctggtggtggagaggagccaggcccggcagaggctggccatgggcatctggatcaagttccgccacagccctggcctgctgctgctgtggacagtggcctttgctgctgagaacctggccctggtgtcctggaacagcccccagtggtggtgggcccgggctgacctgggccagcaggtgcgctctgctgcccagcagagcacctggagggactttggaaggaagctgcggctgctgagcggctacctgtggccccggggcagccctgccctgcagctggtggtgctgatctgcctgggcctgatgggcctggagcgggccctgaatgtgctggtgcccatcttctacagaaatattgtgaacctgctgacagagaaggccccctggaacagcctggcctggacagtgaccagctatgtgttcctgaagttcctgcagggcggcggcaccggcagcactggatttgtgagcaacctgcggaccttcctgtggatccgggtgcagcagttcaccagcagaagagtggagctgctgatcttcagccacctgcacgagctgagcctgcgctggcacctgggccgcaggactggagaggtgctgagaattgctgaccggggcaccagctctgtgacaggcctgctgagctacctggtgttcaacgtcatccccaccctggccgacatcatcatcggcatcatctacttctccatgttcttcaatgcctggtttggcctcatcgtgttcctgtgcatgagcctgtacctgaccctgaccatcgtggtgacagagtggaggaccaagttcagaagagccatgaacacccaggagaatgccacccgggcccgggctgtggacagcctgctgaactttgagaccgtgaagtactacaatgctgagagctatgaggtggagcgctaccgggaggccatcatcaagtaccagggcctggagtggaagagcagcgccagcctggtgctgctgaaccagacccagaacctggtgattggcctgggcctgctggccggcagcctgctgtgtgcctactttgtgacagagcagaagctgcaggtgggggactatgtgctgtttggcacctacatcatccagctgtacatgcccctgaactggtttggcacctactacaggatgatccagaccaacttcatcgacatggagaacatgtttgacctgctgaaggaggagacagaggtgaaggacctgcccggggccggccccctgcgcttccagaagggccgcatcgagtttgaaaatgtgcacttctcctatgcagatggccgggagaccctgcaggatgtgtccttcaccgtgatgcctggccagaccctggccctggtgggccccagcggggccggcaagagcaccatcctgcggctgctcttccgcttctatgacatcagcagcggctgcatcagaattgatggccaggacatcagccaggtgacccaggccagcctgcggagccacatcggcgtggtgccccaggacacagtgctcttcaatgacaccatcgctgacaacatccgctatggccgggtgacagctggaaatgatgaggtggaggccgccgcccaggccgccggcatccatgatgccatcatggccttccctgagggctaccgcacccaggtgggggagcggggcctgaagctgagcggcggggagaagcagagggtggccatcgcccggaccatcctgaaggcccctggcatcatcctgctggatgaggccaccagcgccctggacaccagcaatgaaagagccatccaggccagcctggccaaggtgtgtgccaacagaaccaccatcgtggtggcccaccggctgagcacagtggtgaatgctgaccagatcctggtgatcaaggatggctgcatcgtggagcggggcagacatgaggccctgctgagcagaggaggagtgtatgctgacatgtggcagctgcagcagggccaggaggagaccagcgaggacaccaagccccagaccatggagaggtag

SEQ ID NO: 144582 - DNA, 2262 bp, Artificial Sequence
  Description of Artificial Sequence: Synthetic coding sequence
atggccctgctggccatgcacagctggcgctgggccgctgctgctgctgcctttgagaagagaagacacagcgccatcctgatccggcccctggtgtctgtgtctggcagcggcccccagtggaggccccaccagctgggcgccctgggcacagcccgggcctaccagcagatccctgagagcctgaagagcatcacctggcagaggctgggcaagggcaacagcggccagttcctggatgctgccaaggccctgcaggtgtggcccctgattgagaagaggacctgctggcacggccatgctgggggcggcctgcacacagaccccaaggagggcctgaaggatgtggacaccaggaagatcatcaaggccatgctgtcctatgtgtggcccaaggacagaccagacctgcgggcccgggtggccatcagcctgggcttcctgggcggggccaaggccatgaacatcgtggtgcccttcatgttcaagtatgctgtggacagcctgaaccagatgagcggcaacatgctgaacctgagtgatgcccccaacacagtggccaccatggccacagctgtgctgattggctatggagtgtcccgggccggggccgccttcttcaatgaggtgagaaatgctgtgtttgggaaggtggcccagaacagcatccgccgcatcgccaagaatgtgttcctgcacctgcacaacctggacctgggcttccacctgagccggcagacaggagccctgagcaaggccatcgaccggggcacccggggcatcagctttgtgctgagcgccctggtgttcaacctgctgcccatcatgtttgaggtgatgctggtgtctggagtgctgtactacaagtgtggggcccagtttgccctggtgaccctgggcaccctgggcacctacacagccttcaccgtggccgtgacccgctggaggacccgcttcagaattgagatgaacaaggctgacaatgatgctggaaatgctgccatcgacagcctgctgaactatgaaacagtgaagtacttcaacaatgaaagatatgaggcccagagatatgatggcttcctgaagacctatgaaacagccagcctgaagagcaccagcaccctggccatgctgaactttggccagagcgccatcttctctgtgggcctgacagccatcatggtgctggccagccagggcatcgtggccggcaccctgactgtgggggacctggtgatggtgaatggcctgctcttccagctgagcctgcccctgaacttcctgggcaccgtgtaccgggagacccggcaggccctgattgacatgaacaccctcttcaccctgctgaaggtggacacccagatcaaggacaaggtgatggccagccccctgcagatcaccccccagacagccaccgtggcctttgacaacgtgcactttgagtacatcgagggccagaaggtgctgagcggcatcagctttgaggtgcctgctgggaagaaggtggccatcgtgggcggcagcggcagcggcaagagcaccatcgtgcggctgctcttccgcttctatgagccccagaagggcagcatctacctggccggccagaacatccaggatgtgtccctggagagcctgcggcgggctgtgggcgtggtgccccaggatgctgtgctcttccacaacaccatctactacaacctgctgtatggcaacatcagcgccagccctgaggaggtgtatgctgtggccaagctggccggcctgcatgatgccatcctgaggatgcctcatggctatgacacccaggtgggggagcggggcctgaagctgtctggaggagagaagcagagggtggccatcgcccgggccatcctgaaggacccccctgtgatcctgtatgatgaggccaccagcagcctggacagcatcacagaggagaccatcctgggcgccatgaaggatgtggtgaagcacaggaccagcatcttcatcgcccaccggctgagcacagtggtggatgctgatgagatcatcgtgctggaccagggcaaggtggccgagcggggcacccaccacggcctgctggccaacccccacagcatctacagcgagatgtggcacacccagagcagccgggtgcagaaccacgacaaccccaagtgggaggccaagaaggagaacatcagcaaggaggaggagaggaagaagctgcaggaggagatcgtgaacagcgtgaagggctgcggcaactgcagctgctag

SEQ ID NO: 144583 - DNA, 2259 bp, Artificial Sequence
  Description of Artificial Sequence: Synthetic coding sequence
atggccctgctggccatgcacagctggcgctgggccgctgctgctgctgcctttgagaagagaagacacagcgccatcctgatccggcccctggtgtctgtgtctggcagcggcccccagtggaggccccaccagctgggcgccctgggcacagcccgggcctaccagatccctgagagcctgaagagcatcacctggcagaggctgggcaaaggaaacagcggccagttcctggatgctgccaaggccctgcaggtgtggcccctcatcgagaagaggacctgctggcacggccacgccggcggcggcctgcacacagaccccaaggagggcctgaaggatgtggacaccaggaagatcatcaaggccatgctgtcctatgtgtggcccaaggacagaccagacctgcgggcccgggtggccatcagcctgggcttcctgggcggggccaaggccatgaacatcgtggtgcccttcatgttcaagtatgctgtggacagcctgaaccagatgagcggcaacatgctgaacctgagtgatgcccccaacacagtggccaccatggccacagctgtgctgattggctacggcgtgtccagagctggagctgccttcttcaatgaggtgagaaatgctgtgtttgggaaggtggcccagaacagcatcagaagaattgccaagaatgtgttcctgcacctgcacaacctggacctgggcttccacctgagccggcagacaggagccctgagcaaggccatcgaccggggcacccggggcatcagctttgtgctgagcgccctggtgttcaacctgctgcccatcatgtttgaggtgatgctggtgtctggagtgctgtactacaagtgtggggcccagtttgccctggtgaccctgggcaccctgggcacctacacagccttcaccgtggccgtgacccgctggaggacccgcttccgcatcgagatgaacaaggctgacaatgatgctggaaatgctgccatcgacagcctgctgaactatgagaccgtgaagtacttcaacaatgaaagatatgaggcccagagatatgatggcttcctgaagacctatgaaacagccagcctgaagagcaccagcaccctggccatgctgaactttggccagagcgccatcttctctgtgggcctgacagccatcatggtgctggccagccagggcatcgtggccggcaccctgactgtgggggacctggtgatggtgaatggcctgctcttccagctgagcctgcccctgaacttcctgggcaccgtgtaccgggagacccggcaggccctgattgacatgaacaccctcttcaccctgctgaaggtggacacccagatcaaggacaaggtgatggccagccccctgcagatcaccccccagacagccaccgtggcctttgacaacgtgcactttgagtacatcgagggccagaaggtgctgagcggcatcagctttgaggtgcctgctgggaagaaggtggccatcgtgggcggcagcggcagcggcaagagcaccatcgtgcggctgctcttccgcttctatgagccccagaagggcagcatctacctggccggccagaacatccaggatgtgtccctggagagcctgcggcgggctgtgggcgtggtgccccaggatgctgtgctcttccacaacaccatctactacaacctgctgtatggcaacatcagcgccagccctgaggaggtgtatgctgtggccaagctggccggcctgcatgatgccatcctgaggatgccccacggctatgacacccaggtgggggagcggggcctgaagctgagcggcggggagaagcagagggtggccatcgcccgggccatcctgaaggacccccctgtgatcctgtatgatgaggccaccagcagcctggacagcatcacagaggagaccatcctgggcgccatgaaggatgtggtgaagcacaggaccagcatcttcatcgcccaccggctgagcacagtggtggatgctgatgagatcatcgtgctggaccagggcaaggtggccgagcggggcacccaccacggcctgctggccaacccccacagcatctacagcgagatgtggcacacccagagcagccgggtgcagaaccacgacaaccccaagtgggaggccaagaaggagaacatcagcaaggaggaggagaggaagaagctgcaggaggagatcgtgaacagcgtgaagggctgcggcaactgcagctgctag

SEQ ID NO: 144584 - DNA, 2109 bp, Artificial Sequence
  Description of Artificial Sequence: Synthetic coding sequence
atggccctgctggccatgcacagctggcgctgggccgctgctgctgctgcctttgagaagagaagacacagcgccatcctgatccggcccctggtgtctgtgtctggcagcggcccccagtggaggccccaccagctgggcgccctgggcacagcccgggcctaccaggccctgcaggtgtggcccctcatcgagaagaggacctgctggcacggccacgccggcggcggcctgcacacagaccccaaggagggcctgaaggatgtggacaccaggaagatcatcaaggccatgctgtcctatgtgtggcccaaggacagaccagacctgcgggcccgggtggccatcagcctgggcttcctgggcggggccaaggccatgaacatcgtggtgcccttcatgttcaagtatgctgtggacagcctgaaccagatgagcggcaacatgctgaacctgagtgatgcccccaacacagtggccaccatggccacagctgtgctgattggctacggcgtgtccagagctggagctgccttcttcaatgaggtgagaaatgctgtgtttgggaaggtggcccagaacagcatcagaagaattgccaagaatgtgttcctgcacctgcacaacctggacctgggcttccacctgagccggcagacaggagccctgagcaaggccatcgaccggggcacccggggcatcagctttgtgctgagcgccctggtgttcaacctgctgcccatcatgtttgaggtgatgctggtgtctggagtgctgtactacaagtgtggggcccagtttgccctggtgaccctgggcaccctgggcacctacacagccttcaccgtggccgtgacccgctggaggacccgcttccgcatcgagatgaacaaggctgacaatgatgctggaaatgctgccatcgacagcctgctgaactatgagaccgtgaagtacttcaacaatgaaagatatgaggcccagagatatgatggcttcctgaagacctatgaaacagccagcctgaagagcaccagcaccctggccatgctgaactttggccagagcgccatcttctctgtgggcctgacagccatcatggtgctggccagccagggcatcgtggccggcaccctgactgtgggggacctggtgatggtgaatggcctgctcttccagctgagcctgcccctgaacttcctgggcaccgtgtaccgggagacccggcaggccctgattgacatgaacaccctcttcaccctgctgaaggtggacacccagatcaaggacaaggtgatggccagccccctgcagatcaccccccagacagccaccgtggcctttgacaacgtgcactttgagtacatcgagggccagaaggtgctgagcggcatcagctttgaggtgcctgctgggaagaaggtggccatcgtgggcggcagcggcagcggcaagagcaccatcgtgcggctgctcttccgcttctatgagccccagaagggcagcatctacctggccggccagaacatccaggatgtgtccctggagagcctgcggcgggctgtgggcgtggtgccccaggatgctgtgctcttccacaacaccatctactacaacctgctgtatggcaacatcagcgccagccctgaggaggtgtatgctgtggccaagctggccggcctgcatgatgccatcctgaggatgccccacggctatgacacccaggtgggggagcggggcctgaagctgagcggcggggagaagcagagggtggccatcgcccgggccatcctgaaggacccccctgtgatcctgtatgatgaggccaccagcagcctggacagcatcacagaggagaccatcctgggcgccatgaaggatgtggtgaagcacaggaccagcatcttcatcgcccaccggctgagcacagtggtggatgctgatgagatcatcgtgctggaccagggcaaggtggccgagcggggcacccaccacggcctgctggccaacccccacagcatctacagcgagatgtggcacacccagagcagccgggtgcagaaccacgacaaccccaagtgggaggccaagaaggagaacatctcctag

SEQ ID NO: 144585 - DNA, 2181 bp, Artificial Sequence
  Description of Artificial Sequence: Synthetic coding sequence
atggccctgctggccatgcacagctggcgctgggccgctgctgctgctgcctttgagaagagaagacacagcgccatcctgatccggcccctggtgtctgtgtctggcagcggcccccagtggaggccccaccagctgggcgccctgggcacagcccgggcctaccaggccctgcaggtgtggcccctcatcgagaagaggacctgctggcacggccacgccggcggcggcctgcacacagaccccaaggagggcctgaaggatgtggacaccaggaagatcatcaaggccatgctgtcctatgtgtggcccaaggacagaccagacctgcgggcccgggtggccatcagcctgggcttcctgggcggggccaaggccatgaacatcgtggtgcccttcatgttcaagtatgctgtggacagcctgaaccagatgagcggcaacatgctgaacctgagtgatgcccccaacacagtggccaccatggccacagctgtgctgattggctacggcgtgtccagagctggagctgccttcttcaatgaggtgagaaatgctgtgtttgggaaggtggcccagaacagcatcagaagaattgccaagaatgtgttcctgcacctgcacaacctggacctgggcttccacctgagccggcagacaggagccctgagcaaggccatcgaccggggcacccggggcatcagctttgtgctgagcgccctggtgttcaacctgctgcccatcatgtttgaggtgatgctggtgtctggagtgctgtactacaagtgtggggcccagtttgccctggtgaccctgggcaccctgggcacctacacagccttcaccgtggccgtgacccgctggaggacccgcttccgcatcgagatgaacaaggctgacaatgatgctggaaatgctgccatcgacagcctgctgaactatgagaccgtgaagtacttcaacaatgaaagatatgaggcccagagatatgatggcttcctgaagacctatgaaacagccagcctgaagagcaccagcaccctggccatgctgaactttggccagagcgccatcttctctgtgggcctgacagccatcatggtgctggccagccagggcatcgtggccggcaccctgactgtgggggacctggtgatggtgaatggcctgctcttccagctgagcctgcccctgaacttcctgggcaccgtgtaccgggagacccggcaggccctgattgacatgaacaccctcttcaccctgctgaaggtggacacccagatcaaggacaaggtgatggccagccccctgcagatcaccccccagacagccaccgtggcctttgacaacgtgcactttgagtacatcgagggccagaaggtgctgagcggcatcagctttgaggtgcctgctgggaagaaggtggccatcgtgggcggcagcggcagcggcaagagcaccatcgtgcggctgctcttccgcttctatgagccccagaagggcagcatctacctggccggccagaacatccaggatgtgtccctggagagcctgcggcgggctgtgggcgtggtgccccaggatgctgtgctcttccacaacaccatctactacaacctgctgtatggcaacatcagcgccagccctgaggaggtgtatgctgtggccaagctggccggcctgcatgatgccatcctgaggatgccccacggctatgacacccaggtgggggagcggggcctgaagctgagcggcggggagaagcagagggtggccatcgcccgggccatcctgaaggacccccctgtgatcctgtatgatgaggccaccagcagcctggacagcatcacagaggagaccatcctgggcgccatgaaggatgtggtgaagcacaggaccagcatcttcatcgcccaccggctgagcacagtggtggatgctgatgagatcatcgtgctggaccagggcaaggtggccgagcggggcacccaccacggcctgctggccaacccccacagcatctacagcgagatgtggcacacccagagcagccgggtgcagaaccacgacaaccccaagtgggaggccaagaaggagaacatcagcaaggaggaggagaggaagaagctgcaggaggagatcgtgaacagcgtgaagggctgcggcaactgcagctgctag

SEQ ID NO: 144586 - DNA, 2208 bp, Artificial Sequence
  Description of Artificial Sequence: Synthetic coding sequence
atgctggtgcacctgttccgggtgggcatccggggcggccccttccctggccgcctgctgccccccctgcgcttccagaccttctctgctgtgaggaacacctggagaaatggcaagacaggccagctgcacaaggccgagggggagtacagtgatggctaccgcagcagcagcctgctgcgggctgtggcccacctgcggagccagctgtgggcccacctgccccgggcccccctggccccccgctggagccccagcgcctggtgctgggtgggcggggccctgctgggccccatggtgctgagcaagcacccccacctgtgcctggtggccctgtgtgaggccgaggaggcccccccagccagcagcaccccccacgtggtgggcagccgcttcaactggaagctgttctggcagttcctgcacccccacctgctggtgctgggcgtggccgtggtgctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgaggcgggccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagagatatggagctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgactggaggagacctgatgtccttcctggtggccagccagacagtgcagaggtccatggccaacctgtctgtgctgtttggccaggtggtgcggggcctgtctgctggggcccgggtgtttgagtacatggccctgaacccctgcatccccctgagcggcggctgctgcgtgcccaaggagcagctgcggggctctgtgaccttccagaatgtgtgcttctcctacccctgcaggcctggctttgaggtgctgaaggacttcaccctgaccctgcccccaggcaagatcgtggccctggtgggccagagcggcggcggcaagaccaccgtggccagcctgctggagcgcttctatgaccccacagctggggtggtgatgctggatggccgggacctgcggaccctggaccccagctggctgcggggccaggtggtgggcttcatcagccaggagcctgtgctgtttggcaccaccatcatggagaacatccgctttgggaagctggaggccagtgatgaggaggtgtacacagctgcccgggaggccaatgcccacgagttcatcaccagcttccctgagggctacaacacagtggtgggggagcggggcaccaccctgagcggcggccagaagcagaggctggccatcgcccgggccctgatcaagcagcccaccgtgctgatcctggatgaggccaccagcgccctggatgctgagagcgagcgggtggtgcaggaggccctggaccgggccagcgctggccgcacagtgctggtgattgcccaccggctgagcacagtgcggggggcccactgcatcgtggtgatggctgatggccgggtgtgggaggccggcacccatgaggagctgctgaagaagggcggcctgtatgcagagctgatccggcggcaggccctggatgcccccaggacagctgcccccccacccaagaagccagagggccccaggagccaccagcacaagagctag

SEQ ID NO: 144587 - DNA, 1404 bp, Artificial Sequence
  Description of Artificial Sequence: Synthetic coding sequence
atgctggtgcacctgttccgggtgggcatccggggcggccccttccctggccgcctgctgccccccctgcgcttccagaccttctctgctgtgcggcggctgctgcggctgcagccccgggtgtcccagaaggagggcaccctgggcgtgtctgaccacgcccagagcgccctgcccaccggcggccccctgtcctggccctggagatacagtgatggctaccgcagcagcagcctgctgcgggctgtggcccacctgcggagccagctgtgggcccacctgccccgggcccccctggccccccgctggagccccagcgcctggtgctgggtgggcggggccctgctgggccccatggtgctgagcaagcacccccacctgtgcctggtggccctgtgtgaggccgaggaggcccccccagccagcagcaccccccacgtggtgggcagccgcttcaactggaagctgttctggcagttcctgcacccccacctgctggtgctgggcgtggccgtggtgctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgaggcgggccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagagatatggagctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgactggaggagacctgatgtccttcctggtggccagccagacagtgcagaggcaggtgcacggccagcccctgtgccctgtgtgggccggcggccctggagcagaatgtcgctgccccggcctgtag

SEQ ID NO: 144588 - DNA, 2157 bp, Artificial Sequence
  Description of Artificial Sequence: Synthetic coding sequence
atgctggtgcacctgttccgggtgggcatccggggcggccccttccctggccgcctgctgccccccctgcgcttccagaccttctctgctgtgcgctacagtgatggctaccgcagcagcagcctgctgcgggctgtggcccacctgcggagccagctgtgggcccacctgccccgggcccccctggccccccgctggagccccagcgcctggtgctgggtgggcggggccctgctgggccccatggtgctgagcaagcacccccacctgtgcctggtggccctgtgtgaggccgaggaggcccccccagccagcagcacccctcatgtggtgggcagccgcttcaactggaagctgttctggcagttcctgcacccccacctgctggtgctgggcgtggccgtggtgctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgagaagagccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagcgctacggggctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgaccggcggggacctgatgtccttcctggtggccagccagacagtgcagaggtccatggccaacctgtctgtgctgtttggccaggtggtgcggggcctgtctgctggggcccgggtgtttgagtacatggccctgaacccctgcatccccctgagcggcggctgctgcgtgcccaaggagcagctgcggggctctgtgaccttccagaatgtgtgcttctcctacccctgccggcccggctttgaggtgctgaaggacttcaccctgaccctgcccccaggcaagatcgtggccctggtgggccagagcggcggcggcaagaccaccgtggccagcctgctggagcgcttctatgaccccacagctggggtggtgatgctggatggccgggacctgcggaccctggaccccagctggctgcggggccaggtggtgggcttcatcagccaggagcctgtgctgtttggcaccaccatcatggagaacatccgctttgggaagctggaggccagtgatgaggaggtgtacacagctgcccgggaggccaatgcccacgagttcatcaccagcttccctgagggctacaacacagtggtgggggagcggggcaccaccctgagcggcggccagaagcagaggctggccatcgcccgggccctgatcaagcagcccaccgtgctgatcctggatgaggccaccagcgccctggatgctgagagcgagcgggtggtgcaggaggccctggaccgggccagcgctggccgcacagtgctggtgattgcccaccggctgagcacagtgcggggggcccactgcatcgtggtgatggctgatggccgggtgtgggaggccggcacccatgaggagctgctgaagaagggcggcctgtatgcagagctgatccggcggcaggccctggatgcccccaggacagctgcccccccacccaagaagccagagggccccaggagccaccagcacaagagctag

SEQ ID NO: 144589 - DNA, 2106 bp, Artificial Sequence
  Description of Artificial Sequence: Synthetic coding sequence
atgctggtgcacctgttccgggtgggcatccggggcggccccttccctggccgcctgctgccccccctgcgcttccagaccttctctgctgtgcgctacagtgatggctaccgcagcagcagcctgctgcgggctgtggcccacctgcggagccagctgtgggcccacctgccccgggccctgctgggccccatggtgctgagcaagcacccccacctgtgcctggtggccctgtgtgaggccgaggaggcccccccagccagcagcaccccccacgtggtgggcagccgcttcaactggaagctgttctggcagttcctgcacccccacctgctggtgctgggcgtggccgtggtgctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgaggcgggccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagagatatggagctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgactggaggagacctgatgtccttcctggtggccagccagacagtgcagaggtccatggccaacctgtctgtgctgtttggccaggtggtgcggggcctgtctgctggggcccgggtgtttgagtacatggccctgaacccctgcatccccctgagcggcggctgctgcgtgcccaaggagcagctgcggggctctgtgaccttccagaatgtgtgcttctcctacccctgcaggcctggctttgaggtgctgaaggacttcaccctgaccctgcccccaggcaagatcgtggccctggtgggccagagcggcggcggcaagaccaccgtggccagcctgctggagcgcttctatgaccccacagctggggtggtgatgctggatggccgggacctgcggaccctggaccccagctggctgcggggccaggtggtgggcttcatcagccaggagcctgtgctgtttggcaccaccatcatggagaacatccgctttgggaagctggaggccagtgatgaggaggtgtacacagctgcccgggaggccaatgcccacgagttcatcaccagcttccctgagggctacaacacagtggtgggggagcggggcaccaccctgagcggcggccagaagcagaggctggccatcgcccgggccctgatcaagcagcccaccgtgctgatcctggatgaggccaccagcgccctggatgctgagagcgagcgggtggtgcaggaggccctggaccgggccagcgctggccgcacagtgctggtgattgcccaccggctgagcacagtgcggggggcccactgcatcgtggtgatggctgatggccgggtgtgggaggccggcacccatgaggagctgctgaagaagggcggcctgtatgcagagctgatccggcggcaggccctggatgcccccaggacagctgcccccccacccaagaagccagagggccccaggagccaccagcacaagagctag

SEQ ID NO: 144590 - DNA, 1296 bp, Artificial Sequence
  Description of Artificial Sequence: Synthetic coding sequence
atgctggtgcacctgttccgggtgggcatccggggcggccccttccctggccgcctgctgccccccctgcgcttccagaccttctctgctgtgcgctacagtgatggctaccgcagcagcagcctgctgcgggctgtggcccacctgcggagccagctgtgggcccacctgccccgggcccccctggccccccgctggagccccagcgcctggtgctgggtgggcggggccctgctgggccccatggtgctgagcaagcacccccacctgtgcctggtggccctgtgtgaggccgaggaggcccccccagccagcagcacccctcatgtggtgggcagccgcttcaactggaagctgttctggcagttcctgcacccccacctgctggtgctgggcgtggccgtggtgctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgagaagagccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagcgctacggggctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgaccggcggggacctgatgtccttcctggtggccagccagacagtgcagagcttcctgcgggtggccccctgccccaacagcctgcccctgcaggccgtgaccttccacgcctggaaggaccacccctag

SEQ ID NO: 144591 - DNA, 2082 bp, Artificial Sequence
  Description of Artificial Sequence: Synthetic coding sequence
atgctggtgcacctgttccgggtgggcatccggggcggccccttccctggccgcctgctgccccccctgcgcttccagaccttctctgctgtgcgctacagtgatggctaccgcagcagcagcctgctgcgggctgtggcccacctgcggagccagctgtgggcccacctgccccgggcccccctggccccccgctggagccccagcgcctggtgctgggtgggcggggccctgctgggccccatggtgctgagcaagcacccccacctgtgcctggtggccctgtgtgaggccgaggaggcccccccagccagcagcacccctcatgtggtgggcagccgcttcaactggaagctgttctggcagttcctgcacccccacctgctggtgctgggcgtggccgtggtgctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgagaagagccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagcgctacggggctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgaccggcggggacctgatgtccttcctggtggccagccagacagtgcagaggtccatggccaacctgtctgtgctgtttggccaggtggtgcggggcctgtctgctggggcccgggtgtttgagtacatggccctgaacccctgcatccccctgagcggcggctgctgcgtgcccaaggagcagctgcggggctctgtgaccttccagaatgtgtgcttctcctacccctgccggcccggctttgaggtgctgaaggacttcaccctgaccctgcccccaggcaagatcgtggccctggtgggccagagcggcggcggcaagaccaccgtggccagcctgctggagcgcttctatgaccccacagctggggtggtgatgctggatggccgggacctgcggaccctggaccccagctggctgcggggccaggtggtgggcttcatcagccaggagcctgtgctgtttggcaccaccatcatggagaacatccgctttgggaagctggaggccagtgatgaggaggtgtacacagctgcccgggaggccaatgcccacgagttcatcaccagcttccctgagggctacaacacagtggtgggggagcggggcaccaccctgagcggcggccagaagcagaggctggccatcgcccgggccctgatcaagcagcccaccgtgctgatcctggatgaggccaccagcgccctggatgctgagagcgagcgggtggtgcaggaggccctggaccgggccagcgctggccgcacagtgctggccggcacccatgaggagctgctgaagaagggcggcctgtatgcagagctgatccggcggcaggccctggatgcccccaggacagctgcccccccacccaagaagccagagggccccaggagccaccagcacaagagctag

SEQ ID NO: 144592 - DNA, 1893 bp, Artificial Sequence
  Description of Artificial Sequence: Synthetic coding sequence
atgagggtgaagctgctgctgcctgctgcccctgtgctgccccggcagcacgccggggccttcatcagcggccgggacagcggctggcccatcccccggcaggccgccacagccccacccctgcctgacatcctgagctgccagctggccctgggcgccgccctggtgaatgtgcagatccccctgctgctgggccagctggtggaggtggtggccaagtacacccgggaccacgtgggcagcttcatgacagagagccagaacctgagcacccacctgctgatcctgtatggagtgcagggcctgctgaccttcggctacctggtgctgctgagccacgtgggggagaggatggctgtggacatgagaagagccctcttcagcagcctgctgcggcaggacatcaccttctttgatgccaacaagacaggccagctggtgtcccggctgaccacagatgtgcaggagttcaagagcagcttcaagctggtgatcagccagggcctgcggagctgcacccaggtggccggctgcctggtgtccctgtccatgctgagcacccggctgaccctgctgctgatggtggccaccccagccctgatgggcgtgggcaccctgatgggcagcggcctgaggaagctgagccggcagtgccaggagcagatcgcccgggccatgggcgtggctgatgaggccctgggcaatgtgaggacagtgcgggcctttgccatggagcagcgggaggaggagcgctacggggctgagctggaggcctgccgctgcagagctgaggagctgggccggggcatcgccctcttccagggcctgagcaacatcgccttcaactgcatggtgctgggcaccctcttcatcggcggcagcctggtggccggccagcagctgaccggcggggacctgatgtccttcctggtggccagccagacagtgcagaggtccatggccaacctgtctgtgctgtttggccaggtggtgcggggcctgtctgctggggcccgggtgtttgagtacatggccctgaacccctgcatccccctgagcggcggctgctgcgtgcccaaggagcagctgcggggctctgtgaccttccagaatgtgtgcttctcctacccctgccggcccggctttgaggtgctgaaggacttcaccctgaccctgcccccaggcaagatcgtggccctggtgggccagagcggcggcggcaagaccaccgtggccagcctgctggagcgcttctatgaccccacagctggggtggtgatgctggatggccgggacctgcggaccctggaccccagctggctgcggggccaggtggtgggcttcatcagccaggagcctgtgctgtttggcaccaccatcatggagaacatccgctttgggaagctggaggccagtgatgaggaggtgtacacagctgcccgggaggccaatgcccacgagttcatcaccagcttccctgagggctacaacacagtggtgggggagcggggcaccaccctgagcggcggccagaagcagaggctggccatcgcccgggccctgatcaagcagcccaccgtgctgatcctggatgaggccaccagcgccctggatgctgagagcgagcgggtggtgcaggaggccctggaccgggccagcgctggccgcacagtgctggtgattgcccaccggctgagcacagtgcggggggcccactgcatcgtggtgatggctgatggccgggtgtgggaggccggcacccatgaggagctgctgaagaagggcggcctgtatgcagagctgatccggcggcaggccctggatgcccccaggacagctgcccccccacccaagaagccagagggccccaggagccaccagcacaagagctag

SEQ ID NO: 144593 - DNA, 2301 bp, Artificial Sequence
  Description of Artificial Sequence: Synthetic coding sequence
atgaggctgtggaaggctgtggtggtgaccctggccttcatgtctgtggacatctgtgtgaccacagccatctacgtgttcagccacctggacaggagcctgctggaggacatccgccacttcaacatctttgacagcgtgctggacctgtgggccgcctgcctgtaccgcagctgcctgctgctgggcgccaccatcggcgtggccaagaacagcgccctgggcccccggcggctgcgggcctcctggctggtgatcaccctggtgtgcctgtttgtgggcatctatgccatggtgaagctgctgctcttcagcgaggtgcggcggcccatccgggacccctggttctgggccctgtttgtgtggacctacatcagcctgggcgccagcttcctgctgtggtggctgctgagcacagtgcggcccggcacccaggccctggagcctggagctgccacagaagctgagggcttccctggcagcggccggcccccacctgagcaggccagcggggccaccctgcagaagctgctgagctacaccaagccagatgtggccttcctggtggccgccagcttcttcctgattgtggccgccctgggggagaccttcctgccctactacacaggccgggccattgatggcatcgtcatccagaagtccatggaccagttcagcacagctgtggtgattgtgtgcctgctggccatcggcagcagctttgctgctggcatccggggcggcatcttcaccctcatctttgcccggctgaacatccggctgaggaactgcctcttccgcagcctggtgtcccaggagaccagcttctttgatgaaaatagaactggagacctgatcagccggctgaccagtgacaccaccatggtgtctgacctggtgtcccagaacatcaacgtgttcctgaggaacacagtgaaggtgactggagtggtggtgttcatgttcagcctgtcctggcagctgagcctggtgaccttcatgggcttccccatcatcatgatggtgagcaacatctacggcaagtactacaagaggctgagcaaggaggtgcagaatgccctggcccgggccagcaacacagctgaggagaccatcagcgccatgaagacagtgcgcagctttgccaatgaggaggaggaggccgaggtgtacctgaggaagctgcagcaggtgtacaagctgaacaggaaggaggccgccgcctacatgtactacgtgtggggcagcggcctgaccctgctggtggtgcaggtgtccatcctgtactacggcggccacctggtgatcagcggccagatgaccagcggcaacctgattgccttcatcatctatgaatttgtgctgggggactgcatggagagcgtgggctctgtgtacagcggcctgatgcagggcgtgggcgctgctgagaaggtgtttgagttcatcgaccggcagcccaccatggtgcatgatggcagcctggccccagaccacctggagggccgggtggactttgaaaatgtgaccttcacctaccgcacccggccccacacccaggtgctgcagaatgtgtccttcagcctgagccctgggaaggtgacagccctggtgggccccagcggcagcggcaagagcagctgtgtgaacatcctggagaacttctaccccctggagggcggccgggtgctgctggatggcaagcccatcagcgcctatgaccacaagtacctgcacagggtcatcagcctggtgtcccaggagcctgtgctgtttgcccggagcatcacagacaacatctcctatggcctgcccaccgtgccctttgagatggtggtggaggccgcccagaaggccaatgcccacggcttcatcatggagctgcaggacggctacagcacagagaccggggagaagggggcccagctgagcggcggccagaagcagagggtggccatggcccgggccctggtgagaaatcctcctgtgctgatcctggatgaggccaccagcgccctggatgctgagagcgagtacctgatccagcaggccatccacggcaacctgcagaagcacacagtgctgatcatcgcccaccggctgagcacagtggagcacgcccacctgattgtggtgctggacaagggccgggtggtgcagcagggcacccaccagcagctgctggcccagggcggcctgtatgccaagctggtgcagaggcagatgctgggcctgcagcctgctgctgacttcaccgctggccacaatgaacctgtggccaacggcagccacaaggcctag

SEQ ID NO: 144594 - DNA, 2172 bp, Artificial Sequence
  Description of Artificial Sequence: Synthetic coding sequence
atgaggctgtggaaggctgtggtggtgaccctggccttcatgtctgtggacatctgtgtgaccacagccatctacgtgttcagccacctggacaggagcctgctggaggacatccgccacttcaacatctttgacagcgtgctggacctgtgggccgcctgcctgtaccgcagctgcctgctgctgggcgccaccatcggcgtggccaagaacagcgccctgggcccccggcggctgcgggcctcctggctggtgatcaccctggtgtgcctgtttgtgggcatctatgccatggtgaagctgctgctcttcagcgaggtgcggcggcccatccgggacccctggttctgggccctgtttgtgtggacctacatcagcctgggcgccagcttcctgctgtggtggctgctgagcacagtgcggcccggcacccaggccctggagcctggagctgccacagaagctgagggcttccctggcagcggccggcccccacctgagcaggccagcggggccaccctgcagaagctgctgagctacaccaagccagatgtggccttcctggtggccgccagcttcttcctgattgtggccgccctgggggagaccttcctgccctactacacaggccgggccattgatggcatcgtcatccagaagtccatggaccagttcagcacagctgtggtgattgtgtgcctgctggccatcggcagcagctttgctgctggcatccggggcggcatcttcaccctcatctttgcccggctgaacatccggctgaggaactgcctcttccgcagcctggtgtcccaggagaccagcttctttgatgaaaatagaactggagacctgatcagccggctgaccagtgacaccaccatggtgtctgacctggtgtcccagaacatcaacgtgttcctgaggaacacagtgaaggtgactggagtggtggtgttcatgttcagcctgtcctggcagctgagcctggtgaccttcatgggcttccccatcatcatgatggtgagcaacatctacggcaagtactacaagaggctgagcaaggaggtgcagaatgccctggcccgggccagcaacacagctgaggagaccatcagcgccatgaagacagtgcgcagctttgccaatgaggaggaggaggccgaggtgtacctgaggaagctgcagcaggtgtacaagctgaacaggaaggaggccgccgcctacatgtactacgtgtggggcagcggctctgtgggctctgtgtacagcggcctgatgcagggcgtgggcgctgctgagaaggtgtttgagttcatcgaccggcagcccaccatggtgcatgatggcagcctggccccagaccacctggagggccgggtggactttgaaaatgtgaccttcacctaccgcacccggccccacacccaggtgctgcagaatgtgtccttcagcctgagccctgggaaggtgacagccctggtgggccccagcggcagcggcaagagcagctgtgtgaacatcctggagaacttctaccccctggagggcggccgggtgctgctggatggcaagcccatcagcgcctatgaccacaagtacctgcacagggtcatcagcctggtgtcccaggagcctgtgctgtttgcccggagcatcacagacaacatctcctatggcctgcccaccgtgccctttgagatggtggtggaggccgcccagaaggccaatgcccacggcttcatcatggagctgcaggacggctacagcacagaaacaggagagaagggggcccagctgagcggcggccagaagcagagggtggccatggcccgggccctggtgaggaacccccctgtgctgatcctggatgaggccaccagcgccctggatgctgagagcgagtacctgatccagcaggccatccacggcaacctgcagaagcacacagtgctgatcatcgcccaccggctgagcacagtggagcacgcccacctgattgtggtgctggacaagggccgggtggtgcagcagggcacccaccagcagctgctggcccagggcggcctgtatgccaagctggtgcagaggcagatgctgggcctgcagcctgctgctgacttcaccgctggccacaatgaacctgtggccaacggcagccacaaggcctag

SEQ ID NO: 144595 - DNA, 2301 bp, Artificial Sequence; identical to SEQ ID NO: 144593
  Description of Artificial Sequence: Synthetic coding sequence

SEQ ID NO: 144596 - DNA, 2310 bp, Artificial Sequence
  Description of Artificial Sequence: Synthetic coding sequence
atgaggctgtggaaggctgtggtggtgaccctggccttcatgtctgtggacatctgtgtgaccacagccatctacgtgttcagccacctggacaggagcctgctggaggacatccgccacttcaacatctttgacagcgtgctggacctgtgggccgcctgcctgtaccgcagctgcctgctgctgggcgccaccatcggcgtggccaagaacagcgccctgggcccccggcggctgcgggcctcctggctggtgatcaccctggtgtgcctgtttgtgggcatctatgccatggtgaagctgctgctcttcagcgaggtgcggcggcccatccgggacccctggttctgggccctgtttgtgtggacctacatcagcctgggcgccagcttcctgctgtggtggctgctgagcacagtgcggcccggcacccaggccctggagcctggagctgccacagaagctgagggcttccctggcagcggccggcccccacctgagcaggccagcggggccaccctgcagaagctgctgagctacaccaagccagatgtggccttcctggtggccgccagcttcttcctgattgtggccgccctgggggagaccttcctgccctactacacaggccgggccattgatggcatcgtcatccagaagtccatggaccagttcagcacagctgtggtgattgtgtgcctgctggccatcggcagcagctttgctgctggcatccggggcggcatcttcaccctcatctttgcccggctgaacatccggctgaggaactgcctcttccgcagcctggtgtcccaggagaccagcttctttgatgaaaatagaactggagacctgatcagccggctgaccagtgacaccaccatggtgtctgacctggtgtcccagaacatcaacgtgttcctgaggaacacagtgaaggtgactggagtggtggtgttcatgttcagcctgtcctggcagctgagcctggtgaccttcatgggcttccccatcatcatgatggtgagcaacatctacggcaagtactacaagaggctgagcaaggaggtgcagaatgccctggcccgggccagcaacacagctgaggagaccatcagcgccatgaagacagtgcgcagctttgccaatgaggaggaggaggccgaggtgtacctgaggaagctgcagcaggtgtacaagctgaacaggaaggaggccgccgcctacatgtactacgtgtggggcagcggcctgaccctgctggtggtgcaggtgtccatcctgtactacggcggccacctggtgatcagcggccagatgaccagcggcaacctgattgccttcatcatctatgaatttgtgctgggggactgcatggagagcgtgggctctgtgtacagcggcctgatgcagggcgtgggcgctgctgagaaggtgtttgagttcatcgaccggcagcccaccatggtgcatgatggcagcctggccccagaccacctggagggccgggtggactttgaaaatgtgaccttcacctaccgcacccggccccacacccaggtgctgcagaatgtgtccttcagcctgagccctgggaaggtgacagccctggtgggccccagcggcagcggcaagagcagctgtgtgaacatcctggagaacttctaccccctggagggcggccgggtgctgctggatggcaagcccatcagcgcctatgaccacaagtacctgcacagggtcatcagcctggtgtcccaggagcctgtgctgtttgcccggagcatcacagacaacatctcctatggcctgcccaccgtgccctttgagatggtggtggaggccgcccagaaggccaatgcccacggcttcatcatggagctgcaggacggctacagcacagagaccggggagaagggggcccagctgagcggcggccagaagcagagggtggccatggcccgggccctggtgagaaatcctcctgtgctgatcctggatgaggccaccagcgccctggatgctgagagcgagtacctgagcccccagatccagcaggccatccacggcaacctgcagaagcacacagtgctgatcatcgcccaccggctgagcacagtggagcacgcccacctgattgtggtgctggacaagggccgggtggtgcagcagggcacccaccagcagctgctggcccagggcggcctgtatgccaagctggtgcagaggcagatgctgggcctgcagcctgctgctgacttcaccgctggccacaatgaacctgtggccaacggcagccacaaggcctag

SEQ ID NO: 144597 - DNA, 2112 bp, Artificial Sequence
  Description of Artificial Sequence: Synthetic coding sequence
atgaggctgtggaaggctgtggtggtgaccctggccttcatgtctgtggacatctgtgtgaccacagccatctacgtgttcagccacctggacaggagcctgctggaggacatccgccacttcaacatctttgacagcgtgctggacctgtgggccgcctgcctgtaccgcagctgcctgctgctgggcgccaccatcggcgtggccaagaacagcgccctgggcccccggcggctgcgggcctcctggctggtgatcaccctggtgtgcctgtttgtgggcatctatgccatggtgaagctgctgctcttcagcgaggtgcggcggcccatccgggacccctggttctgggccctgtttgtgtggacctacatcagcctgggcgccagcttcctgctgtggtggctgctgagcacagtgcggcccggcacccaggccctggagcctggagctgccacagaagctgagggcttccctggcagcggccggcccccacctgagcaggccagcggggccaccctgcagaagctgctgagctacaccaagccagatgtggccttcctggtggccgccagcttcttcctgattgtggccgccctgggggagaccttcctgccctactacacaggccgggccattgatggcatcgtcatccagaagtccatggaccagttcagcacagctgtggtgattgtgtgcctgctggccatcggcagcagctttgctgctggcatccggggcggcatcttcaccctcatctttgcccggctgaacatccggctgaggaactgcctcttccgcagcctggtgtcccaggagaccagcttctttgatgaaaatagaactggagacctgatcagccggctgaccagtgacaccaccatggtgtctgacctggtgtcccagaacatcaacgtgttcctgaggaacacagtgaaggtgactggagtggtggtgttcatgttcagcctgtcctggcagctgagcctggtgaccttcatgggcttccccatcatcatgatggtgagcaacatctacggcaagtactacaagaggctgagcaaggaggtgcagaatgccctggcccgggccagcaacacagctgaggagaccatcagcgccatgaagacagtgcgcagctttgccaatgaggaggaggaggccgaggtgtacctgaggaagctgcagcaggtgtacaagctgaacaggaaggaggccgccgcctacatgtactacgtgtggggcagcggcctgaccctgctggtggtgcaggtgtccatcctgtactacggcggccacctggtgatcagcggccagatgaccagcggcaacctgattgccttcatcatctatgaatttgtgctgggggactgcatggagaatgtgtccttcagcctgagccctgggaaggtgacagccctggtgggccccagcggcagcggcaagagcagctgtgtgaacatcctggagaacttctaccccctggagggcggccgggtgctgctggatggcaagcccatcagcgcctatgaccacaagtacctgcacagggtcatcagcctggtgtcccaggagcctgtgctgtttgcccggagcatcacagacaacatctcctatggcctgcccaccgtgccctttgagatggtggtggaggccgcccagaaggccaatgcccacggcttcatcatggagctgcaggacggctacagcacagaaacaggagagaagggggcccagctgagcggcggccagaagcagagggtggccatggcccgggccctggtgaggaacccccctgtgctgatcctggatgaggccaccagcgccctggatgctgagagcgagtacctgatccagcaggccatccacggcaacctgcagaagcacacagtgctgatcatcgcccaccggctgagcacagtggagcacgcccacctgattgtggtgctggacaagggccgggtggtgcagcagggcacccaccagcagctgctggcccagggcggcctgtatgccaagctggtgcagaggcagatgctgggcctgcagcctgctgctgacttcaccgctggccacaatgaacctgtggccaacggcagccacaaggcctag

SEQ ID NO: 144598 - DNA, 2301 bp, Artificial Sequence; identical to SEQ ID NO: 144593
  Description of Artificial Sequence: Synthetic coding sequence

SEQ ID NO: 144599 - DNA, 4395 bp, Artificial Sequence
  Description of Artificial Sequence: Synthetic coding sequence
atgtgcctgctggtgttccccctggtgcccaggagcccagactacatcctgccctgcagccctggctggaggctgcggctggccgccagcttcctgctgagcgtcttccccctgctggacctgctgcctgtggccctgcccccaggggccggccctggccccatcggcctggaggtgctggccggctgtgtggccgctgtggcctggatcagccacagcctggccctgtgggtgctggcccacagcccccacggccacagccggggccccctggccctggccctggtggccctgctgcctgccccagccctggtgctgactgtgctgtggcactgccagaggggcaccctgctgccccccctgctgcccggccccatggcccggctgtgcctgctgatcctgcagctggccgccctgctggcctatgccctgggctgggccgcccctgggggcccccgggagccctgggcccaggagcccctgctgcctgaggaccaggagcctgaggtggccgaggatggagagagctggctgagccgcttctcctatgcctggctggcccccctgctggcccggggggcctgtggggagctgcggcagccccaggacatctgccgcctgccccaccggctgcagcccacctacctggcccgggtcttccaggcccactggcaggagggcgcccggctgtggagggccctgtatggagccttcggccgctgctacctggccctgggcctgctgaagctggtgggcaccatgctgggcttcagcggccccctgctgctgagcctgctggtgggcttcctggaggagggccaggagcccctgagccacggcctgctgtatgccctgggcctggccggcggcgctgtgctgggcgctgtgctgcagaaccagtatggctatgaggtgtacaaggtgaccctgcaggcccggggagctgtgctgaacatcctgtactgcaaggccctgcagctgggccccagccggccccccaccggggaggccctgaacctgctgggcacagattctgagcggctgctgaactttgctggcagcttccacgaggcctggggcctgcccctgcagctggccatcaccctgtacctgctgtaccagcaggtgggcgtggcctttgtgggcggcctcatcctggccctgctgctggtgcctgtgaacaaggtgattgccacccgcatcatggccagcaaccaggagatgctgcagcacaaggatgcccgggtgaagctggtgacagagctgctgagcggcatccgggtcatcaagttctgtggctgggagcaggccctgggcgcccgggtggaggcctgccgggcccgggagctgggccgcctgcgggtcatcaagtacctggatgctgcctgtgtgtacctgtgggccgccctgcctgtggtgatcagcatcgtcatcttcatcacctacgtgctgatgggccaccagctgacagccaccaaggtgttcaccgccctggccctggtgaggatgctgatcctgcccctgaacaacttcccctgggtgatcaatggcctgctggaggccaaggtgtccctggaccgcatccagctgttcctggacctgcccaaccacaacccccaggcctactacagcccagactgtggccgcctgggcgcccagatcaagtggctgctgtgcagcgaccccccagctgagcccagcacagtgctggagctgcatggagccctcttctcctgggaccctgtgggcaccagcctggagaccttcatcagccacctggaggtgaagaagggcatgctggtgggcatcgtgggcaaggtgggctgcggcaagagcagcctgctggccgccatcgccggggagctgcaccggctgcggggccacgtggccgtgcggggcctgagcaagggcttcggcctggccacccaggagccctggatccagtttgccaccatccgggacaacatcctgtttgggaagacctttgatgcccagctgtacaaggaggtgctggaggcctgtgccctgaatgatgacctgagcatcctgcctgctggggaccagacagaggtgggggagaagggcgtgaccctgagcggcggccagagggcccgcatcgccctggcccgggctgtgtaccaggagaaggagctgtacctgctggatgaccccctggccgctgtggatgctgatgtggccaaccacctgctgcaccgctgcatcctgggcatgctgagctacaccacccggctgctgtgcacccacaggacagagtacctggagcgggcagatgctgtgctgctgatggaggccggccgcctcatccgggccggccccccatctgagatcctgcccctggtgcaggccgtgcccaaggcctgggccgagaatggccaggagagtgacagcgccacagcccagagcgtgcagaaccctgagaagaccaaggagggcctggaggaggagcagagcaccagcggccgcctgctgcaggaggagagcaagaaggagggcgctgtggccctgcacgtgtaccaggcctactggaaggctgtgggccagggcctggccctggccatcctcttcagcctgctgctgatgcaggccaccagaaatgctgctgactggtggctgagccactggatcagccagctgaaggccgagaacagcagccaggaggcccagcccagcaccagccctgcctccatgggcctcttcagcccccagctgctgctcttcagccctggcaacctgtacatccctgtgttccccctgcccaaggccgccccaaatggcagcagtgacatccgcttctacctgactgtgtatgccaccatcgccggcgtgaacagcctgtgcaccctgctgcgggctgtgctgtttgctgctggcaccctgcaggccgccgccaccctgcaccggcggctgctgcaccgggtgctgatggcccctgtgaccttcttcaatgccacccccaccggccgcatcctgaaccgcttcagcagtgatgtggcctgtgctgatgacagcctgcccttcatcctgaacatcctgctggccaatgctgctggcctgctgggcctgctggccgtgctgggcagcggcctgccctggctgctgctgctgctgccccccctgagcatcatgtactaccacgtgcagaggcactaccgggccagcagccgggagctgcggcggctgggcagcctgaccctgagccccctgtacagccacctggccgacaccctggccggcctgtctgtgctgcgggccaccggggccacctacagatttgaggaggagaacctgcggctgctggagctgaaccagcgctgccagtttgccaccagcgccaccatgcagtggctggacatccggctgcagctgatgggcgctgctgtggtgtctgccatcgccggcatcgccctggtgcagcaccagcagggcctggccaaccctggcctggtgggcctgagcctgtcctatgccctgagcctgaccggcctgctgagcggcctggtgagcagcttcacccagacagaggccatgctggtgtctgtggagcggctggaggagtacacctgtgacctgccccaggagccccagggccagcccctgcagctgggcaccggctggctgacccagggcggcgtggagttccaggatgtggtgctggcctacagacctggcctgcccaatgccctggatggagtgaccttctgtgtgcagcccggggagaagctgggcatcgtgggccgcacaggcagcggcaagagcagcctgctgctggtgctcttccggctgctggagcccagcagcggccgggtgctgctggatggagtggacaccagccagctggagctggcccagctgcggagccagctggccatcatcccccaggagcccttcctgttcagcggcaccgtgcgggagaacctggacccccagggcctgcacaaggaccgggccctgtggcaggccctgaagcagtgccacctgtctgaggtgatcacctccatgggcggcctggatggagagctgggggagggcggccgcagcctgagcctgggccagaggcagctgctgtgcctggcccgggccctgctgacagatgccaagatcctgtgcattgatgaggccacagcctctgtggaccagaagacagaccagctgctgcagcagaccatctgcaagagatttgccaacaagacagtgctgaccatcgcccaccggctgaacaccatcctgaacagcgacagagtgctggtgctgcaggccggccgggtggtggagctggacagccctgccaccctgaggaaccagccccacagcctcttccagcagctgctgcagagcagccagcagggcgtgcctgccagcctgggcggcccctag

SEQ ID NO: 144600 - DNA, 4479 bp, Artificial Sequence
  Description of Artificial Sequence: Synthetic coding sequence
atggagcggctgctggcccagctgtgtggcagcagcgctgcctggcccctgcccctgtgggagggggacaccaccggccactgcttcacccagctggtgctgagcgccctgccccacgccctgctggccgtgctgagcgcctgctacctgggcacccccaggagcccagactacatcctgccctgcagccctggctggaggctgcggctggccgccagcttcctgctgtctgtgttccccctgctggacctgctgcctgtggccctgcccccaggagctggccctggccccatcggcctggaggtgctggccggctgtgtggccgctgtggcctggatcagccacagcctggccctgtgggtgctggcccacagcccccacggccacagccggggccccctggccctggccctggtggccctgctgcctgccccagccctggtgctgactgtgctgtggcactgccagaggggcaccctgctgccccccctgctgcccggccccatggcccggctgtgcctgctgatcctgcagctggccgccctgctggcctatgccctgggctgggccgcccctgggggcccccgggagccctgggcccaggagcccctgctgcctgaggaccaggagcctgaggtggctgaagatggagagagctggctgagccgcttctcctatgcctggctggcccccctgctggcccggggggcctgtggggagctgcggcagccccaggacatctgccgcctgccccaccggctgcagcccacctacctggcccgggtcttccaggcccactggcaggagggcgcccggctgtggagggccctgtatggagccttcggccgctgctacctggccctgggcctgctgaagctggtgggcaccatgctgggcttcagcggccccctgctgctgagcctgctggtgggcttcctggaggagggccaggagcccctgagccacggcctgctgtatgccctgggcctggccggcggcgctgtgctgggcgctgtgctgcagaaccagtatggctatgaggtgtacaaggtgaccctgcaggcccggggagctgtgctgaacatcctgtactgcaaggccctgcagctgggccccagccggcccccaactggagaggccctgaacctgctgggcacagacagcgagcggctgctgaactttgctggcagcttccacgaggcctggggcctgcccctgcagctggccatcaccctgtacctgctgtaccagcaggtgggcgtggcctttgtgggcggcctcatcctggccctgctgctggtgcctgtgaacaaggtgattgccacccgcatcatggccagcaaccaggagatgctgcagcacaaggatgcccgggtgaagctggtgacagagctgctgagcggcatccgggtcatcaagttctgtggctgggagcaggccctgggcgcccgggtggaggcctgccgggcccgggagctgggccgcctgcgggtcatcaagtacctggatgctgcctgtgtgtacctgtgggccgccctgcctgtggtgatcagcatcgtcatcttcatcacctacgtgctgatgggccaccagctgacagccaccaaggtgttcaccgccctggccctggtgaggatgctgatcctgcccctgaacaacttcccctgggtgatcaatggcctgctggaggccaaggtgtccctggaccgcatccagctgttcctggacctgcccaaccacaacccccaggcctactacagcccagaccccccagctgagcccagcacagtgctggagctgcatggagccctcttctcctgggaccctgtgggcaccagcctggagaccttcatcagccacctggaggtgaagaagggcatgctggtgggcatcgtgggcaaggtgggctgcggcaagagcagcctgctggccgccatcgccggggagctgcaccggctgcggggccacgtggccgtgcggggcctgagcaagggcttcggcctggccacccaggagccctggatccagtttgccaccatccgggacaacatcctgtttgggaagacctttgatgcccagctgtacaaggaggtgctggaggcctgtgccctgaatgatgacctgagcatcctgcctgctggggaccagacagaggtgggggagaagggcgtgaccctgagcggcggccagagggcccgcatcgccctggcccgggctgtgtaccaggagaaggagctgtacctgctggatgaccccctggccgctgtggatgctgatgtggccaaccacctgctgcaccgctgcatcctgggcatgctgagctacaccacccggctgctgtgcacccacaggacagagtacctggagcgggcagatgctgtgctgctgatggaggccggccgcctcatccgggccggccccccatctgagatcctgcccctggtgcaggccgtgcccaaggcctgggccgagaatggccaggagagtgacagcgccacagcccagagcgtgcagaaccctgagaagaccaaggagggcctggaggaggagcagagcaccagcggccgcctgctgcaggaggagagcaagaaggagggcgctgtggccctgcacgtgtaccaggcctactggaaggctgtgggccagggcctggccctggccatcctcttcagcctgctgctgatgcaggccaccagaaatgctgctgactggtggctgagccactggatcagccagctgaaggccgagaacagcagccaggaggcccagcccagcaccagccctgcctccatgggcctcttcagcccccagctgctgctcttcagccctggcaacctgtacatccctgtgttccccctgcccaaggccgccccaaatggcagcagtgacatccgcttctacctgactgtgtatgccaccatcgccggcgtgaacagcctgtgcaccctgctgcgggctgtgctgtttgctgctggcaccctgcaggccgccgccaccctgcaccggcggctgctgcaccgggtgctgatggcccctgtgaccttcttcaatgccacccccaccggccgcatcctgaaccgcttcagcagtgatgtggcctgtgctgatgacagcctgcccttcatcctgaacatcctgctggccaatgctgctggcctgctgggcctgctggccgtgctgggcagcggcctgccctggctgctgctgctgctgccccccctgagcatcatgtactaccacgtgcagaggcactaccgggccagcagccgggagctgcggcggctgggcagcctgaccctgagccccctgtacagccacctggccgacaccctggccggcctgtctgtgctgcgggccaccggggccacctacagatttgaggaggagaacctgcggctgctggagctgaaccagcgctgccagtttgccaccagcgccaccatgcagtggctggacatccggctgcagctgatgggcgctgctgtggtgtctgccatcgccggcatcgccctggtgcagcaccagcagggcctggccaaccctggcctggtgggcctgagcctgtcctatgccctgagcctgaccggcctgctgagcggcctggtgagcagcttcacccagacagaggccatgctggtgtctgtggagcggctggaggagtacacctgtgacctgccccaggagccccagggccagcccctgcagctgggcaccggctggctgacccagggcggcgtggagttccaggatgtggtgctggcctacagacctggcctgcccaatgccctggatggagtgaccttctgtgtgcagcccggggagaagctgggcatcgtgggccgcacaggcagcggcaagagcagcctgctgctggtgctcttccggctgctggagcccagcagcggccgggtgctgctggatggagtggacaccagccagctggagctggcccagctgcggagccagctggccatcatcccccaggagcccttcctgttcagcggcaccgtgcgggagaacctggacccccagggcctgcacaaggaccgggccctgtggcaggccctgaagcagtgccacctgtctgaggtgatcacctccatgggcggcctggatggagagctgggggagggcggccgcagcctgagcctgggccagaggcagctgctgtgcctggcccgggccctgctgacagatgccaagatcctgtgcattgatgaggccacagcctctgtggaccagaagacagaccagctgctgcagcagaccatctgcaagagatttgccaacaagacagtgctgaccatcgcccaccggctgaacaccatcctgaacagcgacagagtgctggtgctgcaggccggccgggtggtggagctggacagccctgccaccctgaggaaccagccccacagcctcttccagcagctgctgcagagcagccagcagggcgtgcctgccagcctgggcggcccctag

SEQ ID NO: 144601 - DNA, 4035 bp, Artificial Sequence
  Description of Artificial Sequence: Synthetic coding sequence
atgaccaggaagaggacctactgggtgcccaacagcagcggcggcctggtgaacagaggaattgatattggagatgacatggtgtctggcctcatctacaagacctacaccctgcaggacggcccctggagccagcaggagaggaaccctgaggcccctggccgggctgctgtgcccccctggggcaagtatgatgctgccctgcggaccatgatccccttccggcccaagccccgcttccctgccccccagcccctggacaatgccggcctcttctcctacctgactgtgtcctggctgacccccctgatgatccagagcctgcggagccggctggatgagaacaccatcccccccctgtctgtgcatgatgccagtgacaagaatgtgcagaggctgcaccggctgtgggaggaggaggtgtccagaagaggcatcgagaaggcctctgtgctgctggtgatgctgcgcttccagaggaccaggctcatctttgatgccctgctgggcatctgcttctgcatcgcctctgtgctgggccccatcctgatcatccccaagatcctggagtacagcgaggagcagctgggcaatgtggtgcatggagtgggcctgtgctttgccctcttcctgtctgaatgtgtgaagagcctgtccttcagcagctcctggatcatcaaccagaggacagccatccgcttccgggctgctgtgagcagctttgcctttgagaagctgatccagttcaagagcgtcatccacatcaccagcggggaggccatctccttcttcaccggagatgtgaactacctgtttgagggcgtgtgctacggccccctggtgctgatcacctgtgccagcctggtgatctgcagcatcagcagctacttcatcatcggctacacagccttcatcgccatcctgtgctacctgctggtgttccccctggccgtgttcatgaccaggatggctgtgaaggcccagcaccacaccagcgaggtgtctgaccagaggatccgggtgaccagcgaggtgctgacctgcatcaagctgatcaagatgtacacctgggagaagccctttgccaagatcatcgaggacctgcggaggaaggagaggaagctgctggagaagtgtggcctggtgcagagcctgaccagcatcaccctcttcatcatccccaccgtggccacagctgtgtgggtgctgatccacaccagcctgaagctgaagctgacagcctccatggccttctccatgctggccagcctgaacctgctgcggctgagcgtcttctttgtgcccatcgctgtgaagggcctgaccaacagcaagtctgctgtgatgaggttcaagaagttcttcctgcaggagagccctgtgttctacgtgcagaccctgcaggaccccagcaaggccctggtgtttgaggaggccaccctgtcctggcagcagacctgccccggcatcgtgaatggagccctggagctggagagaaatggccacgccagcgagggcatgacccggcccagagatgccctgggccctgaggaggagggcaacagcctgggccctgagctgcacaagatcaacctggtggtgtccaagggcatgatgctgggcgtgtgtggcaacacaggcagcggcaagagcagcctgctgagcgccatcctggaggagatgcacctgctggagggctctgtgggcgtgcagggcagcctggcctacgtgccccagcaggcctggatcgtgtctggcaacatccgggagaacatcctgatgggcggggcctatgacaaggcccgctacctgcaggtgctgcactgctgcagcctgaacagagacctggagctgctgccctttggagacatgacagaaattggagagcggggcctgaacctgagcggcggccagaagcagaggatcagcctggcccgggctgtgtacagcgaccggcagatctacctgctggatgaccccctgtctgctgtggatgcccacgtgggcaagcacatctttgaggagtgcatcaagaagaccctgcggggcaagacagtggtgctggtgacccaccagctgcagtacctggagttctgtggccagatcatcctgctggagaatggcaagatctgtgaaaatggcacccacagcgagctgatgcagaagaagggcaagtatgcccagctgatccagaagatgcacaaggaggccaccagtgacatgctgcaggacacagccaagattgctgagaagcccaaggtggagagccaggccctggccaccagcctggaggagagcctgaatggaaatgctgtgcctgagcaccagctgacccaggaggaggagatggaggagggcagcctgtcctggagggtgtaccaccactacatccaggccgccggcggctacatggtgtcctgcatcatcttcttctttgtggtgctgattgtgttcctgaccatcttctccttctggtggctgagctactggctggagcagggcagcggcaccaacagcagccgggagagcaatggcaccatggctgacctgggcaacattgctgacaacccccagctgtccttctaccagctggtgtatggcctgaatgccctgctgctgatctgtgtgggcgtgtgcagcagcggcatcttcaccaaggtgaccaggaaggccagcacagccctgcacaacaagctgttcaacaaggtgttccgctgccccatgtccttctttgacaccatccccatcggccgcctgctgaactgctttgctggggacctggagcagctggaccagctgctgcccatcttcagcgagcagttcctggtgctgagcctgatggtgattgctgtgctgctgattgtgtctgtgctgagcccctacatcctgctgatgggcgccatcatcatggtgatctgcttcatctactacatgatgttcaagaaggccatcggggtcttcaagaggctggagaactacagccgcagccccctcttcagccacatcctgaacagcctgcagggcctgagcagcatccacgtgtatggcaagacagaggacttcatcagccagttcaagaggctgacagatgcccagaacaactacctgctgctcttcctgagcagcacccgctggatggccctgcggctggagatcatgaccaacctggtgaccctggccgtggccctgtttgtggccttcggcatcagcagcaccccctacagcttcaaggtgatggctgtgaacatcgtgctgcagctggccagcagcttccaggccacagccagaattggcctggagacagaggcccagttcaccgctgtggagcgcatcctgcagtacatgaagatgtgtgtgtctgaggcccccctgcacatggagggcaccagctgcccccagggctggccccagcacggggagatcatcttccaggactaccacatgaagtacagagacaacacccccaccgtgctgcacggcatcaacctgaccatccggggccacgaggtggtgggcatcgtgggccgcactggaagtggcaagagcagcctgggcatggccctcttccggctggtggagcccatggccggccgcatcctgattgatggagtggacatctgcagcatcggcctggaggacctgcggagcaagctgagcgtcatcccccaggaccctgtgctgctgagcggcaccatccgcttcaacctggacccctttgacagacacacagaccagcagatctgggatgccctggagaggaccttcctgaccaaggccatcatcctgattgatgaggccacagccagcattgacatggagacagacaccctcatccagaggaccatccgggaggccttccagggctgcaccgtgctggtgattgcccaccgggtgaccaccgtgctgaactgtgaccacatcctggtgatgggaaatggcaaggtggtggagtttgacaggcctgaggtgctgaggaagaagccaggcagcctgtttgctgccctgatggccacagccaccagcagcctgaggtag

SEQ ID NO: 144602 - DNA, 4149 bp, Artificial Sequence
  Description of Artificial Sequence: Synthetic coding sequence
atgaccaggaagaggacctactgggtgcccaacagcagcggcggcctggtgaacagaggaattgatattggagatgacatggtgtctggcctcatctacaagacctacaccctgcaggacggcccctggagccagcaggagaggaaccctgaggcccctggccgggctgctgtgcccccctggggcaagtatgatgctgccctgcggaccatgatccccttccggcccaagccccgcttccctgccccccagcccctggacaatgccggcctcttctcctacctgactgtgtcctggctgacccccctgatgatccagagcctgcggagccggctggatgagaacaccatcccccccctgtctgtgcatgatgccagtgacaagaatgtgcagaggctgcaccggctgtgggaggaggaggtgtccagaagaggcatcgagaaggcctctgtgctgctggtgatgctgcgcttccagaggaccaggctcatctttgatgccctgctgggcatctgcttctgcatcgcctctgtgctgggccccatcctgatcatccccaagatcctggagtacagcgaggagcagctgggcaatgtggtgcatggagtgggcctgtgctttgccctcttcctgtctgaatgtgtgaagagcctgtccttcagcagctcctggatcatcaaccagaggacagccatccgcttccgggctgctgtgagcagctttgcctttgagaagctgatccagttcaagagcgtcatccacatcaccagcggggaggccatctccttcttcaccggagatgtgaactacctgtttgagggcgtgtgctacggccccctggtgctgatcacctgtgccagcctggtgatctgcagcatcagcagctacttcatcatcggctacacagccttcatcgccatcctgtgctacctgctggtgttccccctggccgtgttcatgaccaggatggctgtgaaggcccagcaccacaccagcgaggtgtctgaccagaggatccgggtgaccagcgaggtgctgacctgcatcaagctgatcaagatgtacacctgggagaagccctttgccaagatcatcgaggacctgcggaggaaggagaggaagctgctggagaagtgtggcctggtgcagagcctgaccagcatcaccctcttcatcatccccaccgtggccacagctgtgtgggtgctgatccacaccagcctgaagctgaagctgacagcctccatggccttctccatgctggccagcctgaacctgctgcggctgagcgtcttctttgtgcccatcgctgtgaagggcctgaccaacagcaagtctgctgtgatgaggttcaagaagttcttcctgcaggagagccctgtgttctacgtgcagaccctgcaggaccccagcaaggccctggtgtttgaggaggccaccctgtcctggcagcagacctgccccggcatcgtgaatggagccctggagctggagagaaatggccacgccagcgagggcatgacccggcccagagatgccctgggccctgaggaggagggcaacagcctgggccctgagctgcacaagatcaacctggtggtgtccaagggcatgatgctgggcgtgtgtggcaacacaggcagcggcaagagcagcctgctgagcgccatcctggaggagatgcacctgctggagggctctgtgggcgtgcagggcagcctggcctacgtgccccagcaggcctggatcgtgtctggcaacatccgggagaacatcctgatgggcggggcctatgacaaggcccgctacctgcaggtgctgcactgctgcagcctgaacagagacctggagctgctgccctttggagacatgacagaaattggagagcggggcctgaacctgagcggcggccagaagcagaggatcagcctggcccgggctgtgtacagcgaccggcagatctacctgctggatgaccccctgtctgctgtggatgcccacgtgggcaagcacatctttgaggagtgcatcaagaagaccctgcggggcaagacagtggtgctggtgacccaccagctgcagtacctggagttctgtggccagatcatcctgctggagaatggcaagatctgtgaaaatggcacccacagcgagctgatgcagaagaagggcaagtatgcccagctgatccagaagatgcacaaggaggccaccagtgacatgctgcaggacacagccaagattgctgagaagcccaaggtggagagccaggccctggccaccagcctggaggagagcctgaatggaaatgctgtgcctgagcaccagctgacccaggaggaggagatggaggagggcagcctgtcctggagggtgtaccaccactacatccaggccgccggcggctacatggtgtcctgcatcatcttcttctttgtggtgctgattgtgttcctgaccatcttctccttctggtggctgagctactggctggagcagggcagcggcaccaacagcagccgggagagcaatggcaccatggctgacctgggcaacattgctgacaacccccagctgtccttctaccagctggtgtatggcctgaatgccctgctgctgatctgtgtgggcgtgtgcagcagcggcatcttcaccaaggtgaccaggaaggccagcacagccctgcacaacaagctgttcaacaaggtgttccgctgccccatgtccttctttgacaccatccccatcggccgcctgctgaactgctttgctggggacctggagcagctggaccagctgctgcccatcttcagcgagcagttcctggtgctgagcctgatggtgattgctgtgctgctgattgtgtctgtgctgagcccctacatcctgctgatgggcgccatcatcatggtgatctgcttcatctactacatgatgttcaagaaggccatcggggtcttcaagaggctggagaactacagccgcagccccctcttcagccacatcctgaacagcctgcagggcctgagcagcatccacgtgtatggcaagacagaggacttcatcagccagttcaagaggctgacagatgcccagaacaactacctgctgctcttcctgagcagcacccgctggatggccctgcggctggagatcatgaccaacctggtgaccctggccgtggccctgtttgtggccttcggcatcagcagcaccccctacagcttcaaggtgatggctgtgaacatcgtgctgcagctggccagcagcttccaggccacagccagaattggcctggagacagaggcccagttcaccgctgtggagcgcatcctgcagtacatgaagatgtgtgtgtctgaggcccccctgcacatggagggcaccagctgcccccagggctggccccagcacggggagatcatcttccaggactaccacatgaagtacagagacaacacccccaccgtgctgcacggcatcaacctgaccatccggggccacgaggtggtgggcatcgtgggccgcactggaagtggcaagagcagcctgggcatggccctcttccggctggtggagcccatggccggccgcatcctgattgatggagtggacatctgcagcatcggcctggaggacctgcggagcaagctgagcgtcatcccccaggaccctgtgctgctgagcggcaccatccgcttcaacctggacccctttgacagacacacagaccagcagatctgggatgccctggagaggaccttcctgaccaaggccatcagcaagttccccaagaagctgcacacagatgtggtggagaatggaggcaacttctctgtgggggagcggcagctgctgtgcatcgcccgggctgtgctgaggaacagcaagatcatcctgattgatgaggccacagccagcattgacatggagacagacaccctcatccagaggaccatccgggaggccttccagggctgcaccgtgctggtgattgcccaccgggtgaccaccgtgctgaactgtgaccacatcctggtgatgggaaatggcaaggtggtggagtttgacaggcctgaggtgctgaggaagaagccaggcagcctgtttgctgccctgatggccacagccaccagcagcctgaggtag

SEQ ID NO: 144603 - DNA, 4149 bp, Artificial Sequence; identical to SEQ ID NO: 144602
  Description of Artificial Sequence: Synthetic coding sequence

SEQ ID NO: 144604 - DNA, 4149 bp, Artificial Sequence; identical to SEQ ID NO: 144602
  Description of Artificial Sequence: Synthetic coding sequence

SEQ ID NO: 144605 - DNA, 2268 bp, Artificial Sequence
  Description of Artificial Sequence: Synthetic coding sequence
atgaccaggaagaggacctactgggtgcccaacagcagcggcggcctggtgaacagaggaattgatattggagatgacatggtgtctggcctcatctacaagacctacaccctgcaggacggcccctggagccagcaggagaggaaccctgaggcccctggccgggctgctgtgcccccctggggcaagtatgatgctgccctgcggaccatgatccccttccggcccaagccccgcttccctgccccccagcccctggacaatgccggcctcttctcctacctgactgtgtcctggctgacccccctgatgatccagagcctgcggagccggctggatgagaacaccatcccccccctgtctgtgcatgatgccagtgacaagaatgtgcagaggctgcaccggctgtgggaggaggaggtgtccagaagaggcatcgagaaggcctctgtgctgctggtgatgctgcgcttccagaggaccaggctcatctttgatgccctgctgggcatctgcttctgcatcgcctctgtgctgggccccatcctgatcatccccaagatcctggagtacagcgaggagcagctgggcaatgtggtgcatggagtgggcctgtgctttgccctcttcctgtctgaatgtgtgaagagcctgtccttcagcagctcctggatcatcaaccagaggacagccatccgcttccgggctgctgtgagcagctttgcctttgagaagctgatccagttcaagagcgtcatccacatcaccagcggggaggccatctccttcttcaccggagatgtgaactacctgtttgagggcgtgtgctacggccccctggtgctgatcacctgtgccagcctggtgatctgcagcatcagcagctacttcatcatcggctacacagccttcatcgccatcctgtgctacctgctggtgttccccctggccgtgttcatgaccaggatggctgtgaaggcccagcaccacaccagcgaggtgtctgaccagaggatccgggtgaccagcgaggtgctgacctgcatcaagctgatcaagatgtacacctgggagaagccctttgccaagatcatcgaggacctgcggaggaaggagaggaagctgctggagaagtgtggcctggtgcagagcctgaccagcatcaccctcttcatcatccccaccgtggccacagctgtgtgggtgctgatccacaccagcctgaagctgaagctgacagcctccatggccttctccatgctggccagcctgaacctgctgcggctgagcgtcttctttgtgcccatcgctgtgaagggcctgaccaacagcaagtctgctgtgatgaggttcaagaagttcttcctgcaggagagccctgtgttctacgtgcagaccctgcaggaccccagcaaggccctggtgtttgaggaggccaccctgtcctggcagcagacctgccccggcatcgtgaatggagccctggagctggagagaaatggccacgccagcgagggcatgacccggcccagagatgccctgggccctgaggaggagggcaacagcctgggccctgagctgcacaagatcaacctggtggtgtccaagggcatgatgctgggcgtgtgtggcaacacaggcagcggcaagagcagcctgctgagcgccatcctggaggagatgcacctgctggagggctctgtgggcgtgcagggcagcctggcctacgtgccccagcaggcctggatcgtgtctggcaacatccgggagaacatcctgatgggcggggcctatgacaaggcccgctacctgcaggtgctgcactgctgcagcctgaacagagacctggagctgctgccctttggagacatgacagaaattggagagcggggcctgaacctgagcggcggccagaagcagaggatcagcctggcccgggctgtgtacagcgaccggcagatctacctgctggatgaccccctgtctgctgtggatgcccacgtgggcaagcacatctttgaggagtgcatcaagaagaccctgcggggcaagacagtggtgctggtgacccaccagctgcagtacctggagttctgtggccagatcatcctgctggagaatggcaagatctgtgaaaatggcacccacagcgagctgatgcagaagaagggcaagtatgcccagctgatccagaagatgcacaaggaggccaccagctgccgcagcatcagcagccacagaagaagacgctggaagaaggccccctag

SEQ ID NO: 144606 - DNA, 4080 bp, Artificial Sequence
  Description of Artificial Sequence: Synthetic coding sequence
atggtgggggagggcccctacctgatcagtgacctggaccagagaggaagaagaagaagctttgctgagagatatgaccccagcctgaagaccatgatccctgtgcggccctgtgcccggctggcccccaaccctgtggatgatgctggcctgctgagctttgccaccttctcctggctgacccctgtgatggtgaagggctaccggcagaggctgactgtggacaccctgccccccctgagcacctatgacagcagtgacaccaatgccaagcgcttccgggtgctgtgggatgaggaggtggcccgggtgggccctgagaaggccagcctgagccacgtggtgtggaagttccagaggaccagggtgctgatggacatcgtggccaacatcctgtgcatcatcatggccgccatcggccctgtgatcctgatccaccagatcctgcagcagacagagaggaccagcggcaaggtgtgggtgggcatcggcctgtgcatcgccctgtttgccacagagttcaccaaggtgttcttctgggccctggcctgggccatcaactacagaacagccatccggctgaaggtggccctgagcaccctggtgtttgagaacctggtgtccttcaagaccctgacccacatctctgtgggggaggtgctgaacatcctgagcagtgacagctacagcctgtttgaggccgccctcttctgccccctgcctgccaccatccccatcctgatggtgttctgtgccgcctatgccttcttcatcctgggccccacagccctgattggcatctctgtgtatgtgatcttcatccctgtgcagatgttcatggccaagctgaacagcgccttccgccgcagcgccatcctggtgacagacaagagggtgcagaccatgaatgagttcctgacctgcatccgcctcatcaagatgtatgcctgggagaagagcttcaccaacaccatccaggacatcagaagaagagagaggaagctgctggagaaggccggctttgtgcagagcggcaacagcgccctggcccccatcgtgtccaccatcgccatcgtgctgaccctgagctgccacatcctgctgcggaggaagctgacagcccctgtggccttctctgtgattgccatgtttaatgtgatgaagttcagcatcgccatcctgcccttcagcatcaaggccatggccgaggccaacgtgtccctgcggaggatgaagaagatcctgattgacaagagcccccccagctacatcacccagcctgaggaccctgacacagtgctgctgctggccaatgccaccctgacctgggagcacgaggccagcaggaagagcacccccaagaagctgcagaaccagaagaggcacctgtgcaagaagcagaggtctgaggcctacagcgagaggagccccccagccaagggggccactggacctgaggagcagagcgacagcctgaagtctgtgctgcacagcatcagctttgtggtgaggaagggcaagatcctgggcatctgtggaaatgtgggcagcggcaagagcagcctgctggccgccctgctgggccagatgcagctgcagaagggcgtggtggccgtgaatggcaccctggcctacgtgtcccagcaggcctggatcttccacggcaatgtgcgggagaacatcctgtttggagagaagtatgaccaccagcgctaccagcacacagtgcgggtgtgtggcctgcagaaggacctgagcaacctgccctacggggacctgacagagatcggggagcggggcctgaacctgagcggcggccagaggcagaggatcagcctggcccgggctgtgtacagcgaccggcagctgtacctgctggatgaccccctgtctgctgtggatgcccacgtgggcaagcacgtgtttgaggagtgcatcaagaagaccctgcggggcaagacagtggtgctggtgacccaccagctgcagttcctggagagctgtgatgaagtcatcctgctggaggatggagagatctgtgagaagggcacccacaaggagctgatggaggagcggggccgctatgccaagctgatccacaacctgcggggcctgcagttcaaggaccctgagcacctgtacaatgctgccatggtggaggccttcaaggagagccctgctgagcgggaggaggatgctggcatcatcgtgctggcccctggaaatgagaaggatgagggcaaggagagcgagaccggcagcgagtttgtggacaccaaggtgcctgagcaccagctgatccagacagagagcccccaggagggcaccgtgacctggaagacctaccacacctacatcaaggccagcggcggctacctgctgagcctcttcaccgtcttcctgttcctgctgatgattggcagcgctgccttcagcaactggtggctgggcctgtggctggacaagggcagcaggatgacctgtggcccccagggcaacagaaccatgtgtgaggtgggcgctgtgctggccgacatcggccagcacgtgtaccagtgggtgtacacagcctccatggtgttcatgctggtgtttggagtgaccaagggctttgtgttcaccaagaccaccctgatggccagcagcagcctgcatgacacagtgtttgacaagatcctgaagagccccatgtccttctttgacaccacccccaccggccgcctgatgaaccgcttcagcaaggacatggatgagctggatgtgcggctgcccttccacgccgagaacttcctgcagcagttcttcatggtggtgttcatcctggtgatcctggccgctgtgtttcctgctgtgctgctggtggtggccagcctggccgtgggcttcttcatcctgctgcgcatcttccaccggggcgtgcaggagctgaagaaggtggagaatgtgagccgcagcccctggttcacccacatcaccagctccatgcagggcctgggcatcatccacgcctacggcaagaaggagagctgcatcacctaccacctgctgtacttcaactgtgccctgcgctggtttgccctgaggatggatgtgctgatgaacatcctgaccttcaccgtggccctgctggtgaccctgtccttcagcagcatcagcaccagcagcaagggcctgagcctgagctacatcatccagctgagcggcctgctgcaggtgtgtgtgaggactggaacagagacccaggccaagttcacctctgtggagctgctgcgggagtacatcagcacctgtgtgcctgagtgcacccaccccctgaaggtgggcacctgccccaaggactggcccagcagaggagagatcaccttccgggactaccagatgagatacagagacaacacccccctggtgctggacagcctgaacctgaacatccagagcggccagacagtgggcatcgtgggccgcacaggcagcggcaagagcagcctgggcatggccctcttccggctggtggagcccgccagcggcaccatcttcattgatgaggtggacatctgcatcctgagcctggaggacctgcggaccaagctgaccgtcatcccccaggaccctgtgctgtttgtgggcaccgtgcgctacaacctggacccctttgagagccacacagatgagatgctgtggcaggtgctggagaggaccttcatgagggacaccatcatgaagctgcctgagaagctgcaggccgaggtgacagaaaatggagagaacttctctgtgggggagcggcagctgctgtgtgtggcccgggccctgctgaggaacagcaagatcatcctgctggatgaggccacagcctccatggacagcaagacagacaccctggtgcagaacaccatcaaggatgccttcaagggctgcaccgtgctgaccatcgcccaccggctgaacacagtgctgaactgtgaccacgtgctggtgatggagaatggcaaggtgattgaatttgacaagccagaggtgctggccgagaagccagattctgcctttgccatgctgctggccgctgaggtgcggctgtag

SEQ ID NO: 144607 - DNA, 1902 bp, Artificial Sequence
  Description of Artificial Sequence: Synthetic coding sequence
atggtgggggagggcccctacctgatcagtgacctggaccagagaggaagaagaagaagctttgctgagagatatgaccccagcctgaagaccatgatccctgtgcggccctgtgcccggctggcccccaaccctgtggatgatgctggcctgctgagctttgccaccttctcctggctgacccctgtgatggtgaagggctaccggcagaggctgactgtggacaccctgccccccctgagcacctatgacagcagtgacaccaatgccaagcgcttccgggtgctgtgggatgaggaggtggcccgggtgggccctgagaaggccagcctgagccacgtggtgtggaagttccagaggaccagggtgctgatggacatcgtggccaacatcctgtgcatcatcatggccgccatcggccccaccgtgctgatccaccagatcctgcagcagacagagaggaccagcggcaaggtgtgggtgggcatcggcctgtgcatcgccctgtttgccacagagttcaccaaggtgttcttctgggccctggcctgggccatcaactacagaacagccatccggctgaaggtggccctgagcaccctggtgtttgagaacctggtgtccttcaagaccctgacccacatctctgtgggggaggtgctgaacatcctgagcagtgacagctacagcctgtttgaggccgccctcttctgccccctgcctgccaccatccccatcctgatggtgttctgtgccgcctatgccttcttcatcctgggccccacagccctgattggcatctctgtgtatgtgatcttcatccctgtgcagatgttcatggccaagctgaacagcgccttccgccgcagcgccatcctggtgacagacaagagggtgcagaccatgaatgagttcctgacctgcatccgcctcatcaagatgtatgcctgggagaagagcttcaccaacaccatccaggacatcagaagaagagagaggaagctgctggagaaggccggctttgtgcagagcggcaacagcgccctggcccccatcgtgtccaccatcgccatcgtgctgaccctgagctgccacatcctgctgcggaggaagctgacagcccctgtggccttctctgtgattgccatgtttaatgtgatgaagttcagcatcgccatcctgcccttcagcatcaaggccatggccgaggccaacgtgtccctgcggaggatgaagaagatcctgattgacaagagcccccccagctacatcacccagcctgaggaccctgacacagtgctgctgctggccaatgccaccctgacctgggagcacgaggccagcaggaagagcacccccaagaagctgcagaaccagaagaggcacctgtgcaagaagcagaggtctgaggcctacagcgagaggagccccccagccaagggggccactggacctgaggagcagagcgacagcctgaagtctgtgctgcacagcatcagctttgtggtgaggaagggcaagatcctgggcatctgtggaaatgtgggcagcggcaagagcagcctgctggccgccctgctgggccagatgcagctgcagaagggcgtggtggccgtgaatggcaccctggcctacgtgtcccagcaggcctggatcttccacggcaatgtgcgggagaacatcctgtttggagagaagtatgaccaccagaggctgggcagcggggccagcaccagcctgggcggccggggccggggcctggcctggccagccctgagcacccccaccgtgagcagcacctgctggaccaccccctgccggccctggacccccacctggggcagcaccagcctgcggagcgccctgcggcggcgcagcggggagcggcagagctcctggtag

SEQ ID NO: 144608 - DNA, 2808 bp, Artificial Sequence
  Description of Artificial Sequence: Synthetic coding sequence
atggtgggggagggcccctacctgatcagtgacctggaccagagaggaagaagaagaagctttgctgagagatatgaccccagcctgaagaccatgatccctgtgcggccctgtgcccggctggcccccaaccctgtggatgatgctggcctgctgagctttgccaccttctcctggctgacccctgtgatggtgaagggctaccggcagaggctgactgtggacaccctgccccccctgagcacctatgacagcagtgacaccaatgccaagcgcttccgggtgctgtgggatgaggaggtggcccgggtgggccctgagaaggccagcctgagccacgtggtgtggaagttccagaggaccagggtgctgatggacatcgtggccaacatcctgtgcatcatcatggccgccatcggccccaccgtgctgatccaccagatcctgcagcagacagagaggaccagcggcaaggtgtgggtgggcatcggcctgtgcatcgccctgtttgccacagagttcaccaaggtgttcttctgggccctggcctgggccatcaactacagaacagccatccggctgaaggtggccctgagcaccctggtgtttgagaacctggtgtccttcaagaccctgacccacatctctgtgggggaggtgctgaacatcctgagcagtgacagctacagcctgtttgaggccgccctcttctgccccctgcctgccaccatccccatcctgatggtgttctgtgccgcctatgccttcttcatcctgggccccacagccctgattggcatctctgtgtatgtgatcttcatccctgtgcagatgttcatggccaagctgaacagcgccttccgccgcagcgccatcctggtgacagacaagagggtgcagaccatgaatgagttcctgacctgcatccgcctcatcaagatgtatgcctgggagaagagcttcaccaacaccatccaggacatcagaagaagagagaggaagctgctggagaaggccggctttgtgcagagcggcaacagcgccctggcccccatcgtgtccaccatcgccatcgtgctgaccctgagctgccacatcctgctgcggaggaagctgacagcccctgtggccttctctgtgattgccatgtttaatgtgatgaagttcagcatcgccatcctgcccttcagcatcaaggccatggccgaggccaacgtgtccctgcggaggatgaagaagatcctgattgacaagagcccccccagctacatcacccagcctgaggaccctgacacagtgctgctgctggccaatgccaccctgacctgggagcacgaggccagcaggaagagcacccccaagaagctgcagaaccagaagaggcacctgtgcaagaagcagaggtctgaggcctacagcgagaggagccccccagccaagggggccactggacctgaggagcagagcgacagcctgaagtctgtgctgcacagcatcagctttgtggtgaggaagggcaagatcctgggcatctgtggaaatgtgggcagcggcaagagcagcctgctggccgccctgctgggccagatgcagctgcagaagggcgtggtggccgtgaatggcaccctggcctacgtgtcccagcaggcctggatcttccacggcaatgtgcgggagaacatcctgtttggagagaagtatgaccaccagcgctaccagcacacagtgcgggtgtgtggcctgcagaaggacctgagcaacctgccctacggggacctgacagagatcggggagcggggcctgaacctgagcggcggccagaggcagaggatcagcctggcccgggctgtgtacagcgaccggcagctgtacctgctggatgaccccctgtctgctgtggatgcccacgtgggcaagcacgtgtttgaggagtgcatcaagaagaccctgcggggcaagacagtggtgctggtgacccaccagctgcagttcctggagagctgtgatgaagtcatcctgctggaggatggagagatctgtgagaagggcacccacaaggagctgatggaggagcggggccgctatgccaagctgatccacaacctgcggggcctgcagttcaaggaccctgagcacctgtacaatgctgccatggtggaggccttcaaggagagccctgctgagcgggaggaggatgctgtgctggcccctggaaatgagaaggatgagggcaaggagagcgagactggaagtgaatttgtggacaccaaggtgcctgagcaccagctgatccagacagagagcccccaggagggcaccgtgacctggaagacctaccacacctacatcaaggccagcggcggctacctgctgagcctcttcaccgtcttcctgttcctgctgatgattggcagcgctgccttcagcaactggtggctgggcctgtggctggacaagggcagcaggatgacctgtggcccccagggcaacagaaccatgtgtgaggtgggcgctgtgctggccgacatcggccagcacgtgtaccagtgggtgtacacagcctccatggtgttcatgctggtgtttggagtgaccaagggctttgtgttcaccaagaccaccctgatggccagcagcagcctgcatgacacagtgtttgacaagcacttcccccagaggagccctggggcccaggagggcggggagtgccagcctgtgaccctggtgcacccccaccacctgctgcatgctggccctggccaccacagccggctgtggcaggagggggagctgcaccacctggtgtag

SEQ ID NO: 144609 - DNA, 2793 bp, Artificial Sequence
  Description of Artificial Sequence: Synthetic coding sequence
atggtgggggagggcccctacctgatcagtgacctggaccagagaggaagaagaagaagctttgctgagagatatgaccccagcctgaagaccatgatccctgtgcggccctgtgcccggctggcccccaaccctgtggatgatgctggcctgctgagctttgccaccttctcctggctgacccctgtgatggtgaagggctaccggcagaggctgactgtggacaccctgccccccctgagcacctatgacagcagtgacaccaatgccaagcgcttccgggtgctgtgggatgaggaggtggcccgggtgggccctgagaaggccagcctgagccacgtggtgtggaagttccagaggaccagggtgctgatggacatcgtggccaacatcctgtgcatcatcatggccgccatcggccccaccgtgctgatccaccagatcctgcagcagacagagaggaccagcggcaaggtgtgggtgggcatcggcctgtgcatcgccctgtttgccacagagttcaccaaggtgttcttctgggccctggcctgggccatcaactacagaacagccatccggctgaaggtggccctgagcaccctggtgtttgagaacctggtgtccttcaagaccctgacccacatctctgtgggggagatgttcatggccaagctgaacagcgccttccgccgcagcgccatcctggtgacagacaagagggtgcagaccatgaatgagttcctgacctgcatccgcctcatcaagatgtatgcctgggagaagagcttcaccaacaccatccaggacatcagaagaagagagaggaagctgctggagaaggccggctttgtgcagagcggcaacagcgccctggcccccatcgtgtccaccatcgccatcgtgctgaccctgagctgccacatcctgctgcggaggaagctgacagcccctgtggccttctctgtgattgccatgtttaatgtgatgaagttcagcatcgccatcctgcccttcagcatcaaggccatggccgaggccaacgtgtccctgcggaggatgaagaagatcctgattgacaagagcccccccagctacatcacccagcctgaggaccctgacacagtgctgctgctggccaatgccaccctgacctgggagcacgaggccagcaggaagagcacccccaagaagctgcagaaccagaagaggcacctgtgcaagaagcagaggtctgaggcctacagcgagaggagccccccagccaagggggccactggacctgaggagcagagcgacagcctgaagtctgtgctgcacagcatcagctttgtggtgaggaagggcaagatcctgggcatctgtggaaatgtgggcagcggcaagagcagcctgctggccgccctgctgggccagatgcagctgcagaagggcgtggtggccgtgaatggcaccctggcctacgtgtcccagcaggcctggatcttccacggcaatgtgcgggagaacatcctgtttggagagaagtatgaccaccagcgctaccagcacacagtgcgggtgtgtggcctgcagaaggacctgagcaacctgccctacggggacctgacagagatcggggagcggggcctgaacctgagcggcggccagaggcagaggatcagcctggcccgggctgtgtacagcgaccggcagctgtacctgctggatgaccccctgtctgctgtggatgcccacgtgggcaagcacgtgtttgaggagtgcatcaagaagaccctgcggggcaagacagtggtgctggtgacccaccagctgcagttcctggagagctgtgatgaagtcatcctgctggaggatggagagatctgtgagaagggcacccacaaggagctgatggaggagcggggccgctatgccaagctgatccacaacctgcggggcctgcagttcaaggaccctgagcacctgtacaatgctgccatggtggaggccttcaaggagagccctgctgagcgggaggaggatgctggcatcatcgtgcctgagcaccagctgatccagacagagagcccccaggagggcaccgtgacctggaagacctaccacacctacatcaaggccagcggcggctacctgctgagcctcttcaccgtcttcctgttcctgctgatgattggcagcgctgccttcagcaactggtggctgggcctgtggctggacaagggcagcaggatgacctgtggcccccagggcaacagaaccatgtgtgaggtgggcgctgtgctggccgacatcggccagcacgtgtaccagtgggtgtacacagcctccatggtgttcatgctggtgtttggagtgaccaagggctttgtgttcaccaagaccaccctgatggccagcagcagcctgcatgacacagtgtttgacaagatcctgaagagccccatgtccttctttgacaccacccccaccggccgcctgatgaaccgcttcagcaaggacatggatgagctggatgtgcggctgcccttccacgccgagaacttcctgcagcagttcttcatggtggtgttcatcctggtgatcctggccgctgtgtttcctgctgtgctgctggtggtggccagcctggccgtgggcttcttcatcctgctgcgcatcttccaccggggcgtgcaggagctgaagaaggtggagaatgtgagccgcagcccctggttcacccacatcaccagctccatgcagggcctgggcatcatccacgcctacggcaagaaggagagctgcatcacctag

SEQ ID NO: 144610 - DNA, 321 bp, Artificial Sequence
  Description of Artificial Sequence: Synthetic coding sequence
atggtgggggagggcccctacctgatcagtgacctggaccagagaggaagaagaagaagctttgctgagagatatgaccccagcctgaagaccatgatccctgtgcggccctgtgcccggctggcccccaaccctgtggatgatgctggcctgctgagctttgccaccttctcctggctgacccctgtgatggtgaagggctaccggcagaggctgactgtggacaccctgccccccctgagcacctatgacagcagtgacaccaatgccaagcgcttccgggtgctgtgggatgaggaggtggcccgggtgggcccctag

SEQ ID NO: 144611 - DNA, 858 bp, Artificial Sequence
  Description of Artificial Sequence: Synthetic coding sequence
atggtgggggagggcccctacctgatcagtgacctggaccagagaggaagaagaagaagctttgctgagagatatgaccccagcctgaagaccatgatccctgtgcggccctgtgcccggctggcccccaaccctgtggatgatgctggcctgctgagctttgccaccttctcctggctgacccctgtgatggtgaagggctaccggcagaggctgactgtggacaccctgccccccctgagcacctatgacagcagtgacaccaatgccaagcgcttccgggtgctgtgggatgaggaggtggcccgggtgggccctgagaaggccagcctgagccacgtggtgtggaagttccagaggaccagggtgctgatggacatcgtggccaacatcctgtgcatcatcatggccgccatcggccccaccgtgctgatccaccagatcctgcagcagacagagaggaccagcggcaaggtgtgggtgggcatcggcctgtgcatcgccctgtttgccacagagttcaccaaggtgttcttctgggccctggcctgggccatcaactacagaacagccatccggctgaaggtggccctgagcaccctggtgtttgagaacctggtgtccttcaagaccctgacccacatctctgtgggggaggtgctgaacatcctgagcagtgacagctacagcctgtttgaggccgccctcttctgccccctgcctgccaccatccccatcctgatggtgttctgtgccgcctatgccttcttcatcctgggccccacagccctgattggcatctctgtgtgcctgtggcccagcagcatccagctgtctgagggccagcagttctggtag

SEQ ID NO: 144612 - DNA, 882 bp, Artificial Sequence
  Description of Artificial Sequence: Synthetic coding sequence
atgctggagaagttctgcaacagcaccttctggaacagcagcttcctggacagccctgaggccgacctgcccctgtgctttgagcagacagtgctggtgtggatccccctgggctacctgtggctgctggccccctggcagctgctgcacgtgtacaagagcaggaccaagaggagcagcaccaccaagctgtacctggccaagcaggtgtttgtgggcttcctgctgatcctggccgccatcgagctggccctggtgctgacagaagattctggccaggccaccgtgcctgctgtgcgctacaccaaccccagcctgtacctgggcacctggctgctggtgctgctgatccagtacagccggcagtggtgtgtgcagaagaacagctggttcctgagcctcttctggatcctgagcatcctgtgtggcaccttccagttccagaccctcatccgcaccctgctgcagggcgacaacagcaacctggcctacagctgcctcttcttcatctcctatggcttccagatcctgatcctgatcttcagcgccttcagcgagaacaatgaaagcagcaacaaccccagcagcatcgccagcttcctgagcagcatcacctacagctggtatgacagcatcatcctgaagggctacaagaggcccctgaccctggaggatgtgtgggaggtggatgaggagatgaagaccaagaccctggtgtccaagtttgagacccacatgaagcgggagctgcagaaggcccggcgggccctgcagaggcggcaggagaagagcagccagcagaacagcggggcccggctgcccggcctgaacaagaaccagagccagagccaggatgccctggtgctggtgaccttcccctag

SEQ ID NO: 144613 - DNA, 4638 bp, Artificial Sequence
  Description of Artificial Sequence: Synthetic coding sequence
atgctggagaagttctgcaacagcaccttctggaacagcagcttcctggacagccctgaggccgacctgcccctgtgctttgagcagacagtgctggtgtggatccccctgggctacctgtggctgctggccccctggcagctgctgcacgtgtacaagagcaggaccaagaggagcagcaccaccaagctgtacctggccaagcaggtgtttgtgggcttcctgctgatcctggccgccatcgagctggccctggtgctgacagaagattctggccaggccaccgtgcctgctgtgcgctacaccaaccccagcctgtacctgggcacctggctgctggtgctgctgatccagtacagccggcagtggtgtgtgcagaagaacagctggttcctgagcctcttctggatcctgagcatcctgtgtggcaccttccagttccagaccctcatccgcaccctgctgcagggcgacaacagcaacctggcctacagctgcctcttcttcatctcctatggcttccagatcctgatcctgatcttcagcgccttcagcgagaacaatgaaagcagcaacaaccccagcagcatcgccagcttcctgagcagcatcacctacagctggtatgacagcatcatcctgaagggctacaagaggcccctgaccctggaggatgtgtgggaggtggatgaggagatgaagaccaagaccctggtgtccaagtttgagacccacatgaagcgggagctgcagaaggcccggcgggccctgcagaggcggcaggagaagagcagccagcagaacagcggggcccggctgcccggcctgaacaagaaccagagccagagccaggatgccctggtgctggaggatgtggagaagaagaagaagaagagcggcaccaagaaggatgtgcccaagtcctggctgatgaaggccctcttcaagaccttctacatggtgctgctgaagagcttcctgctgaagctggtgaatgacatcttcacctttgtgagcccccagctgctgaagctgctgatcagctttgccagtgaccgggacacctacctgtggattggctacctgtgtgccatcctgctcttcaccgctgccctgatccagagcttctgcctgcagtgctacttccagctgtgcttcaagctgggcgtgaaggtgaggacagccatcatggcctctgtgtacaagaaggccctgaccctgagcaacctggccaggaaggagtacacagtgggggagaccgtgaacctgatgtctgtggatgcccagaagctgatggatgtgaccaacttcatgcacatgctgtggagctctgtgctgcagatcgtgctgagcatcttcttcctgtggagggagctgggccccagcgtgctggccggcgtgggcgtgatggtgctggtgatccccatcaatgccatcctgagcaccaagagcaagaccatccaggtgaagaacatgaagaacaaggacaagaggctgaagatcatgaatgagatcctgagcggcatcaagatcctgaagtactttgcctgggagcccagcttccgggaccaggtgcagaacctgaggaagaaggagctgaagaacctgctggccttcagccagctgcagtgtgtggtgatctttgtgttccagctgacccctgtgctggtgtctgtggtgaccttctctgtgtatgtgctggtggacagcaacaacatcctggatgcccagaaggccttcaccagcatcaccctcttcaacatcctgcgcttccccctgtccatgctgcccatgatgatcagctccatgctgcaggcctctgtgtccacagagcggctggagaagtacctgggcggagatgacctggacaccagcgccatcagacatgactgcaactttgacaaggccatgcagttcagcgaggccagcttcacctgggagcatgacagcgaggccaccgtgagagatgtgaacctggacatcatggccggccagctggtggccgtcatcggccctgtgggcagcggcaagagcagcctcatcagcgccatgctgggggagatggagaatgtgcacggccacatcaccatcaagggcaccacagcctacgtgccccagcagagctggatccagaatggcaccatcaaggacaacatcctgtttggaacagagttcaatgagaagcgctaccagcaggtgctggaggcctgtgccctgctgcctgacctggagatgctgcctggaggagacctggccgagatcggggagaagggcatcaacctgagcggcggccagaagcagaggatcagcctggcccgggccacctaccagaacctggacatctacctgctggatgaccccctgtctgctgtggatgcccacgtgggcaagcacatcttcaacaaggtgctgggccccaacggcctgctgaagggcaagacccggctgctggtgacccacagcatgcacttcctgccccaggtggatgaaattgtggtgctgggcaatggcaccatcgtggagaagggcagctacagcgccctgctggccaagaagggggagtttgccaagaacctgaagaccttcctgcggcacacaggccctgaggaggaggccaccgtgcatgatggcagcgaggaggaggatgatgattatggcctcatcagctctgtggaggagatcccagaagatgctgccagcatcaccatgaggcgggagaacagcttccggaggaccctgagccgcagcagccgcagcaatggccgccacctgaagagcctgaggaacagcctgaagaccagaaatgtgaacagcctgaaggaggatgaggagctggtgaagggccagaagctgatcaagaaggagttcattgaaacaggcaaggtgaagttcagcatctacctggagtacctgcaggccatcggcctcttcagcatcttcttcatcatcctggcctttgtgatgaacagcgtggccttcatcggcagcaacctgtggctgagcgcctggaccagtgacagcaagatcttcaacagcacagactacccagccagccagagggacatgagggtgggcgtgtatggagccctgggcctggcccagggcatctttgtgttcatcgcccacttctggagcgcctttggatttgtgcacgccagcaacatcctgcacaagcagctgctgaacaacatcctgcgggcccccatgaggttctttgacaccacccccaccggccgcatcgtgaacagatttgctggggacatcagcacagtggatgacaccctgccccagagcctgcgctcctggatcacctgcttcctgggcatcatcagcaccctggtgatgatctgcatggccacccctgtgttcaccatcatcgtcatccccctgggcatcatctacgtgtctgtgcagatgttttatgtgtccaccagccggcagctgcggcggctggacagcgtgaccaggagccccatctacagccacttcagcgagaccgtgtctggcctgcctgtgatccgggcctttgagcaccagcagcgcttcctgaagcacaatgaggtgagaattgacaccaaccagaagtgtgtgttctcctggatcaccagcaaccgctggctggccatccggctggagctggtgggcaacctgaccgtcttcttcagcgccctgatgatggtgatctacagagacaccctgagcggggacacagtgggctttgtgctgagcaatgccctgaacatcacccagaccctgaactggctggtgaggatgaccagcgagattgagaccaacatcgtggccgtggagcgcatcacagagtacaccaaggtggagaatgaggccccctgggtgacagacaagaggcctcctccagactggcccagcaagggcaagatccagttcaacaactaccaggtgcgctacagacctgagctggacctggtgctgcggggcatcacctgtgacatcggctccatggagaagattggagtggtgggccgcactggagctgggaagagcagcctgaccaactgcctcttccgcatcctggaggccgccggcggccagatcatcattgatggagtggacatcgccagcatcggcctgcatgacctgcgggagaagctgaccatcatcccccaggaccccatcctcttcagcggcagcctgaggatgaacctggaccccttcaacaactacagtgatgaggagatctggaaggccctggagctggcccacctgaagagctttgtggccagcctgcagctgggcctgagccatgaggtgacagaagctgggggcaacctgagcatcggccagaggcagctgctgtgcctgggccgggccctgctgaggaagagcaagatcctggtgctggatgaggccacagctgctgtggacctggagacagacaacctgatccagaccaccatccagaatgaatttgcccactgcaccgtcatcaccatcgcccaccggctgcacaccatcatggacagcgacaaggtgatggtgctggacaatggcaagatcattgaatgtggcagccctgaggagctgctgcagatccctggccccttctacttcatggccaaggaggccggcattgaaaatgtgaacagcaccaagttctag

SEQ ID NO: 144614 - DNA, 4584 bp, Artificial Sequence
  Description of Artificial Sequence: Synthetic coding sequence
atggatgccctgtgtggcagcggggagctgggcagcaagttctgggacagcaacctgtctgtgcacacagagaacccagacctgaccccctgcttccagaacagcctgctggcctgggtgccctgcatctacctgtgggtggccctgccctgctacctgctgtacctgcggcaccactgccggggctacatcatcctgagccacctgagcaagctgaagatggtgctgggcgtgctgctgtggtgtgtgtcctgggccgacctcttctacagcttccacggcctggtgcacggccgggccccagcccctgtgttctttgtgacccccctggtggtgggcgtgaccatgctgctggccaccctgctgatccagtatgagcggctgcagggcgtgcagagcagcggcgtgctgatcatcttctggttcctgtgtgtggtgtgtgccatcgtgcccttccgcagcaagatcctgctggccaaggccgagggggagatcagtgaccccttccgcttcaccaccttctacatccactttgccctggtgctgagcgccctgatcctggcctgcttccgggagaagccacccttcttcagcgccaagaatgtggaccccaacccctacccagagaccagcgctggcttcctgagccgcctcttcttctggtggttcaccaagatggccatctacggctaccgccaccccctggaggagaaggacctgtggagcctgaaggaggaggacaggagccagatggtggtgcagcagctgctggaggcctggaggaagcaggagaagcagacagcccggcacaaggccagcgctgcccctgggaagaatgccagcggagaagatgaggtgctgctgggcgcccggccccggcccaggaagcccagcttcctgaaggccctgctggccaccttcggcagcagcttcctgatcagcgcctgcttcaagctgatccaggacctgctgtccttcatcaacccccagctgctgagcatcctgatccgcttcatcagcaaccccatggcccccagctggtggggcttcctggtggccggcctgatgttcctgtgcagcatgatgcagagcctcatcctgcagcactactaccactacatctttgtgactggagtgaagttcagaacaggcatcatgggcgtcatctacaggaaggccctggtgatcaccaacagcgtgaagagggccagcacagtgggggagatcgtgaacctgatgtctgtggatgcccagcgcttcatggacctggcccccttcctgaacctgctgtggagcgcccccctgcagatcatcctggccatctacttcctgtggcagaacctgggccccagcgtgctggccggcgtggccttcatggtgctgctgatccccctgaatggagctgtggccgtgaagatgagggccttccaggtgaagcagatgaagctgaaggacagccgcatcaagctgatgtctgagatcctgaatggcatcaaggtgctgaagctgtatgcctgggagcccagcttcctgaagcaggtggagggcatccggcagggcgagctgcagctgctgaggacagctgcctacctgcacaccaccaccaccttcacctggatgtgcagccccttcctggtgaccctcatcaccctgtgggtgtatgtgtatgtggaccccaacaacgtgctggatgctgagaaggcctttgtgtctgtgtccctcttcaacatcctgcggctgcccctgaacatgctgccccagctgatcagcaacctgacccaggcctctgtgtccctgaagaggatccagcagttcctgagccaggaggagctggacccccagagcgtggagaggaagaccatcagccctggctacgccatcaccatccacagcggcaccttcacctgggcccaggacctgccccccaccctgcacagcctggacatccaggtgcccaagggggccctggtggccgtggtgggccctgtgggctgcggcaagagcagcctggtgtctgccctgctgggggagatggagaagctggagggcaaggtgcacatgaagggctctgtggcctacgtgccccagcaggcctggatccagaactgcaccctgcaggagaatgtgctgtttgggaaggccctgaaccccaagcgctaccagcagaccctggaggcctgtgccctgctggccgacctggagatgctgcctggaggagaccagacagagatcggggagaagggcatcaacctgagcggcggccagaggcagagggtgtccctggcccgggctgtgtacagtgatgctgacatcttcctgctggatgaccccctgtctgctgtggacagccacgtggccaagcacatctttgaccacgtgattggccctgagggcgtgctggccggcaagaccagggtgctggtgacccacggcatctccttcctgccccagacagacttcatcatcgtgctggctgatggccaggtgtctgagatgggcccctacccagccctgctgcagagaaatggcagctttgccaacttcctgtgcaactatgccccagatgaggaccagggccacctggaggacagctggacagccctggagggcgctgaggacaaggaggccctgctgattgaggacaccctgagcaaccacacagacctgacagacaatgaccctgtgacctacgtggtgcagaagcagttcatgaggcagctgagcgccctgagcagtgatggagagggccagggccggcctgtgcccaggaggcacctgggccccagcgagaaggtgcaggtgacagaggccaaggcagatggagccctgacccaggaggagaaggccgccatcggcaccgtggagctgtctgtgttctgggactatgccaaggctgtgggcctgtgcaccaccctggccatctgcctgctgtatgtgggccagagcgctgctgccatcggggccaacgtgtggctgagcgcctggaccaatgatgccatggctgacagccggcagaacaacaccagcctgcggctgggcgtgtatgctgccctgggcatcctgcagggcttcctggtgatgctggccgccatggccatggctgctgggggcatccaggccgcccgggtgctgcaccaggccctgctgcacaacaagatccgcagcccccagagcttctttgacaccaccccatctggccgcatcctgaactgcttcagcaaggacatctacgtggtggatgaggtgctggcccctgtgatcctgatgctgctgaacagcttcttcaatgccatcagcaccctggtggtgatcatggccagcacccccctcttcaccgtggtgatcctgcccctggccgtgctgtacaccctggtgcagcgcttctacgccgccaccagccggcagctgaagaggctggagagcgtgagccgcagccccatctacagccacttcagcgagaccgtgactggagccagcgtcatccgggcctacaacagaagccgggactttgagatcatcagtgacaccaaggtggatgccaaccagaggagctgctacccctacatcatcagcaaccgctggctgagcattggagtggagtttgtgggcaactgtgtggtgctgtttgctgccctgtttgctgtgattggccgcagcagcctgaaccctggcctggtgggcctgtctgtgtcctacagcctgcaggtgacctttgccctgaactggatgatccgcatgatgtctgacctggagagcaacatcgtggccgtggagcgggtgaaggagtacagcaagacagaaacagaggccccctgggtggtggagggcagcaggcctcctgagggctggcccccaagaggagaggtggagttcaggaactacagcgtgcgctaccggcccggcctggacctggtgctgcgggacctgagcctgcacgtgcacggcggggagaaggtgggcatcgtgggccgcactggagctgggaagagctccatgaccctgtgcctcttccgcatcctggaggccgccaagggggagatcagaattgatggcctgaatgtggccgacatcggcctgcatgacctgcggagccagctgaccatcatcccccaggaccccatcctcttcagcggcaccctgaggatgaacctggaccccttcggcagctacagcgaggaggacatctggtgggccctggagctgagccacctgcacacctttgtgagcagccagcctgctggcctggacttccagtgcagcgagggcggggagaacctgtctgtgggccagaggcagctggtgtgcctggcccgggccctgctgaggaagagccgcatcctggtgctggatgaggccacagctgccatcgacctggagacagacaacctgatccaggccaccatccgcacccagtttgacacctgcaccgtgctgaccatcgcccaccggctgaacaccatcatggactacaccagggtgctggtgctggacaagggcgtggtggccgagtttgacagccctgccaacctgattgctgcccggggcatcttctacggcatggccagagatgctggcctggcctag

SEQ ID NO: 144615 - DNA, 1719 bp, Artificial Sequence
  Description of Artificial Sequence: Synthetic coding sequence
atggatgccctgtgtggcagcggggagctgggcagcaagttctgggacagcaacctgtctgtgcacacagagaacccagacctgaccccctgcttccagaacagcctgctggcctgggtgccctgcatctacctgtgggtggccctgccctgctacctgctgtacctgcggcaccactgccggggctacatcatcctgagccacctgagcaagctgaagatggtgctgggcgtgctgctgtggtgtgtgtcctgggccgacctcttctacagcttccacggcctggtgcacggccgggccccagcccctgtgttctttgtgacccccctggtggtgggcgtgaccatgctgctggccaccctgctgatccagtatgagcggctgcagggcgtgcagagcagcggcgtgctgatcatcttctggttcctgtgtgtggtgtgtgccatcgtgcccttccgcagcaagatcctgctggccaaggccgagggggagatcagtgaccccttccgcttcaccaccttctacatccactttgccctggtgctgagcgccctgatcctggcctgcttccgggagaagccacccttcttcagcgccaagaatgtggaccccaacccctacccagagaccagcgctggcttcctgagccgcctcttcttctggtggttcaccaagatggccatctacggctaccgccaccccctggaggagaaggacctgtggagcctgaaggaggaggacaggagccagatggtggtgcagcagctgctggaggcctggaggaagcaggagaagcagacagcccggcacaaggccagcgctgcccctgggaagaatgccagcggagaagatgaggtgctgctgggcgcccggccccggcccaggaagcccagcttcctgaaggccctgctggccaccttcggcagcagcttcctgatcagcgcctgcttcaagctgatccaggacctgctgtccttcatcaacccccagctgctgagcatcctgatccgcttcatcagcaaccccatggcccccagctggtggggcttcctggtggccggcctgatgttcctgtgcagcatgatgcagagcctcatcctgcagcactactaccactacatctttgtgactggagtgaagttcagaacaggcatcatgggcgtcatctacaggaaggccctggtgatcaccaacagcgtgaagagggccagcacagtgggggagatcgtgaacctgatgtctgtggatgcccagcgcttcatggacctggcccccttcctgaacctgctgtggagcgcccccctgcagatcatcctggccatctacttcctgtggcagaacctgggccccagcgtgctggccggcgtggccttcatggtgctgctgatccccctgaatggagctgtggccgtgaagatgagggccttccaggtgaagcagatgaagctgaaggacagccgcatcaagctgatgtctgagatcctgaatggcatcaaggtgctgaagctgtatgcctgggagcccagcttcctgaagcaggtggagggcatccggcagggcgagctgcagctgctgaggacagctgcctacctgcacaccaccaccaccttcacctggatgtgcagccccttcctggtgcggctgggcaccggcctgggcccctgcctgcagggcagcggctgccccggcatggcccgggcccactggaccctgccctag

SEQ ID NO: 144616 - DNA, 3717 bp, Artificial Sequence
  Description of Artificial Sequence: Synthetic coding sequence
atggatgccctgtgtggcagcggggagctgggcagcaagttctgggacagcaacctgtctgtgcacacagagaacccagacctgaccccctgcttccagaacagcctgctggcctgggtgccctgcatctacctgtgggtggccctgccctgctacctgctgtacctgcggcaccactgccggggctacatcatcctgagccacctgagcaagctgaagatggtgctgggcgtgctgctgtggtgtgtgtcctgggccgacctcttctacagcttccacggcctggtgcacggccgggccccagcccctgtgttctttgtgacccccctggtggtgggcgtgaccatgctgctggccaccctgctgatccagtatgagcggctgcagggcgtgcagagcagcggcgtgctgatcatcttctggttcctgtgtgtggtgtgtgccatcgtgcccttccgcagcaagatcctgctggccaaggccgagggggagatcagtgaccccttccgcttcaccaccttctacatccactttgccctggtgctgagcgccctgatcctggcctgcttccgggagaagccacccttcttcagcgccaagaatgtggaccccaacccctacccagagaccagcgctggcttcctgagccgcctcttcttctggtggttcaccaagatggccatctacggctaccgccaccccctggaggagaaggacctgtggagcctgaaggaggaggacaggagccagatggtggtgcagcagctgctggaggcctggaggaagcaggagaagcagacagcccggcacaaggccagcgctgcccctgggaagaatgccagcggagaagatgaggtgctgctgggcgcccggccccggcccaggaagcccagcttcctgaaggccctgctggccaccttcggcagcagcttcctgatcagcgcctgcttcaagctgatccaggacctgctgtccttcatcaacccccagctgctgagcatcctgatccgcttcatcagcaaccccatggcccccagctggtggggcttcctggtggccggcctgatgttcctgtgcagcatgatgcagagcctcatcctgcagcactactaccactacatctttgtgactggagtgaagttcagaacaggcatcatgggcgtcatctacaggaaggccctggtgatcaccaacagcgtgaagagggccagcacagtgggggagatcgtgaacctgatgtctgtggatgcccagcgcttcatggacctggcccccttcctgaacctgctgtggagcgcccccctgcagatcatcctggccatctacttcctgtggcagaacctgggccccagcgtgctggccggcgtggccttcatggtgctgctgatccccctgaatggagctgtggccgtgaagatgagggccttccaggtgaagcagatgaagctgaaggacagccgcatcaagctgatgtctgagatcctgaatggcatcaaggtgctgaagctgtatgcctgggagcccagcttcctgaagcaggtggagggcatccggcagggcgagctgcagctgctgaggacagctgcctacctgcacaccaccaccaccttcacctggatgtgcagccccttcctggtgaccctcatcaccctgtgggtgtatgtgtatgtggaccccaacaacgtgctggatgctgagaaggcctttgtgtctgtgtccctcttcaacatcctgcggctgcccctgaacatgctgccccagctgatcagcaacctgacccaggcctctgtgtccctgaagaggatccagcagttcctgagccaggaggagctggacccccagagcgtggagaggaagaccatcagccctggctacgccatcaccatccacagcggcaccttcacctgggcccaggacctgccccccaccctgcacagcctggacatccaggtgcccaagggggccctggtggccgtggtgggccctgtgggctgcggcaagagcagcctggtgtctgccctgctgggggagatggagaagctggagggcaaggtgcacatgaagggctctgtggcctacgtgccccagcaggcctggatccagaactgcaccctgcaggagaatgtgctgtttgggaaggccctgaaccccaagcgctaccagcagaccctggaggcctgtgccctgctggccgacctggagatgctgcctggaggagaccagacagagatcggggagaagggcatcaacctgagcggcggccagaggcagagggtgtccctggcccgggctgtgtacagtgatgctgacatcttcctgctggatgaccccctgtctgctgtggacagccacgtggccaagcacatctttgaccacgtgattggccctgagggcgtgctggccggcaagaccagggtgctggtgacccacggcatctccttcctgccccagacagacttcatcatcgtgctggctgatggccaggtgtctgagatgggcccctacccagccctgctgcagagaaatggcagctttgccaacttcctgtgcaactatgccccagatgaggaccagggccacctggaggacagctggacagccctggagggcgctgaggacaaggaggccctgctgattgaggacaccctgagcaaccacacagacctgacagacaatgaccctgtgacctacgtggtgcagaagcagttcatgaggcagctgagcgccctgagcagtgatggagagggccagggccggcctgtgcccaggaggcacctgggccccagcgagaaggtgcaggtgacagaggccaaggcagatggagccctgacccaggaggagaaggccgccatcggcaccgtggagctgtctgtgttctgggactatgccaaggctgtgggcctgtgcaccaccctggccatctgcctgctgtatgtgggccagagcgctgctgccatcggggccaacgtgtggctgagcgcctggaccaatgatgccatggctgacagccggcagaacaacaccagcctgcggctgggcgtgtatgctgccctgggcatcctgcagggcttcctggtgatgctggccgccatggccatggctgctgggggcatccaggccgcccgggtgctgcaccaggccctgctgcacaacaagatccgcagcccccagagcttctttgacaccaccccatctggccgcatcctgaactgcttcagcaaggacatctacgtggtggatgaggtgctggcccctgtgatcctgatgctgctgaacagcttcttcaatgccatcagcaccctggtggtgatcatggccagcacccccctcttcaccgtggtgatcctgcccctggccgtgctgtacaccctggtgcagcgcttctacgccgccaccagccggcagctgaagaggctggagagcgtgagccgcagccccatctacagccacttcagcgagaccgtgactggagccagcgtcatccgggcctacaacagaagccgggactttgagatcatcagtgacaccaaggtggatgccaaccagaggagctgctacccctacatcatcagcaacagaagtgaggccgccagcctggccccctgcagcagcaggaacagccagcaggccctgtggtgcagcggcagcctgagcctgctgagccccaagcagaagacaggccctgccctgcccctgccccacttcctgctgatctag

SEQ ID NO: 144617 - DNA, 3978 bp, Artificial Sequence
  Description of Artificial Sequence: Synthetic coding sequence
atgctgcctgtgtaccaggaggtgaagcccaaccccctgcaggatgccaacctgtgcagcagggtcttcttctggtggctgaaccccctcttcaagattggccacaagaggcggctggaggaggatgacatgtacagcgtgctgcctgaggacaggagccagcacctgggggaggagctgcagggcttctgggacaaggaggtgctgcgggcagaaaatgatgcccagaagcccagcctgacccgggccatcatcaagtgctactggaagagctacctggtgctgggcatcttcaccctgattgaggagagcgccaaggtgatccagcccatcttcctgggcaagatcatcaactactttgaaaattatgaccccatggacagcgtggccctgaacacagcctatgcctatgccaccgtgctgaccttctgcaccctcatcctggccatcctgcaccacctgtacttctaccacgtgcagtgtgccggcatgaggctgcgggtggccatgtgccacatgatctacaggaaggccctgcggctgagcaacatggccatgggcaagaccaccaccggccagatcgtgaacctgctgagcaatgatgtgaacaagtttgaccaggtgacagtgttcctgcacttcctgtgggccggccccctgcaggccatcgctgtgacagccctgctgtggatggagatcggcatcagctgcctggccggcatggctgtgctgatcatcctgctgcccctgcagagctgcttcggcaagctgttcagcagcctgcggagcaagacagccaccttcacagatgcccgcatccgcaccatgaatgaagtcatcaccggcatccgcatcatcaagatgtatgcctgggagaagagcttcagcaacctgatcaccaacctgaggaagaaggagatcagcaagatcctgcggagcagctgcctgcggggcatgaacctggccagcttcttcagcgccagcaagatcatcgtgtttgtgaccttcaccacctacgtgctgctgggcagcgtcatcacagccagccgggtgtttgtggccgtgaccctgtatggagctgtgcggctgactgtgaccctcttcttccccagcgccatcgagcgggtgtctgaggccatcgtgtccatccgccgcatccagaccttcctgctgctggatgagatcagccagaggaaccggcagctgcccagtgatggcaagaagatggtgcacgtgcaggacttcaccgccttctgggacaaggccagcgagacccccaccctgcagggcctgtccttcaccgtgcggcctggagagctgctggccgtggtgggccctgtgggcgccggcaagagcagcctgctgtctgctgtgctgggggagctggcccccagccacggcctggtgtctgtgcacggcagaattgcctacgtgtcccagcagccctgggtgttcagcggcaccctgcggagcaacatcctgtttgggaagaagtatgagaaggagagatatgagaaggtgatcaaggcctgtgccctgaagaaggacctgcagctgctggaggatggagacctgaccgtcatcggggaccggggcaccaccctgagcggcggccagaaggcccgggtgaacctggcccgggctgtgtaccaggatgctgacatctacctgctggatgaccccctgtctgctgtggatgctgaggtgagccgccacctgtttgagctgtgcatctgccagatcctgcacgagaagatcaccatcctggtgacccaccagctgcagtacctgaaggccgccagccagatcctgatcctgaaggatggcaagatggtgcagaagggcacctacacagagttcctgaagtctggaattgactttggcagcctgctgaagaaggacaatgaggagagcgagcagccccctgtgcccggcacccccaccctgaggaacagaaccttcagcgagagctctgtgtggagccagcagagcagccggcccagcctgaaggatggagccctggagagccaggacacagaaaatgtgcctgtgaccctgtctgaagaaaatagaagtgagggcaaggtgggcttccaggcctacaagaactacttccgggccggggcccactggatcgtgttcatcttcctgatcctgctgaacacagctgcccaggtggcctacgtgctgcaggactggtggctgagctactgggccaacaagcagagcatgctgaatgtgacagtgaatggaggcggcaatgtgacagagaagctggacctgaactggtacctgggcatctacagcggcctgactgtggccaccgtgctgtttggcatcgcccggagcctgctggtgttctacgtgctggtgaacagcagccagaccctgcacaacaagatgtttgagagcatcctgaaggcccctgtgctcttctttgacaggaaccccatcggccgcatcctgaaccgcttcagcaaggacatcggccacctggatgacctgctgcccctgaccttcctggacttcatccagaccctgctgcaggtggtgggcgtggtgtctgtggccgtggccgtcatcccctggatcgccatccccctggtgcccctgggcatcatcttcatcttcctgcggcgctacttcctggagaccagcagagatgtgaagaggctggagagcaccaccaggagccctgtgttcagccacctgagcagcagcctgcagggcctgtggaccatccgggcctacaaggccgaggagcgctgccaggagctgtttgatgcccaccaggacctgcacagcgaggcctggttcctgttcctgaccaccagccgctggtttgctgtgcggctggatgccatctgtgccatgtttgtgatcatcgtggccttcggcagcctcatcctggccaagaccctggatgctggccaggtgggcctggccctgtcctatgccctgaccctgatgggcatgttccagtggtgtgtgcggcagagcgctgaggtggagaacatgatgatctctgtggagagggtcatcgagtacacagacctggagaaggaggccccctgggagtaccagaagaggcctcctccagcctggccccatgaaggagtcatcatctttgacaacgtgaacttcatgtacagccctgggggccccctggtgctgaagcacctgacagccctgatcaagagccaggagaaggtgggcatcgtgggccgcactggagctgggaagagcagcctcatcagcgccctcttccggctgtctgagcctgagggcaagatctggattgacaagatcctgaccacagagatcggcctgcatgacctgaggaagaagatgagcatcatcccccaggagcctgtgctcttcaccggcaccatgaggaagaacctggaccccttcaatgagcacacagatgaggagctgtggaatgccctgcaggaggtgcagctgaaggagaccatcgaggacctgcccgggaagatggacacagagctggccgagagcggcagcaacttctctgtgggccagaggcagctggtgtgcctggcccgggccatcctgaggaagaaccagatcctgatcattgatgaggccacagccaacgtggaccccaggacagatgagctgatccagaagaagatccgggagaagtttgcccactgcaccgtgctgaccatcgcccaccggctgaacaccatcatcgacagcgacaagatcatggtgctggacagcggccgcctgaaggagtatgatgagccctacgtgctgctgcagaacaaggagagcctcttctacaagatggtgcagcagctgggcaaggccgaggccgccgccctgacagaaacagccaagcaggtgtacttcaagaggaactacccccacatcggccacacagaccacatggtgaccaacaccagcaatggccagcccagcaccctgaccatctttgaaacagccctgtag

SEQ ID NO: 144618 - DNA, 3837 bp, Artificial Sequence
  Description of Artificial Sequence: Synthetic coding sequence
atgctgcctgtgtaccaggaggtgaagcccaaccccctgcaggatgccaacctgtgcagcagggtcttcttctggtggctgaaccccctcttcaagattggccacaagaggcggctggaggaggatgacatgtacagcgtgctgcctgaggacaggagccagcacctgggggaggagctgcagggcttctgggacaaggaggtgctgcgggcagaaaatgatgcccagaagcccagcctgacccgggccatcatcaagtgctactggaagagctacctggtgctgggcatcttcaccctgattgaggagagcgccaaggtgatccagcccatcttcctgggcaagatcatcaactactttgaaaattatgaccccatggacagcgtggccctgaacacagcctatgcctatgccaccgtgctgaccttctgcaccctcatcctggccatcctgcaccacctgtacttctaccacgtgcagtgtgccggcatgaggctgcgggtggccatgtgccacatgatctacaggaaggccctgcggctgagcaacatggccatgggcaagaccaccaccggccagatcgtgaacctgctgagcaatgatgtgaacaagtttgaccaggtgacagtgttcctgcacttcctgtgggccggccccctgcaggccatcgctgtgacagccctgctgtggatggagatcggcatcagctgcctggccggcatggctgtgctgatcatcctgctgcccctgcagagctgcttcggcaagctgttcagcagcctgcggagcaagacagccaccttcacagatgcccgcatccgcaccatgaatgaagtcatcaccggcatccgcatcatcaagatgtatgcctgggagaagagcttcagcaacctgatcaccaacctgaggaagaaggagatcagcaagatcctgcggagcagctgcctgcggggcatgaacctggccagcttcttcagcgccagcaagatcatcgtgtttgtgaccttcaccacctacgtgctgctgggcagcgtcatcacagccagccgggtgtttgtggccgtgaccctgtatggagctgtgcggctgactgtgaccctcttcttccccagcgccatcgagcgggtgtctgaggccatcgtgtccatccgccgcatccagaccttcctgctgctggatgagatcagccagaggaaccggcagctgcccagtgatggcaagaagatggtgcacgtgcaggacttcaccgccttctgggacaaggccagcgagacccccaccctgcagggcctgtccttcaccgtgcggcctggagagctgctggccgtggtgggccctgtgggcgccggcaagagcagcctgctgtctgctgtgctgggggagctggcccccagccacggcctggtgtctgtgcacggcagaattgcctacgtgtcccagcagccctgggtgttcagcggcaccctgcggagcaacatcctgtttgggaagaagtatgagaaggagagatatgagaaggtgatcaaggcctgtgccctgaagaaggacctgcagctgctggaggatggagacctgaccgtcatcggggaccggggcaccaccctgagcggcggccagaaggcccgggtgaacctggcccgggctgtgtaccaggatgctgacatctacctgctggatgaccccctgtctgctgtggatgctgaggtgagccgccacctgtttgagctgtgcatctgccagatcctgcacgagaagatcaccatcctggtgacccaccagctgcagtacctgaaggccgccagccagatcctgatcctgaaggatggcaagatggtgcagaagggcacctacacagagttcctgaagtctggaattgactttggcagcctgctgaagaaggacaatgaggagagcgagcagccccctgtgcccggcacccccaccctgaggaacagaaccttcagcgagagctctgtgtggagccagcagagcagccggcccagcctgaaggatggagccctggagagccaggatgtggcctacgtgctgcaggactggtggctgagctactgggccaacaagcagagcatgctgaatgtgacagtgaatggaggcggcaatgtgacagagaagctggacctgaactggtacctgggcatctacagcggcctgactgtggccaccgtgctgtttggaattgcccggagcctgctggtgttctacgtgctggtgaacagcagccagaccctgcacaacaagatgtttgagagcatcctgaaggcccctgtgctcttctttgacaggaaccccatcggccgcatcctgaaccgcttcagcaaggacatcggccacctggatgacctgctgcccctgaccttcctggacttcatccagaccctgctgcaggtggtgggcgtggtgtctgtggccgtggccgtcatcccctggatcgccatccccctggtgcccctgggcatcatcttcatcttcctgcggcgctacttcctggagaccagcagagatgtgaagaggctggagagcaccaccaggagccctgtgttcagccacctgagcagcagcctgcagggcctgtggaccatccgggcctacaaggccgaggagcgctgccaggagctgtttgatgcccaccaggacctgcacagcgaggcctggttcctgttcctgaccaccagccgctggtttgctgtgcggctggatgccatctgtgccatgtttgtgatcatcgtggccttcggcagcctcatcctggccaagaccctggatgctggccaggtgggcctggccctgtcctatgccctgaccctgatgggcatgttccagtggtgtgtgcggcagagcgctgaggtggagaacatgatgatctctgtggagcgggtgattgagtacacagacctggagaaggaggccccctgggagtaccagaagaggcctcctccagcctggccccatgagggcgtcatcatctttgacaacgtgaacttcatgtacagccctgggggccccctggtgctgaagcacctgacagccctgatcaagagccaggagaaggtgggcatcgtgggccgcactggagctgggaagagcagcctcatcagcgccctcttccggctgtctgagcctgagggcaagatctggattgacaagatcctgaccacagaaattggcctgcatgacctgaggaagaagatgagcatcatcccccaggagcctgtgctcttcaccggcaccatgaggaagaacctggaccccttcaatgagcacacagatgaggagctgtggaatgccctgcaggaggtgcagctgaaggagaccatcgaggacctgcccgggaagatggacacagagctggccgagagcggcagcaacttctctgtgggccagaggcagctggtgtgcctggcccgggccatcctgaggaagaaccagatcctgatcattgatgaggccacagccaacgtggaccccaggacagatgagctgatccagaagaagatccgggagaagtttgcccactgcaccgtgctgaccatcgcccaccggctgaacaccatcatcgacagcgacaagatcatggtgctggacagcggccgcctgaaggagtatgatgagccctacgtgctgctgcagaacaaggagagcctcttctacaagatggtgcagcagctgggcaaggccgaggccgccgccctgacagaaacagccaagcaggtgtacttcaagaggaactacccccacatcggccacacagaccacatggtgaccaacaccagcaatggccagcccagcaccctgaccatctttgaaacagccctgtag

SEQ ID NO: 144619 - DNA, 2580 bp, Artificial Sequence
  Description of Artificial Sequence: Synthetic coding sequence
atgctgcctgtgtaccaggaggtgaagcccaaccccctgcaggatgccaacctgtgcagcagggtcttcttctggtggctgaaccccctcttcaagattggccacaagaggcggctggaggaggatgacatgtacagcgtgctgcctgaggacaggagccagcacctgggggaggagctgcagggcttctgggacaaggaggtgctgcgggcagaaaatgatgcccagaagcccagcctgacccgggccatcatcaagtgctactggaagagctacctggtgctgggcatcttcaccctgattgaggagagcgccaaggtgatccagcccatcttcctgggcaagatcatcaactactttgaaaattatgaccccatggacagcgtggccctgaacacagcctatgcctatgccaccgtgctgaccttctgcaccctcatcctggccatcctgcaccacctgtacttctaccacgtgcagtgtgccggcatgaggctgcgggtggccatgtgccacatgatctacaggaaggccctgcggctgagcaacatggccatgggcaagaccaccaccggccagatcgtgaacctgctgagcaatgatgtgaacaagtttgaccaggtgacagtgttcctgcacttcctgtgggccggccccctgcaggccatcgctgtgacagccctgctgtggatggagatcggcatcagctgcctggccggcatggctgtgctgatcatcctgctgcccctgcagagctgcttcggcaagctgttcagcagcctgcggagcaagacagccaccttcacagatgcccgcatccgcaccatgaatgaagtcatcaccggcatccgcatcatcaagatgtatgcctgggagaagagcttcagcaacctgatcaccaacctgaggaagaaggagatcagcaagatcctgcggagcagctgcctgcggggcatgaacctggccagcttcttcagcgccagcaagatcatcgtgtttgtgaccttcaccacctacgtgctgctgggcagcgtcatcacagccagccgggtgtttgtggccgtgaccctgtatggagctgtgcggctgactgtgaccctcttcttccccagcgccatcgagcgggtgtctgaggccatcgtgtccatccgccgcatccagaccttcctgctgctggatgagatcagccagaggaaccggcagctgcccagtgatggcaagaagatggtgcacgtgcaggacttcaccgccttctgggacaaggccagcgagacccccaccctgcagggcctgtccttcaccgtgcggcctggagagctgctggccgtggtgggccctgtgggcgccggcaagagcagcctgctgtctgctgtgctgggggagctggcccccagccacggcctggtgtctgtgcacggcagaattgcctacgtgtcccagcagccctgggtgttcagcggcaccctgcggagcaacatcctgtttgggaagaagtatgagaaggagagatatgagaaggtgatcaaggcctgtgccctgaagaaggacctgcagctgctggaggatggagacctgaccgtcatcggggaccggggcaccaccctgagcggcggccagaaggcccgggtgaacctggcccgggctgtgtaccaggatgctgacatctacctgctggatgaccccctgtctgctgtggatgctgaggtgagccgccacctgtttgagctgtgcatctgccagatcctgcacgagaagatcaccatcctggtgacccaccagctgcagtacctgaaggccgccagccagatcctgatcctgaaggatggcaagatggtgcagaagggcacctacacagagttcctgaagtctggaattgactttggcagcctgctgaagaaggacaatgaggagagcgagcagccccctgtgcccggcacccccaccctgaggaacagaaccttcagcgagagctctgtgtggagccagcagagcagccggcccagcctgaaggatggagccctggagagccaggacacagaaaatgtgcctgtgaccctgtctgaagaaaatagaagtgagggcaaggtgggcttccaggcctacaagaactacttccgggccggggcccactggatcgtgttcatcttcctgatcctgctgaacacagctgcccaggtggcctacgtgctgcaggactggtggctgagctactgggccaacaagcagagcatgctgaatgtgacagtgaatggaggcggcaatgtgacagagaagctggacctgaactggtacctgggcatctacagcggcctgactgtggccaccgtgctgtttggcatcgcccggagcctgctggtgttctacgtgctggtgaacagcagccagaccctgcacaacaagatgtttgagagcatcctgaaggcccctgtgctcttctttgacaggaaccccatcggccgcatcctgaaccgcttcagcaaggacatcggccacctggatgacctgctgcccctgaccttcctggacttcatccagcgctgggacctggccgtgctgtcctggctggtgagcaacagctag

SEQ ID NO: 144620 - DNA, 2355 bp, Artificial Sequence
  Description of Artificial Sequence: Synthetic coding sequence
atgctgcctgtgtaccaggaggtgaagcccaaccccctgcaggatgccaacctgtgcagcagggtcttcttctggtggctgaaccccctcttcaagattggccacaagaggcggctggaggaggatgacatgtacagcgtgctgcctgaggacaggagccagcacctgggggaggagctgcagggcttctgggacaaggaggtgctgcgggcagaaaatgatgcccagaagcccagcctgacccgggccatcatcaagtgctactggaagagctacctggtgctgggcatcttcaccctgattgaggccctgcggctgagcaacatggccatgggcaagaccaccaccggccagatcgtgaacctgctgagcaatgatgtgaacaagtttgaccaggtgaccgtcttcctgcacttcctgtgggccggccccctgcaggccatcgctgtgacagccctgctgtggatggagatcggcatcagctgcctggccggcatggctgtgctgatcatcctgctgcccctgcagagctgcttcggcaagctgttcagcagcctgcggagcaagacagccaccttcacagatgcccgcatccgcaccatgaatgaggtgatcaccggcatccgcatcatcaagatgtatgcctgggagaagagcttcagcaacctgatcaccaacctgaggaagaaggagatcagcaagatcctgcggagcagctgcctgcggggcatgaacctggccagcttcttcagcgccagcaagatcatcgtgtttgtgaccttcaccacctacgtgctgctgggcagcgtcatcacagccagccgggtgtttgtggccgtgaccctgtatggagctgtgcggctgactgtgaccctcttcttccccagcgccatcgagcgggtgtctgaggccatcgtgtccatccgccgcatccagaccttcctgctgctggatgagatcagccagaggaaccggcagctgcccagtgatggcaagaagatggtgcacgtgcaggacttcaccgccttctgggacaaggccagcgagacccccaccctgcagggcctgtccttcaccgtgcggcctggagagctgctggccgtggtgggccctgtgggcgctgggaagagcagcctgctgtctgctgtgctgggggagctggcccccagccacggcctggtgtctgtgcacggccgcatcgcctacgtgtcccagcagccctgggtgttttctggcaccctgcggagcaacatcctgtttgggaagaagtatgagaaggagagatatgagaaggtgatcaaggcctgtgccctgaagaaggacctgcagctgctggaggatggagacctgactgtgattggagaccggggcaccaccctgagcggcggccagaaggcccgggtgaacctggcccgggctgtgtaccaggatgctgacatctacctgctggatgaccccctgtctgctgtggatgctgaggtgagccgccacctgtttgagctgtgcatctgccagatcctgcacgagaagatcaccatcctggtgacccaccagctgcagtacctgaaggccgccagccagatcctgatcctgaaggatggcaagatggtgcagaagggcacctacacagagttcctgaagagcggcatcgactttggcagcctgctgaagaaggacaatgaggagagcgagcagccccctgtgcccggcacccccaccctgaggaacagaaccttcagcgagagctctgtgtggagccagcagagcagccggcccagcctgaaggatggagccctggagagccaggacacagaaaatgtgcctgtgaccctgtctgaggagaacagaagtgagggcaaggtgggcttccaggcctacaagaactacttccgggccggggcccactggatcgtgttcatcttcctgatcctgctgaacacagctgcccaggtggcctacgtgctgcaggactggtggctgagctactgggccaacaagcagagcatgctgaatgtgacagtgaatggaggcggcaatgtgacagagaagctggacctgaactggtacctgggcatctacagcggcctgactgtggccaccgtgctgtttggaattgcccggagcctgctggtgttctacgtgctggtgaacagcagccagaccctgcacaacaagatgtttgagagcatcctgaaggcccctgtgctcttctttgacaggaaccccatcggccgcatcctgaaccgcttcagcaaggacatcggccacctggatgacctgctgcccctgaccttcctggacttcatccagcgctgggacctggccgtgctgtcctggctggtgagcaacagctag

SEQ ID NO: 144621 - DNA, 75 bp, Artificial Sequence
  Description of Artificial Sequence: Synthetic coding sequence
atgctgcctgtgtaccaggaggtgaagcccaaccccctgcaggatgccaacctgtgcagcagggtcttcttctag

SEQ ID NO: 144622 - DNA, 4185 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccctgccttcatggtgaagcacctgctggagtacacccaggccacagagagcaacctgcagtacagcctgctgctggtgctgggcctgctgctgacagagatcgtgcgctcctggagcctggccctgacctgggccctgaactacagaactggagtgcggctgcggggggccatcctgaccatggccttcaagaagatcctgaagctgaagaacatcaaggagaagagcctgggggagctgatcaacatctgcagcaatgatggccagaggatgtttgaggccgctgctgtgggcagcctgctggccggcggccctgtggtggccatcctgggcatgatctacaacgtcatcatcctgggccccaccggcttcctgggcagcgctgtgttcatcctcttctacccagccatgatgtttgccagccggctgacagcctacttccggaggaaatgtgtggccgccacagatgagcgggtgcagaagatgaatgaggtgctgacctacatcaagttcatcaagatgtatgcctgggtgaaggccttcagccagagcgtgcagaagatccgggaggaggagcggcgcatcctggagaaggccggctacttccagagcatcaccgtgggcgtggcccccatcgtggtggtgattgcctctgtggtgaccttctctgtgcacatgaccctgggctttgacctgacagctgcccaggccttcaccgtggtgaccgtcttcaacagcatgacctttgccctgaaggtgacccccttctctgtgaagagcctgtctgaggcctctgtggccgtggaccgcttcaagagcctcttcctgatggaggaggtgcacatgatcaagaacaagccagccagcccccacatcaagattgagatgaagaatgccaccctggcctgggacagcagccacagcagcatccagaacagccccaagctgacccccaagatgaagaaggacaagagggccagccggggcaagaaggagaaggtgcggcagctgcagaggacagagcaccaggccgtgctggccgagcagaagggccacctgctgctggacagtgatgagcggcccagccctgaggaggaggagggcaagcacatccacctgggccacctgcggctgcagaggaccctgcacagcattgacctggagatccaggagggcaagctggtgggcatctgtggctctgtgggcagcggcaagaccagcctcatcagcgccatcctgggccagatgaccctgctggagggcagcatcgccatcagcggcacctttgcctacgtggcccagcaggcctggatcctgaatgccaccctgcgggacaacatcctgtttgggaaggagtatgatgaggagcgctacaacagcgtgctgaacagctgctgcctgcggccagacctggccatcctgcccagcagtgacctgacagagatcggggagcggggggccaacctgagcggcggccagaggcagaggatcagcctggcccgggccctgtacagcgacaggagcatctacatcctggatgaccccctgagcgccctggatgcccacgtgggcaaccacatcttcaacagcgccatcaggaagcacctgaagagcaagacagtgctgtttgtgacccaccagctgcagtacctggtggactgtgatgaagtcatcttcatgaaggagggctgcatcacagagcggggcacccatgaggagctgatgaacctgaatggagactatgccaccatcttcaacaacctgctgctgggggagaccccacctgtggagatcaacagcaagaaggagaccagcggcagccagaagaagagccaggacaagggccccaagacaggctctgtgaagaaggagaaggctgtgaagccagaggagggccagctggtgcagctggaggagaagggccagggctctgtgccctggagcgtgtatggagtgtacatccaggccgccggcggccccctggccttcctggtgatcatggccctcttcatgctgaatgtgggcagcacagccttcagcacctggtggctgagctactggatcaagcagggcagcggcaacaccaccgtgaccagaggaaatgagacctctgtgtctgacagcatgaaggacaacccccacatgcagtactatgccagcatctatgccctgtccatggctgtgatgctgatcctgaaggccatccggggcgtggtgtttgtgaagggcaccctgcgggccagcagccggctgcatgatgagctgttccgccgcatcctgcggagccccatgaagttctttgacaccacccccaccggccgcatcctgaaccgcttcagcaaggacatggatgaggtggatgtgcggctgcccttccaggccgagatgttcatccagaatgtcatcctggtgttcttctgtgtgggcatgattgctggggtcttcccctggttcctggtggccgtgggccccctggtgatcctcttctctgtgctgcacatcgtgagccgctaccaggagctgctggatgacaaccaggcccccttcttcctgttcacctgtgccatgcgctggctggccgtgcggctggacctgatcagcatcgccctgatcaccaccaccggcctgatgattgtgctgatgcacggccagatccccccagcctatgccggcctggccatctcctatgctgtgcagctgaccggcctcttccagttcaccgtgcggctggccagcgagacagaggcccgcttcacctctgtggagcgcatcaaccactacatcaagaccctgagcctggaggccccagcccgcatcaagaacaaggcccccagcccagactggccccaggagggggaggtgacctttgaaaatgctgagatgagataccgggagaacctgcccctggtgctgaagaaggtgtccttcaccatcaagcccaaggagaagattggcatcgtgggccgcacaggcagcggcaagagcagcctgggcatggccctcttccggctggtggagctgagcggcggctgcatcaagattgatggagtgcgcatcagtgacatcggcctggccgacctgcggagcaagctgagcatcatcccccaggagcctgtgctcttcagcggcaccgtgcgcagcaacctggaccccttcaaccagtacacagaggaccagatctgggatgccctggagaggacccacatgaaggaatgtattgcccagctgcccctgaagctggagagcgaggtgatggagaatggagacaacttctctgtgggggagcggcagctgctgtgcatcgcccgggccctgctgcggcactgcaagatcctgatcctggatgaggccacagctgccatggacacagaaacagacctgctgatccaggagaccatccgggaggcctttgctgactgcaccatgctgaccatcgcccaccggctgcacacagtgctgggcagtgaccgcatcatggtgctggcccagggccaggtggtggagtttgacaccccatctgtgctgctgagcaatgacagcagccgcttctacgccatgtttgctgctgctgagaacaaggtggccgtgaagggctag

SEQ ID NO: 144623 - DNA, 4314 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccctgccttcatggtgaagcacctgctggagtacacccaggccacagagagcaacctgcagtacagcctgctgctggtgctgggcctgctgctgacagagatcgtgcgctcctggagcctggccctgacctgggccctgaactacagaactggagtgcggctgcggggggccatcctgaccatggccttcaagaagatcctgaagctgaagaacatcaaggagaagagcctgggggagctgatcaacatctgcagcaatgatggccagaggatgtttgaggccgctgctgtgggcagcctgctggccggcggccctgtggtggccatcctgggcatgatctacaacgtcatcatcctgggccccaccggcttcctgggcagcgctgtgttcatcctcttctacccagccatgatgtttgccagccggctgacagcctacttccggaggaaatgtgtggccgccacagatgagcgggtgcagaagatgaatgaggtgctgacctacatcaagttcatcaagatgtatgcctgggtgaaggccttcagccagagcgtgcagaagatccgggaggaggagcggcgcatcctggagaaggccggctacttccagagcatcaccgtgggcgtggcccccatcgtggtggtgattgcctctgtggtgaccttctctgtgcacatgaccctgggctttgacctgacagctgcccaggccttcaccgtggtgaccgtcttcaacagcatgacctttgccctgaaggtgacccccttctctgtgaagagcctgtctgaggcctctgtggccgtggaccgcttcaagagcctcttcctgatggaggaggtgcacatgatcaagaacaagccagccagcccccacatcaagattgagatgaagaatgccaccctggcctgggacagcagccacagcagcatccagaacagccccaagctgacccccaagatgaagaaggacaagagggccagccggggcaagaaggagaaggtgcggcagctgcagaggacagagcaccaggccgtgctggccgagcagaagggccacctgctgctggacagtgatgagcggcccagccctgaggaggaggagggcaagcacatccacctgggccacctgcggctgcagaggaccctgcacagcattgacctggagatccaggagggcaagctggtgggcatctgtggctctgtgggcagcggcaagaccagcctcatcagcgccatcctgggccagatgaccctgctggagggcagcatcgccatcagcggcacctttgcctacgtggcccagcaggcctggatcctgaatgccaccctgcgggacaacatcctgtttgggaaggagtatgatgaggagcgctacaacagcgtgctgaacagctgctgcctgcggccagacctggccatcctgcccagcagtgacctgacagagatcggggagcggggggccaacctgagcggcggccagaggcagaggatcagcctggcccgggccctgtacagcgacaggagcatctacatcctggatgaccccctgagcgccctggatgcccacgtgggcaaccacatcttcaacagcgccatcaggaagcacctgaagagcaagacagtgctgtttgtgacccaccagctgcagtacctggtggactgtgatgaagtcatcttcatgaaggagggctgcatcacagagcggggcacccatgaggagctgatgaacctgaatggagactatgccaccatcttcaacaacctgctgctgggggagaccccacctgtggagatcaacagcaagaaggagaccagcggcagccagaagaagagccaggacaagggccccaagacaggctctgtgaagaaggagaaggctgtgaagccagaggagggccagctggtgcagctggaggagaagggccagggctctgtgccctggagcgtgtatggagtgtacatccaggccgccggcggccccctggccttcctggtgatcatggccctcttcatgctgaatgtgggcagcacagccttcagcacctggtggctgagctactggatcaagcagggcagcggcaacaccaccgtgaccagaggaaatgagacctctgtgtctgacagcatgaaggacaacccccacatgcagtactatgccagcatctatgccctgtccatggctgtgatgctgatcctgaaggccatccggggcgtggtgtttgtgaagggcaccctgcgggccagcagccggctgcatgatgagctgttccgccgcatcctgcggagccccatgaagttctttgacaccacccccaccggccgcatcctgaaccgcttcagcaaggacatggatgaggtggatgtgcggctgcccttccaggccgagatgttcatccagaatgtcatcctggtgttcttctgtgtgggcatgattgctggggtcttcccctggttcctggtggccgtgggccccctggtgatcctcttctctgtgctgcacatcgtgtcccgggtgctgatccgggagctgaagaggctggacaacatcacccagagccccttcctgagccacatcaccagcagcatccagggcctggccaccatccacgcctacaacaagggccaggagttcctgcaccgctaccaggagctgctggatgacaaccaggcccccttcttcctgttcacctgtgccatgcgctggctggccgtgcggctggacctgatcagcatcgccctgatcaccaccaccggcctgatgattgtgctgatgcacggccagatccccccagcctatgccggcctggccatctcctatgctgtgcagctgaccggcctcttccagttcaccgtgcggctggccagcgagacagaggcccgcttcacctctgtggagcgcatcaaccactacatcaagaccctgagcctggaggccccagcccgcatcaagaacaaggcccccagcccagactggccccaggagggggaggtgacctttgaaaatgctgagatgagataccgggagaacctgcccctggtgctgaagaaggtgtccttcaccatcaagcccaaggagaagattggaattgtgggccgcactggaagtggcaagagcagcctgggcatggccctcttccggctggtggagctgagcggcggctgcatcaagattgatggagtgcgcatcagtgacatcggcctggccgacctgcggagcaagctgagcatcatcccccaggagcctgtgctcttctctggaacagtgcgcagcaacctggaccccttcaaccagtacacagaggaccagatctgggatgccctggagaggacccacatgaaggagtgcatcgcccagctgcccctgaagctggagagcgaggtgatggagaatggagacaacttctctgtgggggagcggcagctgctgtgcatcgcccgggccctgctgcggcactgcaagatcctgatcctggatgaggccacagctgccatggacacagaaacagacctgctgatccaggagaccatccgggaggcctttgctgactgcaccatgctgaccatcgcccaccggctgcacacagtgctgggcagtgaccgcatcatggtgctggcccagggccaggtggtggagtttgacacccccagcgtgctgctgagcaatgacagcagccgcttctacgccatgtttgctgctgctgagaacaaggtggccgtgaagggctag

SEQ ID NO: 144624 - DNA, 627 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccccaacttccaggacggctgcatcctgcggtctgagtag

SEQ ID NO: 144625 - DNA, 2511 bp, Artificial Sequence
  Description of Artificial Sequence: Synthetic coding sequence
atgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccctgccttcatggtgaagcacctgctggagtacacccaggccacagagagcaacctgcagtacagcctgctgctggtgctgggcctgctgctgacagagatcgtgcgctcctggagcctggccctgacctgggccctgaactacagaactggagtgcggctgcggggggccatcctgaccatggccttcaagaagatcctgaagctgaagaacatcaaggagaagagcctgggggagctgatcaacatctgcagcaatgatggccagaggatgtttgaggccgctgctgtgggcagcctgctggccggcggccctgtggtggccatcctgggcatgatctacaacgtcatcatcctgggccccaccggcttcctgggcagcgctgtgttcatcctcttctacccagccatgatgtttgccagccggctgacagcctacttccggaggaaatgtgtggccgccacagatgagcgggtgcagaagatgaatgaggtgctgacctacatcaagttcatcaagatgtatgcctgggtgaaggccttcagccagagcgtgcagaagatccgggaggaggagcggcgcatcctggagaaggccggctacttccagagcatcaccgtgggcgtggcccccatcgtggtggtgattgcctctgtggtgaccttctctgtgcacatgaccctgggctttgacctgacagctgcccaggccttcaccgtggtgaccgtcttcaacagcatgacctttgccctgaaggtgacccccttctctgtgaagagcctgtctgaggcctctgtggccgtggaccgcttcaagagcctcttcctgatggaggaggtgcacatgatcaagaacaagccagccagcccccacatcaagattgagatgaagaatgccaccctggcctgggacagcagccacagcagcatccagaacagccccaagctgacccccaagatgaagaaggacaagagggccagccggggcaagaaggagaaggtgcggcagctgcagaggacagagcaccaggccgtgctggccgagcagaagggccacctgctgctggacagtgatgagcggcccagccctgaggaggaggagggcaagcacatccacctgggccacctgcggctgcagaggaccctgcacagcattgacctggagatccaggagggcaagctggtgggcatctgtggctctgtgggcagcggcaagaccagcctcatcagcgccatcctgggccagatgaccctgctggagggcagcatcgccatcagcggcacctttgcctacgtggcccagcaggcctggatcctgaatgccaccctgcgggacaacatcctgtttgggaaggagtatgatgaggagcgctacaacagcgtgctgaacagctgctgcctgcggccagacctggccatcctgcccagcagtgacctgacagagatcggggagcggggggccaacctgagcggcggccagaggcagaggatcagcctggcccgggccctgtacagcgacaggagcatctacatcctggatgaccccctgagcgccctggatgcccacgtgggcaaccacatcttcaacagcgccatcaggaagcacctgaagagcaagacagtgctgtttgtgacccaccagctgcagtacctggtggactgtgatgaagtcatcttcatgaaggagggctgcatcacagagcggggcacccatgaggagctgatgaacctgaatggagactatgccaccatcttcaacaacctgctgctgggggagaccccacctgtggagatcaacagcaagaaggagaccagcggcagccagaagaagagccaggacaagggccccaagacaggctctgtgaagaaggagaaggctgtgaagccagaggagggccagctggtgcagctggaggagaagggccagggctctgtgccctggagcgtgtatggccaccctggctgctggggccccctgggcatccctggctactacggccccttccacgcagaatgtcggcagcaccggctgcagcacctggtggtggagctgctggaccaggccaggaagcgggagcaccactgtgacagccgggagcgggacctgggggagtag

SEQ ID NO: 144626 - DNA, 678 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccccccatcctttggagactgcagcatctctgctgaggtgtgtggcaaccggctgcactgcacagccatcctgctgagctgcttcacctag

SEQ ID NO: 144627 - DNA, 696 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccctgtgagcagcaaccaccccttccggcagagccctggggcccggcccaggcctgccctgaccctgctcttctgctgccggggctgtgcccagctgtgggccaggtag

SEQ ID NO: 144628 - DNA, 444 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgcaggtag

SEQ ID NO: 144629 - DNA, 639 bp, Artificial Sequence
  Description of Artificial Sequence: Synthetic coding sequence
atgaaggacatcgacatcggcaaggagtacatcatccccagccctggctacagatctgtgcgggagaggaccagcaccagcggcacccaccgggaccgggaggacagcaagttccggaggacccggcccctggagtgccaggatgccctggagacagctgcccgggcagagggcctgagcctggatgcctccatgcacagccagctgcgcatcctggatgaggagcaccccaagggcaagtaccaccacggcctgagcgccctgaagcccatccgcaccaccagcaagcaccagcaccctgtggacaatgccggcctcttcagctgcatgaccttctcctggctgagcagcctggcccgggtggcccacaagaagggggagctgtccatggaggatgtgtggagcctgagcaagcatgagagcagtgatgtgaactgccggcggctggagcggctgtggcaggaggagctgaatgaggtgggcccagatgctgccagcctgcggcgggtggtgtggatcttctgcaggaccaggctcatcctgagcatcgtgtgcctgatgatcacccagctggccggcttcagcggccccctggcctggtgctgccaggacctggacctgggcggcgtgtccctgtag

SEQ ID NO: 144630 - DNA, 1530 bp, Artificial Sequence
  Description of Artificial Sequence: Synthetic coding sequence
atgcagagctggagccgggtgtactgcagcctggccaagaggggccacttcaaccgcatcagccacggcctgcagggcctgtctgctgtgcccctgcggacctacgccgaccagcccattgatgctgatgtgacagtgattggcagcggccctgggggctacgtggccgccatcaaggccgcccagctgggcttcaagacagtgtgcatcgagaagaatgagaccctgggcggcacctgcctgaatgtgggctgcatccccagcaaggccctgctgaacaacagccactactaccacatggcccacggcaaggactttgccagccggggcatcgagatgtctgaggtgcggctgaacctggacaagatgatggagcagaagagcacagctgtgaaggccctgactggaggcatcgcccacctgttcaagcagaacaaggtggtgcacgtgaatggctacggcaagatcaccgggaagaaccaggtgacagccaccaaggcagatggcggcacccaggtgattgacaccaagaacatcctgattgccactggaagtgaggtgacccccttccctggcatcaccattgatgaggacaccatcgtgagcagcactggagccctgagcctgaagaaggtgcctgagaagatggtggtgattggagctggggtcatcggcgtggagctgggctctgtgtggcagaggctgggcgcagatgtgacagctgtggagttcctgggccacgtgggcggcgtgggcatcgacatggagatcagcaagaacttccagaggatcctgcagaagcagggcttcaagttcaagctgaacaccaaggtgactggagccaccaagaagagtgatggcaagattgatgtgtccattgaagctgccagcggcggcaaggccgaggtgatcacctgtgatgtgctgctggtgtgcattggaagaagacccttcaccaagaacctgggcctggaggagctgggcatcgagctggacccccggggccgcatccctgtgaacacccgcttccagaccaagatccccaacatctatgccatcggagatgtggtggccggccccatgctggcccacaaggcagaagatgagggcatcatctgtgtggagggcatggccggcggcgctgtgcacatcgactacaactgtgtgcccagcgtcatctacacccaccctgaggtggcctgggtgggcaagtctgaggagcagctgaaggaggagggcatcgagtacaaggtgggcaagttcccctttgctgccaacagccgggccaagaccaatgctgacacagatggcatggtgaagatcctgggccagaagagcacagacagagtgctgggcgcccacatcctgggccctggggccggggagatggtgaatgaagctgccctggccctggagtatggagccagctgtgaggacatcgcccgggtgtgccacgcccaccccaccctgtctgaggccttccgggaggccaacctggccgccagctttgggaagagcatcaacttctag

SEQ ID NO: 144631 - DNA, 4512 bp, Artificial Sequence
  Description of Artificial Sequence: Synthetic coding sequence
atggccgccccagctgagccctgtgccggccagggcgtgtggaaccagacagagcctgagcctgctgccaccagcctgctgagcctgtgcttcctgaggacagctggggtgtgggtgccccccatgtacctgtgggtgctgggccccatctacctgctcttcatccaccaccacggccggggctacctgaggatgagccccctcttcaaggccaagatggtgctgggctttgccctgattgtgctgtgcaccagctctgtggccgtggccctgtggaagatccagcagggcaccccagaggcccctgagttcctgatccaccccaccgtgtggctgaccaccatgagctttgctgtgttcctgatccacacagagaggaagaagggcgtgcagagcagtggagtgctgtttggctactggctgctgtgctttgtgctgcctgccaccaatgctgcccagcaggccagcggggccggcttccagagcgaccctgtgcgccacctgagcacctacctgtgcctgagcctggtggtggcccagtttgtgctgagctgcctggccgaccagccccccttcttccctgaggacccccagcagagcaacccctgcccagagaccggggccgccttccccagcaaggccaccttctggtgggtgtctggcctggtgtggaggggctaccgccggcccctgcggcccaaggacctgtggagcctgggccgggagaacagcagcgaggagctggtgtcccggctggagaaggagtggatgaggaacagatctgctgcccggcggcacaacaaggccatcgccttcaagaggaaaggaggcagcggcatgaaggcccctgagacagagcccttcctgcggcaggagggcagccagtggaggcccctgctgaaggccatctggcaggtgttccacagcaccttcctgctgggcaccctgagcctcatcatcagtgatgtgttccgcttcaccgtgcccaagctgctgagcctcttcctggagttcatcggggaccccaagcccccagcctggaagggctacctgctggccgtgctgatgttcctgagcgcctgcctgcagaccctgtttgagcagcagaacatgtaccgcctgaaggtgctgcagatgaggctgcggagcgccatcaccggcctggtgtacaggaaggtgctggccctgagcagcggcagcaggaaggccagcgctgtgggagatgtggtgaacctggtgtctgtggatgtgcagaggctgacagaatctgtgctgtacctgaatggcctgtggctgcccctggtgtggatcgtggtgtgctttgtgtacctgtggcagctgctgggccccagcgccctgacagccatcgctgtgttcctgagcctgctgcccctgaacttcttcatcagcaagaagaggaaccaccaccaggaggagcagatgaggcagaaggacagccgggcccggctgaccagcagcatcctgaggaacagcaagaccatcaagttccacggctgggagggcgccttcctggacagagtgctgggcatccggggccaggagctgggcgccctgcggaccagcggcctgctcttctctgtgtccctggtgtccttccaggtgtccaccttcctggtggccctggtggtgtttgctgtgcacaccctggtggctgaaaatgccatgaatgctgagaaggcctttgtgaccctgactgtgctgaacatcctgaacaaggcccaggccttcctgcccttcagcatccacagcctggtgcaggcccgggtgtcctttgaccggctggtgaccttcctgtgcctggaggaggtggaccccggggtggtggacagcagcagcagcggcagcgctgctgggaaggactgcatcaccatccacagcgccacctttgcctggagccaggagagccccccctgcctgcaccgcatcaacctgactgtgccccagggctgcctgctggccgtggtgggccctgtgggcgccggcaagagcagcctgctgagcgccctgctgggggagctgagcaaggtggagggctttgtgtccattgaaggagctgtggcctacgtgccccaggaggcctgggtgcagaacacctctgtggtggagaatgtgtgcttcggccaggagctggaccccccctggctggagcgggtgctggaggcctgtgccctgcagccagatgtggacagcttccctgagggcatccacaccagcatcggggagcagggcatgaacctgagcggcggccagaagcagaggctgagcctggcccgggctgtgtacaggaaggctgctgtgtacctgctggatgaccccctggccgccctggatgcccacgtgggccagcacgtgttcaaccaggtgattggccctgggggcctgctgcagggcaccacccgcatcctggtgacccacgccctgcacatcctgccccaggccgactggatcatcgtgctggccaacggggccatcgccgagatgggcagctaccaggagctgctgcagaggaagggggccctgatgtgcctgctggaccaggcccggcagcccggggacagaggagagggggagacagagcccggcaccagcaccaaggacccccggggcaccagcgctggaagaagacctgagctgcggcgggagaggagcatcaagtctgtgcctgagaaggacaggaccaccagcgaggcccagacagaggtgcccctggatgatcctgaccgggccggctggccagctgggaaggacagcatccagtatggccgggtgaaggccaccgtgcacctggcctacctgcgggctgtgggcacccccctgtgcctgtatgccctcttcctgttcctgtgccagcaggtggccagcttctgccggggctactggctgagcctgtgggcagatgatcctgctgtgggcggccagcagacccaggccgccctgcggggcggcatcttcggcctgctgggctgcctgcaggccatcggcctgtttgcctccatggctgctgtgctgctgggcggggcccgggccagccggctgctcttccagaggctgctgtgggatgtggtgcgcagccccatctccttctttgagaggacccccatcggccacctgctgaaccgcttcagcaaggagacagacacagtggatgtggacatcccagacaagctgcggagcctgctgatgtatgccttcggcctgctggaggtgtccctggtggtggccgtggccacccccctggccaccgtggccatcctgcccctcttcctgctgtatgccggcttccagagcctgtatgtggtgagcagctgccagctgcggcggctggagagcgccagctacagctctgtgtgcagccacatggccgagaccttccagggcagcacagtggtgcgggccttccgcacccaggccccctttgtggcccagaacaatgcccgggtggatgagagccagaggatctccttcccccggctggtggccgaccgctggctggccgccaacgtggagctgctgggcaatggcctggtgtttgctgctgccacctgtgctgtgctgagcaaggcccacctgtctgctggcctggtgggcttctctgtgtctgctgccctgcaggtgacccagaccctgcagtgggtggtgaggaactggacagacctggagaacagcatcgtgtctgtggagaggatgcaggactatgcctggacccccaaggaggccccctggaggctgcccacctgtgccgcccagcccccctggccccagggcggccagatcgagttccgggactttggcctgcgctacagacctgagctgcccctggccgtgcagggcgtgtccttcaagatccatgctggggagaaggtgggcatcgtgggccgcactggagctgggaagagcagcctggccagcggcctgctgcggctgcaggaggccgctgagggcggcatctggattgatggagtgcccatcgcccacgtgggcctgcacaccctgcggagccgcatcagcatcatcccccaggaccccatcctcttccctggcagcctgaggatgaacctggacctgctgcaggagcacagtgatgaggccatctgggccgccctggagaccgtgcagctgaaggccctggtggccagcctgcccggccagctgcagtacaagtgtgccgacagaggagaggacctgtctgtgggccagaagcagctgctgtgcctggcccgggccctgctgaggaagacccagatcctgatcctggatgaggccacagctgctgtggaccccggcacagagctgcagatgcaggccatgctgggctcctggtttgcccagtgcaccgtgctgctgattgcccaccggctgcggtctgtgatggactgtgcccgggtgctggtgatggacaagggccaggtggccgagagcggcagccctgcccagctgctggcccagaagggcctcttctaccgcctggcccaggagagcggcctggtgtag

SEQ ID NO: 144632 - DNA, 2616 bp, Artificial Sequence
  Description of Artificial Sequence: Synthetic coding sequence
atggccgccccagctgagccctgtgccggccagggcgtgtggaaccagacagagcctgagcctgctgccaccagcctgctgagcctgtgcttcctgaggacagctggggtgtgggtgccccccatgtacctgtgggtgctgggccccatctacctgctcttcatccaccaccacggccggggctacctgaggatgagccccctcttcaaggccaagatggtgctgggctttgccctgattgtgctgtgcaccagctctgtggccgtggccctgtggaagatccagcagggcaccccagaggcccctgagttcctgatccaccccaccgtgtggctgaccaccatgagctttgctgtgttcctgatccacacagagaggaagaagggcgtgcagagcagtggagtgctgtttggctactggctgctgtgctttgtgctgcctgccaccaatgctgcccagcaggccagcggggccggcttccagagcgaccctgtgcgccacctgagcacctacctgtgcctgagcctggtggtggcccagtttgtgctgagctgcctggccgaccagccccccttcttccctgaggacccccagcagagcaacccctgcccagagaccggggccgccttccccagcaaggccaccttctggtgggtgtctggcctggtgtggaggggctaccgccggcccctgcggcccaaggacctgtggagcctgggccgggagaacagcagcgaggagctggtgtcccggctggagaaggagtggatgaggaacagatctgctgcccggcggcacaacaaggccatcgccttcaagaggaaaggaggcagcggcatgaaggcccctgagacagagcccttcctgcggcaggagggcagccagtggaggcccctgctgaaggccatctggcaggtgttccacagcaccttcctgctgggcaccctgagcctcatcatcagtgatgtgttccgcttcaccgtgcccaagctgctgagcctcttcctggagttcatcggggaccccaagcccccagcctggaagggctacctgctggccgtgctgatgttcctgagcgcctgcctgcagaccctgtttgagcagcagaacatgtaccgcctgaaggtgctgcagatgaggctgcggagcgccatcaccggcctggtgtacaggaaggtgctggccctgagcagcggcagcaggaaggccagcgctgtgggagatgtggtgaacctggtgtctgtggatgtgcagaggctgacagaatctgtgctgtacctgaatggcctgtggctgcccctggtgtggatcgtggtgtgctttgtgtacctgtggcagctgctgggccccagcgccctgacagccatcgctgtgttcctgagcctgctgcccctgaacttcttcatcagcaagaagaggaaccaccaccaggaggagcagatgaggcagaaggacagccgggcccggctgaccagcagcatcctgaggaacagcaagaccatcaagttccacggctgggagggcgccttcctggacagagtgctgggcatccggggccaggagctgggcgccctgcggaccagcggcctgctcttctctgtgtccctggtgtccttccaggtgtccaccttcctggtggccctggtggtgtttgctgtgcacaccctggtggctgaaaatgccatgaatgctgagaaggcctttgtgaccctgactgtgctgaacatcctgaacaaggcccaggccttcctgcccttcagcatccacagcctggtgcaggcccgggtgtcctttgaccggctggtgaccttcctgtgcctggaggaggtggaccccggggtggtggacagcagcagcagcggcagcgctgctgggaaggactgcatcaccatccacagcgccacctttgcctggagccaggagagccccccctgcctgcaccgcatcaacctgactgtgccccagggctgcctgctggccgtggtgggccctgtgggcgccggcaagagcagcctgctgagcgccctgctgggggagctgagcaaggtggagggctttgtgtccattgaaggagctgtggcctacgtgccccaggaggcctgggtgcagaacacctctgtggtggagaatgtgtgcttcggccaggagctggaccccccctggctggagcgggtgctggaggcctgtgccctgcagccagatgtggacagcttccctgagggcatccacaccagcatcggggagcagggcatgaacctgagcggcggccagaagcagaggctgagcctggcccgggctgtgtacaggaaggctgctgtgtacctgctggatgaccccctggccgccctggatgcccacgtgggccagcacgtgttcaaccaggtgattggccctgggggcctgctgcagggcaccaagcagaacctgggccctgcccccaggaccccagaggcccccctgcaggccggcggccccagcctggatgcccggggccccagcagccagagcctgcggaggacagtgcccctgcagaagccccggcagcgcttcctgtggatgaccctgaccggccaggacggccagcaggagaggacagccagcaacacagctggatag

SEQ ID NO: 144633 - DNA, 2019 bp, Artificial Sequence
  Description of Artificial Sequence: Synthetic coding sequence
atggccgccccagctgagccctgtgccggccagggcgtgtggaaccagacagagcctgagcctgctgccaccagcctgctgagcctgtgcttcctgaggacagctggggtgtgggtgccccccatgtacctgtgggtgctgggccccatctacctgctcttcatccaccaccacggccggggctacctgaggatgagccccctcttcaaggccaagatggtggccgccatccctggcagcctggagcctggaaatgtgctgggctttgccctgattgtgctgtgcaccagctctgtggccgtggccctgtggaagatccagcagggcaccccagaggcccctgagttcctgatccaccccaccgtgtggctgaccaccatgagctttgctgtgttcctgatccacacagagaggaagaagggcgtgcagagcagtggagtgctgtttggctactggctgctgtgctttgtgctgcctgccaccaatgctgcccagcaggccagcggggccggcttccagagcgaccctgtgcgccacctgagcacctacctgtgcctgagcctggtggtggcccagtttgtgctgagctgcctggccgaccagccccccttcttccctgaggacccccagcagagcaacccctgcccagagaccggggccgccttccccagcaaggccaccttctggtgggtgtctggcctggtgtggaggggctaccgccggcccctgcggcccaaggacctgtggagcctgggccgggagaacagcagcgaggagctggtgtcccggctggagaaggagtggatgaggaacagatctgctgcccggcggcacaacaaggccatcgccttcaagaggaaaggaggcagcggcatgaaggcccctgagacagagcccttcctgcggcaggagggcagccagtggaggcccctgctgaaggccatctggcaggtgttccacagcaccttcctgctgggcaccctgagcctcatcatcagtgatgtgttccgcttcaccgtgcccaagctgctgagcctcttcctggagttcatcggggaccccaagcccccagcctggaagggctacctgctggccgtgctgatgttcctgagcgcctgcctgcagaccctgtttgagcagcagaacatgtaccgcctgaaggtgctgcagatgaggctgcggagcgccatcaccggcctggtgtacaggaaggtgctggccctgagcagcggcagcaggaaggccagcgctgtgggagatgtggtgaacctggtgtctgtggatgtgcagaggctgacagaatctgtgctgtacctgaatggcctgtggctgcccctggtgtggatcgtggtgtgctttgtgtacctgtggcagctgctgggccccagcgccctgacagccatcgctgtgttcctgagcctgctgcccctgaacttcttcatcagcaagaagaggaaccaccaccaggaggagcagatgaggcagaaggacagccgggcccggctgaccagcagcatcctgaggaacagcaagaccatcaagttccacggctgggagggcgccttcctggacagagtgctgggcatccggggccaggagctgggcgccctgcggaccagcggcctgctcttctctgtgtccctggtgtccttccaggtgtccaccttcctggtggccctggtggtgtttgctgtgcacaccctggtggctgaaaatgccatgaatgctgagaaggcctttgtgaccctgactgtgctgaacatcctgaacaaggcccaggccttcctgcccttcagcatccacagcctggtgcaggcccgggtgtcctttgaccggctggtgaccttcctgtgcctggaggaggtggaccccggggtggtggacagcagcagcagcggcagcgctgctgggaaggactgcatcaccatccacagcgccacctttgcctggagccaggagagccccccctgcctgcaccgggtgctgctgtaccacgccggctggagcgccatggcctag

SEQ ID NO: 144634 - DNA, 4650 bp, Artificial Sequence
  Description of Artificial Sequence: Synthetic coding sequence
atgagcctgtccttctgtggcaacaacatcagcagctacaacatcaatgatggagtgctgcagaacagctgctttgtggatgccctgaacctggtgccccacgtgttcctgctcttcatcaccttccccatcctcttcatcggctggggcagccagagcagcaaggtgcagatccaccacaacacctggctgcacttccctggccacaacctgcgctggatcctgacctttgccctgctgtttgtgcacgtgtgtgaaattgctgagggcatcgtgtctgacagccggcgggagagccgccacctgcacctgttcatgcctgctgtgatgggctttgtggccaccaccaccagcatcgtgtactaccacaacatcgagaccagcaacttccccaagctgctgctggccctcttcctgtactgggtgatggccttcatcaccaagaccatcaagctggtgaagtactgccagagcggcctggacatcagcaacctgcgcttctgcatcaccggcatgatggtgatcctgaatggcctgctgatggctgtggagatcaacgtcatccgggtgagaagatatgtgttcttcatgaacccccagaaggtgaagcccccagaggacctgcaggacctgggcgtgcgcttcctgcagccctttgtgaacctgctgagcaaggccacctactggtggatgaacaccctcatcatcagcgcccacaagaagcccatcgacctgaaggccatcggcaagctgcccatcgccatgagagctgtgaccaactacgtgtgcctgaaggatgcctatgaggagcagaagaagaaggtggccgaccaccccaacagaacacccagcatctggctggccatgtaccgggccttcggccggcccatcctgctgagcagcaccttccgctacctggccgacctgctgggctttgctggccccctgtgcatctctggaattgtgcagagggtgaatgagacccagaatggcaccaacaacaccaccggcatcagcgagaccctgagcagcaaggagttcctggagaatgcctacgtgctggccgtgctgctcttcctggccctgatcctgcagaggaccttcctgcaggccagctactacgtgaccattgaaacaggcatcaacctgcggggggccctgctggccatgatctacaacaagatcctgcggctgagcaccagcaacctgtccatgggagagatgaccctgggccagatcaacaacctggtggccatcgagaccaaccagctgatgtggttcctgttcctgtgccccaacctgtgggccatgcctgtgcagatcatcatgggcgtcatcctgctgtacaacctgctgggcagcagcgccctggtgggcgctgctgtgattgtgctgctggcccccatccagtacttcatcgccaccaagctggccgaggcccagaagagcaccctggactacagcacagagcggctgaagaagaccaatgagatcctgaagggcatcaagctgctgaagctgtatgcctgggagcacatcttctgcaagtctgtggaggagaccaggatgaaggagctgagcagcctgaagacctttgccctgtacaccagcctgagcatcttcatgaatgctgccatccccatcgctgctgtgctggccacctttgtgacccacgcctatgccagcggcaacaacctgaagccagctgaggcctttgccagcctgagcctcttccacatcctggtgacccccctcttcctgctgagcacagtggtgcgctttgctgtgaaggccatcatctctgtgcagaagctgaatgagttcctgctgagtgatgaaattggagatgacagctggaggactggagagagcagcctgccctttgagagctgcaagaagcacactggagtgcagcccaagaccatcaacaggaagcagcccggccgctaccacctggacagctatgagcagagcacccggcggctgcggcctgctgagacagaggacatcgccatcaaggtgaccaacggctacttctcctggggcagcggcctggccaccctgagcaacatcgacatccgcatccccaccggccagctgaccatgattgtgggccaggtgggctgcggcaagagcagcctgctgctggccatcctgggggagatgcagaccctggagggcaaggtgcactggagcaatgtgaatgaaagtgagcccagctttgaggccaccaggagcaggaaccgctacagcgtggcctatgctgcccagaagccctggctgctgaatgccaccgtggaggagaacatcaccttcggcagccccttcaacaagcagcgctacaaggctgtgacagatgcctgcagcctgcagcctgacatcgacctgctgccctttggagaccagacagaaattggagagcggggcatcaacctgagcggcggccagaggcagaggatctgtgtggcccgggccctgtaccagaacaccaacatcgtgttcctggatgaccccttcagcgccctggacatccacctgagtgaccacctgatgcaggagggcatcctgaagttcctgcaggatgacaagaggaccctggtgctggtgacccacaagctgcagtacctgacccatgctgactggatcatcgccatgaaggatggctctgtgctgcgggagggcaccctgaaggacatccagaccaaggatgtggagctgtatgagcactggaagaccctgatgaaccggcaggaccaggagctggagaaggacatggaggccgaccagaccaccctggagaggaagaccctgcggcgggccatgtacagccgggaggccaaggcccagatggaggatgaagatgaggaggaggaggaggaggaggatgaagatgacaacatgagcacagtgatgaggctgcggaccaagatgccctggaagacctgctggagatacctgaccagcggcggcttcttcctgctgatcctgatgatcttcagcaagctgctgaagcacagcgtcatcgtggccatcgactactggctggccacctggaccagcgagtacagcatcaacaacacaggcaaggctgaccagacctactacgtggccggcttcagcatcctgtgtggggccggcatcttcctgtgcctggtgaccagcctgactgtggagtggatgggcctgacagctgccaagaacctgcaccacaacctgctgaacaagatcatcctgggccccatccgcttctttgacaccacccccctgggcctcatcctgaaccgcttctctgctgacaccaacatcatcgaccagcacatcccccccaccctggagagcctgaccaggagcaccctgctgtgcctgagcgccatcggcatgatctcctatgccacccctgtgttcctggtggccctgctgcccctgggcgtggccttctacttcatccagaagtacttccgggtggccagcaaggacctgcaggagctggatgacagcacccagctgcccctgctgtgccacttcagcgagacagctgagggcctgaccaccatccgggccttcagacatgagacccgcttcaagcagaggatgctggagctgacagacaccaacaacatcgcctacctgttcctgtctgctgccaaccgctggctggaggtgaggacagactacctgggcgcctgcatcgtgctgacagccagcatcgccagcatcagcggcagcagcaacagcggcctggtgggcctgggcctgctgtatgccctgaccatcaccaactacctgaactgggtggtgaggaacctggccgacctggaggtgcagatgggcgctgtgaagaaggtgaacagcttcctgaccatggagagtgaaaattatgagggcaccatggaccccagccaggtgcctgagcactggccccaggagggggagatcaagatccatgacctgtgtgtgcgctatgagaacaacctgaagcctgtgctgaagcacgtgaaggcctacatcaagccaggccagaaggtgggcatctgtggccgcacaggcagcggcaagagcagcctgagcctggccttcttcaggatggtggacatctttgatggcaagatcgtgattgatggcatcgacatcagcaagctgcccctgcacaccctgcggagccggctgagcatcatcctgcaggaccccatcctcttcagcggcagcatccgcttcaacctggaccctgagtgcaagtgcacagatgaccggctgtgggaggccctggagatcgcccagctgaagaacatggtgaagagcctgcccggcggcctggatgctgtggtgacagaaggaggagagaacttctctgtgggccagaggcagctgttctgcctggcccgggcctttgtgaggaagagcagcatcctgatcatggatgaggccacagccagcattgacatggccacagagaacatcctgcagaaggtggtgatgacagcctttgctgacagaacagtggtgaccatcgcccaccgggtgcacaccatcctgacagctgacctggtgattgtgatgaagaggggcaacatcctggagtatgacaccccagagagcctgctggcccaggagaatggagtgtttgccagctttgtgcgggctgacatgtag

SEQ ID NO: 144635 - DNA, 4650 bp, Artificial Sequence
  Description of Artificial Sequence: Synthetic coding sequence
atgagcctgtccttctgtggcaacaacatcagcagctacaacatcaatgatggagtgctgcagaacagctgctttgtggatgccctgaacctggtgccccacgtgttcctgctcttcatcaccttccccatcctcttcatcggctggggcagccagagcagcaaggtgcagatccaccacaacacctggctgcacttccctggccacaacctgcgctggatcctgacctttgccctgctgtttgtgcacgtgtgtgaaattgctgagggcatcgtgtctgacagccggcgggagagccgccacctgcacctgttcatgcctgctgtgatgggctttgtggccaccaccaccagcatcgtgtactaccacaacatcgagaccagcaacttccccaagctgctgctggccctcttcctgtactgggtgatggccttcatcaccaagaccatcaagctggtgaagtactgccagagcggcctggacatcagcaacctgcgcttctgcatcaccggcatgatggtgatcctgaatggcctgctgatggctgtggagatcaacgtcatccgggtgagaagatatgtgttcttcatgaacccccagaaggtgaagcccccagaggacctgcaggacctgggcgtgcgcttcctgcagccctttgtgaacctgctgagcaaggccacctactggtggatgaacaccctcatcatcagcgcccacaagaagcccatcgacctgaaggccatcggcaagctgcccatcgccatgagagctgtgaccaactacgtgtgcctgaaggatgcctatgaggagcagaagaagaaggtggccgaccaccccaacagaacacccagcatctggctggccatgtaccgggccttcggccggcccatcctgctgagcagcaccttccgctacctggccgacctgctgggctttgctggccccctgtgcatctctggaattgtgcagagggtgaatgagacccagaatggcaccaacaacaccaccggcatcagcgagaccctgagcagcaaggagttcctggagaatgcctacgtgctggccgtgctgctcttcctggccctgatcctgcagaggaccttcctgcaggccagctactacgtgaccattgaaacaggcatcaacctgcggggggccctgctggccatgatctacaacaagatcctgcggctgagcaccagcaacctgtccatgggagagatgaccctgggccagatcaacaacctggtggccatcgagaccaaccagctgatgtggttcctgttcctgtgccccaacctgtgggccatgcctgtgcagatcatcatgggcgtcatcctgctgtacaacctgctgggcagcagcgccctggtgggcgctgctgtgattgtgctgctggcccccatccagtacttcatcgccaccaagctggccgaggcccagaagagcaccctggactacagcacagagcggctgaagaagaccaatgagatcctgaagggcatcaagctgctgaagctgtatgcctgggagcacatcttctgcaagtctgtggaggagaccaggatgaaggagctgagcagcctgaagacctttgccctgtacaccagcctgagcatcttcatgaatgctgccatccccatcgctgctgtgctggccacctttgtgacccacgcctatgccagcggcaacaacctgaagccagctgaggcctttgccagcctgagcctcttccacatcctggtgacccccctcttcctgctgagcacagtggtgcgctttgctgtgaaggccatcatctctgtgcagaagctgaatgagttcctgctgagtgatgaaattggagatgacagctggaggactggagagagcagcctgccctttgagagctgcaagaagcacactggagtgcagcccaagaccatcaacaggaagcagcccggccgctaccacctggacagctatgagcagagcacccggcggctgcggcctgctgagacagaggacatcgccatcaaggtgaccaacggctacttctcctggggcagcggcctggccaccctgagcaacatcgacatccgcatccccaccggccagctgaccatgattgtgggccaggtgggctgcggcaagagcagcctgctgctggccatcctgggggagatgcagaccctggagggcaaggtgcactggagcaatgtgaatgaaagtgagcccagctttgaggccaccaggagcaggaaccgctacagcgtggcctatgctgcccagaagccctggctgctgaatgccaccgtggaggagaacatcaccttcggcagccccttcaacaagcagcgctacaaggctgtgacagatgcctgcagcctgcagcctgacatcgacctgctgccctttggagaccagacagaaattggagagcggggcatcaacctgagcggcggccagaggcagaggatctgtgtggcccgggccctgtaccagaacaccaacatcgtgttcctggatgaccccttcagcgccctggacatccacctgagtgaccacctgatgcaggagggcatcctgaagttcctgcaggatgacaagaggaccctggtgctggtgacccacaagctgcagtacctgacccatgctgactggatcatcgccatgaaggatggctctgtgctgcgggagggcaccctgaaggacatccagaccaaggatgtggagctgtatgagcactggaagaccctgatgaaccggcaggaccaggagctggagaaggacatggaggccgaccagaccaccctggagaggaagaccctgcggcgggccatgtacagccgggaggccaaggcccagatggaggatgaagatgaggaggaggaggaggaggaggatgaagatgacaacatgagcacagtgatgaggctgcggaccaagatgccctggaagacctgctggagatacctgaccagcggcggcttcttcctgctgatcctgatgatcttcagcaagctgctgaagcacagcgtcatcgtggccatcgactactggctggccacctggaccagcgagtacagcatcaacaacacaggcaaggctgaccagacctactacgtggccggcttcagcatcctgtgtggggccggcatcttcctgtgcctggtgaccagcctgactgtggagtggatgggcctgacagctgccaagaacctgcaccacaacctgctgaacaagatcatcctgggccccatccgcttctttgacaccacccccctgggcctcatcctgaaccgcttctctgctgacaccaacatcatcgaccagcacatcccccccaccctggagagcctgaccaggagcaccctgctgtgcctgagcgccatcggcatgatctcctatgccacccctgtgttcctggtggccctgctgcccctgggcgtggccttctacttcatccagaagtacttccgggtggccagcaaggacctgcaggagctggatgacagcacccagctgcccctgctgtgccacttcagcgagacagctgagggcctgaccaccatccgggccttcagacatgagacccgcttcaagcagaggatgctggagctgacagacaccaacaacatcgcctacctgttcctgtctgctgccaaccgctggctggaggtgaggacagactacctgggcgcctgcatcgtgctgacagccagcatcgccagcatcagcggcagcagcaacagcggcctggtgggcctgggcctgctgtatgccctgaccatcaccaactacctgaactgggtggtgaggaacctggccgacctggaggtgcagatgggcgctgtgaagaaggtgaacagcttcctgaccatggagagtgaaaattatgagggcaccatggaccccagccaggtgcctgagcactggccccaggagggggagatcaagatccatgacctgtgtgtgcgctatgagaacaacctgaagcctgtgctgaagcacgtgaaggcctacatcaagccaggccagaaggtgggcatctgtggccgcacaggcagcggcaagagcagcctgagcctggccttcttcaggatggtggacatctttgatggcaagatcgtgattgatggcatcgacatcagcaagctgcccctgcacaccctgcggagccggctgagcatcatcctgcaggaccccatcctcttcagcggcagcatccgcttcaacctggaccctgagtgcaagtgcacagatgaccggctgtgggaggccctggagatcgcccagctgaagaacatggtgaagagcctgcccggcggcctggatgctgtggtgacagaaggaggagagaacttctctgtgggccagaggcagctgttctgcctggcccgggcctttgtgaggaagagcagcatcctgatcatggatgaggccacagccagcattgacatggccacagagaacatcctgcagaaggtggtgatgacagcctttgctgacagaacagtggtgaccatcgcccaccgggtgagcagcatcatggatgctggcctggtgctggtgttcagcgagggcatcctggtggagtgtgacacagtgcccaacctgctggcccacaagaatggcctcttcagcaccctggtgatgaccaacaagtag

SEQ ID NO: 144636 - DNA, 450 bp, Artificial Sequence
  Description of Artificial Sequence: Synthetic coding sequence
atgagcctgtccttctgtggcaacaacatcagcagctacaacatcaatgatggagtgctgcagaacagctgctttgtggatgccctgaacctggtgccccacgtgttcctgctcttcatcaccttccccatcctcttcatcggctggggcagccagagcagcaaggtgcagatccaccacaacacctggctgcacttccctggccacaacctgcgctggatcctgacctttgccctgctgtttgtgcacgtgtgtgaaattgctgagggcatcgtgtctgacagccggcgggagagccgccacctgcacctgttcatgcctgctgtgatgggctttgtggccaccaccaccagcatcgtgtactaccacaacatcgagaccagcaacttccccaagctgctgctgggcttcagccaccacgagagcaagagctgctaccagcacagctag

SEQ ID NO: 144637 - DNA, 4542 bp, Artificial Sequence
  Description of Artificial Sequence: Synthetic coding sequence
atgagcctgtccttctgtggcaacaacatcagcagctacaacatcaatgatggagtgctgcagaacagctgctttgtggatgccctgaacctggtgccccacgtgttcctgctcttcatcaccttccccatcctcttcatcggctggggcagccagagcagcaaggtgcagatccaccacaacacctggctgcacttccctggccacaacctgcgctggatcctgacctttgccctgctgtttgtgcacgtgtgtgaaattgctgagggcatcgtgtctgacagccggcgggagagccgccacctgcacctgttcatgcctgctgtgatgggctttgtggccaccaccaccagcatcgtgtactaccacaacatcgagaccagcaacttccccaagctgctgctggccctcttcctgtactgggtgatggccttcatcaccaagaccatcaagctggtgaagtactgccagagcggcctggacatcagcaacctgcgcttctgcatcaccggcatgatggtgatcctgaatggcctgctgatggctgtggagatcaacgtcatccgggtgagaagatatgtgttcttcatgaacccccagaaggtgaagcccccagaggacctgcaggacctgggcgtgcgcttcctgcagccctttgtgaacctgctgagcaaggccacctactggtggatgaacaccctcatcatcagcgcccacaagaagcccatcgacctgaaggccatcggcaagctgcccatcgccatgagagctgtgaccaactacgtgtgcctgaaggatgcctatgaggagcagaagaagaaggtggccgaccaccccaacagaacacccagcatctggctggccatgtaccgggccttcggccggcccatcctgctgagcagcaccttccgctacctggccgacctgctgggctttgctggccccctgtgcatctctggaattgtgcagagggtgaatgagacccagaatggcaccaacaacaccaccggcatcagcgagaccctgagcagcaaggagttcctggagaatgcctacgtgctggccgtgctgctcttcctggccctgatcctgcagaggaccttcctgcaggccagctactacgtgaccattgaaacaggcatcaacctgcggggggccctgctggccatgatctacaacaagatcctgcggctgagcaccagcaacctgtccatgggagagatgaccctgggccagatcaacaacctggtggccatcgagaccaaccagctgatgtggttcctgttcctgtgccccaacctgtgggccatgcctgtgcagatcatcatgggcgtcatcctgctgtacaacctgctgggcagcagcgccctggtgggcgctgctgtgattgtgctgctggcccccatccagtacttcatcgccaccaagctggccgaggcccagaagagcaccctggactacagcacagagcggctgaagaagaccaatgagatcctgaagggcatcaagctgctgaagctgtatgcctgggagcacatcttctgcaagtctgtggaggagaccaggatgaaggagctgagcagcctgaagacctttgccctgtacaccagcctgagcatcttcatgaatgctgccatccccatcgctgctgtgctggccacctttgtgacccacgcctatgccagcggcaacaacctgaagccagctgaggcctttgccagcctgagcctcttccacatcctggtgacccccctcttcctgctgagcacagtggtgcgctttgctgtgaaggccatcatctctgtgcagaagctgaatgagttcctgctgagtgatgaaattggagatgacagctggaggactggagagagcagcctgccctttgagagctgcaagaagcacactggagtggtgaccaacggctacttctcctggggcagcggcctggccaccctgagcaacatcgacatccgcatccccaccggccagctgaccatgattgtgggccaggtgggctgcggcaagagcagcctgctgctggccatcctgggggagatgcagaccctggagggcaaggtgcactggagcaatgtgaatgaaagtgagcccagctttgaggccaccaggagcaggaaccgctacagcgtggcctatgctgcccagaagccctggctgctgaatgccaccgtggaggagaacatcaccttcggcagccccttcaacaagcagcgctacaaggctgtgacagatgcctgcagcctgcagcctgacatcgacctgctgccctttggagaccagacagaaattggagagcggggcatcaacctgagcggcggccagaggcagaggatctgtgtggcccgggccctgtaccagaacaccaacatcgtgttcctggatgaccccttcagcgccctggacatccacctgagtgaccacctgatgcaggagggcatcctgaagttcctgcaggatgacaagaggaccctggtgctggtgacccacaagctgcagtacctgacccatgctgactggatcatcgccatgaaggatggctctgtgctgcgggagggcaccctgaaggacatccagaccaaggatgtggagctgtatgagcactggaagaccctgatgaaccggcaggaccaggagctggagaaggacatggaggccgaccagaccaccctggagaggaagaccctgcggcgggccatgtacagccgggaggccaaggcccagatggaggatgaagatgaggaggaggaggaggaggaggatgaagatgacaacatgagcacagtgatgaggctgcggaccaagatgccctggaagacctgctggagatacctgaccagcggcggcttcttcctgctgatcctgatgatcttcagcaagctgctgaagcacagcgtcatcgtggccatcgactactggctggccacctggaccagcgagtacagcatcaacaacacaggcaaggctgaccagacctactacgtggccggcttcagcatcctgtgtggggccggcatcttcctgtgcctggtgaccagcctgactgtggagtggatgggcctgacagctgccaagaacctgcaccacaacctgctgaacaagatcatcctgggccccatccgcttctttgacaccacccccctgggcctcatcctgaaccgcttctctgctgacaccaacatcatcgaccagcacatcccccccaccctggagagcctgaccaggagcaccctgctgtgcctgagcgccatcggcatgatctcctatgccacccctgtgttcctggtggccctgctgcccctgggcgtggccttctacttcatccagaagtacttccgggtggccagcaaggacctgcaggagctggatgacagcacccagctgcccctgctgtgccacttcagcgagacagctgagggcctgaccaccatccgggccttcagacatgagacccgcttcaagcagaggatgctggagctgacagacaccaacaacatcgcctacctgttcctgtctgctgccaaccgctggctggaggtgaggacagactacctgggcgcctgcatcgtgctgacagccagcatcgccagcatcagcggcagcagcaacagcggcctggtgggcctgggcctgctgtatgccctgaccatcaccaactacctgaactgggtggtgaggaacctggccgacctggaggtgcagatgggcgctgtgaagaaggtgaacagcttcctgaccatggagagtgaaaattatgagggcaccatggaccccagccaggtgcctgagcactggccccaggagggggagatcaagatccatgacctgtgtgtgcgctatgagaacaacctgaagcctgtgctgaagcacgtgaaggcctacatcaagccaggccagaaggtgggcatctgtggccgcacaggcagcggcaagagcagcctgagcctggccttcttcaggatggtggacatctttgatggcaagatcgtgattgatggcatcgacatcagcaagctgcccctgcacaccctgcggagccggctgagcatcatcctgcaggaccccatcctcttcagcggcagcatccgcttcaacctggaccctgagtgcaagtgcacagatgaccggctgtgggaggccctggagatcgcccagctgaagaacatggtgaagagcctgcccggcggcctggatgctgtggtgacagaaggaggagagaacttctctgtgggccagaggcagctgttctgcctggcccgggcctttgtgaggaagagcagcatcctgatcatggatgaggccacagccagcattgacatggccacagagaacatcctgcagaaggtggtgatgacagcctttgctgacagaacagtggtgaccatcgcccaccgggtgagcagcatcatggatgctggcctggtgctggtgttcagcgagggcatcctggtggagtgtgacacagtgcccaacctgctggcccacaagaatggcctcttcagcaccctggtgatgaccaacaagtag

SEQ ID NO: 144638 - DNA, 1386 bp, Artificial Sequence
  Description of Artificial Sequence: Synthetic coding sequence
atgcagagggtgaacatgatcatggccgagagccctggcctcatcaccatctgcctgctgggctacctgctgtctgcagaatgtactgtgttcctggaccatgaaaatgccaacaagatcctgaaccggcccaagcgctacaacagcggcaagctggaggagtttgtgcagggcaacctggagcgggagtgcatggaggagaagtgcagctttgaggaggcccgggaggtgtttgaaaatacagagaggaccacagagttctggaagcagtatgtggatggagaccagtgtgagagcaacccctgcctgaatggaggcagctgcaaggatgacatcaacagctatgagtgctggtgcccctttggatttgagggcaagaactgtgagctggatgtgacctgcaacatcaagaatggccgctgtgagcagttctgcaagaacagcgctgacaacaaggtggtgtgcagctgcacagagggctaccgcctggccgagaaccagaagagctgtgagcctgctgtgcccttcccctgtggccgggtgtctgtgtcccagaccagcaagctgaccagggctgagaccgtcttcccagatgtggactatgtgaacagcacagaagctgagaccatcctggacaacatcacccagagcacccagagcttcaatgacttcaccagggtggtgggcggagaagatgccaagccaggccagttcccctggcaggtggtgctgaatggcaaggtggatgccttctgtggcggcagcatcgtgaatgagaagtggatcgtgacagctgcccactgtgtggagactggagtgaagatcaccgtggtggccggggagcacaacatcgaggagacagagcacacagagcagaagagaaatgtcatccgcatcatcccccaccacaactacaatgctgccatcaacaagtacaaccacgacatcgccctgctggagctggatgagcccctggtgctgaacagctatgtgacccccatctgcatcgctgacaaggagtacaccaacatcttcctgaagtttggcagcggctacgtgtctggctggggccgggtcttccacaagggccgcagcgccctggtgctgcagtacctgcgggtgcccctggtggaccgggccacctgcctgcggagcaccaagttcaccatctacaacaacatgttctgtgccggcttccacgagggcggccgggacagctgccagggcgacagcggcggcccccacgtgacagaggtggagggcaccagcttcctgaccggcatcatctcctggggcgaggagtgtgccatgaagggcaagtatggcatctacaccaaggtgagccgctacgtgaactggatcaaggagaagaccaagctgacctag

SEQ ID NO: 144639 - DNA, 684 bp, Artificial Sequence
  Description of Artificial Sequence: Synthetic coding sequence
atggatggccgcctgaggaacccagaccagagcctgacagaagatgtggtggcctttgctgcctctgtggcccacctgtacagcaacctgaccaagcccctgctggatgtggccgtgaccagctacaccctgctgcgggccgcccggagcagaggagctggaacagcctggcccagcgccatcgccggcctggtggtgttcctgacagccaacgtgctgcgggccttcagccccaagtttggagagctggtggccgaggaggcccggaggaaaggagagctgcgctacatgcacagccgggtggtggccaacagcgaggagatcgccttctatggaggccacgaggtggagctggccctgctgcagaggagctaccaggacctggccagccagatcaacctgatcctgctggagcggctgtggtacgtgatgctggagcagttcctgatgaagtatgtgtggagcgccagcggcctgctgatggtggccgtgcccatcatcacagccaccggctacagcgagagcggggagacccagggcagcaagaggatccaggcccggggcctgagccccatccccctgggcgctgagctgacccgggcccagctgagccagcctgctgcccacttctgctgccggggccaccggggccctgctgccagcctggatgccttccggggctag

SEQ ID NO: 144640 - DNA, 672 bp, Artificial Sequence
  Description of Artificial Sequence: Synthetic coding sequence
tgactcttcagcacagtggccgcccccttctacctgcctgccagctctgtgggcggcttccacctgttcatcgtggccagcacagatgctgaggccgtgaagaaggccgccctggagaagaaggaggaggagctggtgtctgagaggacagaggccttcaccatcgccaggaacctgctgacagctgctgctgatgccatcgagcgcatcatgagcagctacaaggaggtgacagagctggccggctacacagcccgggtgcatgagatgttccaggtgtttgaagatgtgcagcgctgccacttcaagaggccccgggagctggaggatgcccaggccggcagcggcaccatcggccgctctggagtgcgggtggagggccccctgaagatccggggccaggtggtggatgtggagcagggcatcatctgtgagaacatccccatcgtgaccccatctggagaggtggtggtggccagcctgaacatccgggtggaggagggcatgcacctgctgatcaccggccccaacggctgcggcaagagcagcctcttccgcatcctgggcggcctgtggcccacctatggaggagtgctgtacaagcccccaccccagaggatgttctacatcccccagaggccctacatgtctgtgggcagcctgcgggactag

SEQ ID NO: 144641 - DNA, 2223 bp, Artificial Sequence
  Description of Artificial Sequence: Synthetic coding sequence
atgacccacatgctgaatgctgctgctgacagagtgaagtggaccaggagcagcgctgccaagagagctgcctgcctggtggccgccgcctatgccctgaagaccctgtaccccatcatcggcaagaggctgaagcagagcggccacggcaagaagaaggctgctgcctacccagctgctgaaaatacagagatcctgcactgcacagagaccatctgtgagaagcccagccctggggtgaatgctgacttcttcaagcagctgctggagctgaggaagatcctcttccccaagctggtgaccacagagaccggctggctgtgcctgcacagcgtggccctgatcagcaggaccttcctgagcatctacgtggccggcctggatggcaagatcgtgaagagcatcgtggagaagaagcccaggaccttcatcatcaagctgatcaagtggctgatgattgccatcccagccacctttgtgaacagcgccatccgctacctggagtgcaagctggccctggccttccgcacccggctggtggaccacgcctatgagacctacttcaccaaccagacctactacaaggtgatcaacatggatggccgcctggccaacccagaccagagcctgacagaggacatcatgatgttcagccagagcgtggcccacctgtacagcaacctgaccaagcccatcctggatgtgatgctgaccagctacaccctcatccagacagccaccagcagaggagccagccccatcggccccaccctgctggccggcctggtggtgtatgccacagccaaggtgctgaaggcctgcagccccaagtttgggaagctggtggccgaggaggcccacaggaagggctacctgcgctacgtgcacagccgcatcatcgccaacgtggaggagatcgccttctaccggggccacaaggtggagatgaagcagctgcagaagagctacaaggccctggccgaccagatgaacctgatcctgagcaagaggctgtggtacatcatgattgagcagttcctgatgaagtatgtgtggagcagcagcggcctcatcatggtggccatccccatcatcacagccaccggctttgctgatggagaagatggccagaagcaggtgatggtgtctgagaggacagaggccttcaccacagccaggaacctgctggccagcggggctgatgccatcgagcgcatcatgagcagctacaaggaggtgacagagctggccggctacacagcccgggtgtacaacatgttctgggtgtttgatgaggtgaagaggggcatctacaagaggacagctgtgatccaggagagcgagagccacagcaagaatggagccaaggtggagctgcccctgagtgacaccctggccatcaagggcaaggtgattgatgtggaccacggcatcatctgtgaaaatgtgcccatcatcaccccagctggggaggtggtggccagccggctgaacttcaaggtggaggagggcatgcacctgctgatcaccggccccaacggctgcggcaagagcagcctcttccgcatcctgagcggcctgtggcctgtgtatgaaggagtgctgtacaagcccccaccccagcacatgttctacatcccccagaggccctacatgagcctgggcagcctgcgggaccaggtgatctacccagacagcgtggatgacatgcatgacaagggctacacagaccaggacctggagcgcatcctgcacaacgtgcacctgtaccacatcgtgcagcgggagggcggctgggatgctgtgatggactggaaggatgtgctgagcggcggggagaagcagaggatgggcatggccaggatgttctaccacaagcccaagtatgccctgctggatgagtgcaccagcgctgtgtccattgatgtggagggcaagatcttccaggccgccaagggggccggcatcagcctgctgagcatcacccaccggcccagcctgtggaagtaccacacccacctgctgcagtttgatggagagggcggctggaggtttgagcagctggacacagccatccggctgaccctgtctgaggagaagcagaagctggagagccagctggccggcatccccaagatgcagcagaggctgaatgagctgtgcaagatcctgggggaggacagcgtgctgaagaccatcaagaatgaagatgagaccagctag

SEQ ID NO: 144642 - DNA, 711 bp, Artificial Sequence
  Description of Artificial Sequence: Synthetic coding sequence
atggccgccttcagcaagtacctgacagccaggaacagcagcctggccggggccgccttcctgctgctgtgcctgctgcacaagagaagaagagccctgggcctgcacggcaagaagagcggcaagccacccctgcagaacaatgagaaggagggcaagaaggagagagctgtggtggacaaggtgttcttcagccgcctcatccagatcctgaagatcatggtgcccaggaccttctgcaaggagaccggctacctggtgctgattgctgtgatgctggtgtccaggacctactgtgatgtgtggatgatccagaatggcaccctcatcgagagcggcatcatcggccgcagcaggaaggacttcaagcgctacctgctgaacttcatcgccgccatgcccctcatcagcctggtgaacaacttcctgaagtatggcctgaatgagctgaagctgtgcttccgggtgcggctgaccaagtacctgtatgaggagtacctgcaggccttcacctactacaagatgggcaacctggacaaccgcatcgccaacccagaccagctgctgacccaggatgtggagaagttctgcaacagcgtggtggacctgtacagcaacctgagcaagcccttcctggacatcgtgctgtacatcttcaagctgaccagcgccatcggggcccaggtgctgggcaagatcctgtggcactag

SEQ ID NO: 144643 - DNA, 1980 bp, Artificial Sequence
  Description of Artificial Sequence: Synthetic coding sequence
atggccgccttcagcaagtacctgacagccaggaacagcagcctggccggggccgccttcctgctgctgtgcctgctgcacaagagaagaagagccctgggcctgcacggcaagaagagcggcaagccacccctgcagaacaatgagaaggagggcaagaaggagagagctgtggtggacaaggtgttcttcagccgcctcatccagatcctgaagatcatggtgcccaggaccttctgcaaggagaccggctacctggtgctgattgctgtgatgctggtgtccaggacctactgtgatgtgtggatgatccagaatggcaccctcatcgagagcggcatcatcggccgcagcaggaaggacttcaagcgctacctgctgaacttcatcgccgccatgcccctcatcagcctggtgaacaacttcctgaagtatggcctgaatgagctgaagctgtgcttccgggtgcggctgaccaagtacctgtatgaggagtacctgcaggccttcacctactacaagatgggcaacctggacaaccgcatcgccaacccagaccagctgctgacccaggatgtggagaagttctgcaacagcgtggtggacctgtacagcaacctgagcaagcccttcctggacatcgtgctgtacatcttcaagctgaccagcgccatcggggcccagggccctgcctccatgatggcctacctggtggtgtctggcctcttcctgacccggctgcggcggcccatcggcaagatgaccatcacagagcagaagtatgaaggagagtaccgctacgtgaacagccgcctcatcaccaacagcgaggagatcgccttctacaatggaaacaagcgggagaagcagacagtgcacagcgtcttcaggaagctggtggagcacctgcacaacttcatcctcttccgcttctccatgggcttcatcgacagcatcatcgccaagtacctggccaccgtggtgggctacctggtggtgtcccggcccttcctggacctgagccaccccaggcacctgaagagcacccacagcgagctgctggaggactactaccagagcggccgcatgctgctgaggatgagccaggccctgggccgcatcgtgctggccggccgggagatgacccggctggccggcttcaccgcccgcatcacagagctgatgcaggtgctgaaggacctgaaccacggcaagtatgaaagaaccatggtgtcccagcaggagaagggcatcgagggcgtgcaggtgatccccctcatccctggggccggggagatcatcatcgctgacaacatcatcaagtttgaccacgtgcccctggccaccccaaatggagatgtgctgatccgggacctgaactttgaggtgcgcagcggggccaacgtgctgatctgtggccccaacggctgcggcaagagcagcctcttccgggtgctgggggagctgtggcccctgtttggaggccgcctgaccaagccagagcggggcaagctgttctacgtgccccagaggccctacatgaccctgggcaccctgcgggaccaggtgatctacccagatggccgggaggaccagaagaggaagggcatcagtgacctggtgctgaaggagtacctggacaacgtgcagctgggccacatcctggagcgggagggcggctgggacagcgtgcaggactggatggatgtgctgagcggcggggagaagcagaggatggccatggcccggctcttctaccacaagccccagtttgccatcctggatgagtgcaccagcgctgtgtctgtggatgtggagggctacatctacagccactgcaggaaggtgggcatcaccctcttcaccgtgagccacaggaagagcctgtggaagcaccacgagtactacctgcacatggatggccggggcaactatgagttcaagcagatcacagaggacacagtggagtttggcagctag

SEQ ID NO: 144644 - DNA, 1650 bp, Artificial Sequence
  Description of Artificial Sequence: Synthetic coding sequence
atggccgccttcagcaagtacctgacagccaggaacagcagcctggccggggccgccttcctgctgctgtgcctgctgcacaagagaagaagagccctgggcctgcacggcaagaagagcggcaagccacccctgcagaacaatgagaaggagggcaagaaggagagagctgtggtggacaaggtgttcttcagccgcctcatccagatcctgaagatcatggtgcccaggaccttctgcaaggagaccggctacctggtgctgattgctgtgatgctggtgtccaggacctactgtgatgtgtggatgatccagaatggcaccctcatcgagagcggcatcatcggccgcagcaggaaggacttcaagcgctacctgctgaacttcatcgccgccatgcccctcatcagcctggtgaacaacttcctgaagtatggcctgaatgagctgaagctgtgcttccgggtgcggctgaccaagtacctgtatgaggagtacctgcaggccttcacctactacaagatgggcaacctggacaaccgcatcgccaacccagaccagctgctgacccaggatgtggagaagttctgcaacagcgtggtggacctgtacagcaacctgagcaagcccttcctggacatcgtgctgtacatcttcaagctgaccagcgccatcggggcccagggccctgcctccatgatggcctacctggtggtgtctggcctcttcctgacccggctgcggcggcccatcggcaagatgaccatcacagagcagaagtatgaaggagagtaccgctacgtgaacagccgcctcatcaccaacagcttcaccgcccgcatcacagagctgatgcaggtgctgaaggacctgaaccacggcaagtatgaaagaaccatggtgtcccagcaggagaagggcatcgagggcgtgcaggtgatccccctcatccctggggccggggagatcatcatcgctgacaacatcatcaagtttgaccacgtgcccctggccaccccaaatggagatgtgctgatccgggacctgaactttgaggtgcgcagcggggccaacgtgctgatctgtggccccaacggctgcggcaagagcagcctcttccgggtgctgggggagctgtggcccctgtttggaggccgcctgaccaagccagagcggggcaagctgttctacgtgccccagaggccctacatgaccctgggcaccctgcgggaccaggtgatctacccagatggccgggaggaccagaagaggaagggcatcagtgacctggtgctgaaggagtacctggacaacgtgcagctgggccacatcctggagcgggagggcggctgggacagcgtgcaggactggatggatgtgctgagcggcggggagaagcagaggatggccatggcccggctcttctaccacaagccccagtttgccatcctggatgagtgcaccagcgctgtgtctgtggatgtggagggctacatctacagccactgcaggaaggtgggcatcaccctcttcaccgtgagccacaggaagagcctgtggaagcaccacgagtactacctgcacatggatggccggggcaactatgagttcaagcagatcacagaggacacagtggagtttggcagctag

SEQ ID NO: 144645 - DNA, 2052 bp, Artificial Sequence
  Description of Artificial Sequence: Synthetic coding sequence
atggccgccttcagcaagtacctgacagccaggaacagcagcctggccggggccgccttcctgctgctgtgcctgctgcacaagagaagaagagccctgggcctgcacggctacttcatggagacctggagggagaagagtgatgaggtgatgggagagctgacagaccacgtgacccactgcaagaagagcggcaagccacccctgcagaacaatgagaaggagggcaagaaggagagagctgtggtggacaaggtgttcttcagccgcctcatccagatcctgaagatcatggtgcccaggaccttctgcaaggagaccggctacctggtgctgattgctgtgatgctggtgtccaggacctactgtgatgtgtggatgatccagaatggcaccctcatcgagagcggcatcatcggccgcagcaggaaggacttcaagcgctacctgctgaacttcatcgccgccatgcccctcatcagcctggtgaacaacttcctgaagtatggcctgaatgagctgaagctgtgcttccgggtgcggctgaccaagtacctgtatgaggagtacctgcaggccttcacctactacaagatgggcaacctggacaaccgcatcgccaacccagaccagctgctgacccaggatgtggagaagttctgcaacagcgtggtggacctgtacagcaacctgagcaagcccttcctggacatcgtgctgtacatcttcaagctgaccagcgccatcggggcccagggccctgcctccatgatggcctacctggtggtgtctggcctcttcctgacccggctgcggcggcccatcggcaagatgaccatcacagagcagaagtatgaaggagagtaccgctacgtgaacagccgcctcatcaccaacagcgaggagatcgccttctacaatggaaacaagcgggagaagcagacagtgcacagcgtcttcaggaagctggtggagcacctgcacaacttcatcctcttccgcttctccatgggcttcatcgacagcatcatcgccaagtacctggccaccgtggtgggctacctggtggtgtcccggcccttcctggacctgagccaccccaggcacctgaagagcacccacagcgagctgctggaggactactaccagagcggccgcatgctgctgaggatgagccaggccctgggccgcatcgtgctggccggccgggagatgacccggctggccggcttcaccgcccgcatcacagagctgatgcaggtgctgaaggacctgaaccacggcaagtatgaaagaaccatggtgtcccagcaggagaagggcatcgagggcgtgcaggtgatccccctcatccctggggccggggagatcatcatcgctgacaacatcatcaagtttgaccacgtgcccctggccaccccaaatggagatgtgctgatccgggacctgaactttgaggtgcgcagcggggccaacgtgctgatctgtggccccaacggctgcggcaagagcagcctcttccgggtgctgggggagctgtggcccctgtttggaggccgcctgaccaagccagagcggggcaagctgttctacgtgccccagaggccctacatgaccctgggcaccctgcgggaccaggtgatctacccagatggccgggaggaccagaagaggaagggcatcagtgacctggtgctgaaggagtacctggacaacgtgcagctgggccacatcctggagcgggagggcggctgggacagcgtgcaggactggatggatgtgctgagcggcggggagaagcagaggatggccatggcccggctcttctaccacaagccccagtttgccatcctggatgagtgcaccagcgctgtgtctgtggatgtggagggctacatctacagccactgcaggaaggtgggcatcaccctcttcaccgtgagccacaggaagagcctgtggaagcaccacgagtactacctgcacatggatggccggggcaactatgagttcaagcagatcacagaggacacagtggagtttggcagctag

SEQ ID NO: 144646 - DNA, 1761 bp, Artificial Sequence
  Description of Artificial Sequence: Synthetic coding sequence
atggtgcccaggaccttctgcaaggagaccggctacctggtgctgattgctgtgatgctggtgtccaggacctactgtgatgtgtggatgatccagaatggcaccctgattgaaagtggcatcatcggccgcagcaggaaggacttcaagcgctacctgctgaacttcatcgccgccatgcccctcatcagcctggtgaacaacttcctgaagtatggcctgaatgagctgaagctgtgcttccgggtgcggctgaccaagtacctgtatgaggagtacctgcaggccttcacctactacaagatgggcaacctggacaacagaattgccaacccagaccagctgctgacccaggatgtggagaagttctgcaacagcgtggtggacctgtacagcaacctgagcaagcccttcctggacatcgtgctgtacatcttcaagctgaccagcgccatcggggcccagggccctgcctccatgatggcctacctggtggtgtctggcctcttcctgacccggctgcggcggcccatcggcaagatgaccatcacagagcagaagtatgaaggagagtaccgctacgtgaacagccgcctcatcaccaacagcgaggagatcgccttctacaacggcaacaagcgggagaagcagacagtgcacagcgtcttcaggaagctggtggagcacctgcacaacttcatcctcttccgcttctccatgggcttcatcgacagcatcatcgccaagtacctggccaccgtggtgggctacctggtggtgtcccggcccttcctggacctgagccaccccaggcacctgaagagcacccacagcgagctgctggaggactactaccagagcggccgcatgctgctgaggatgagccaggccctgggcagaattgtgctggccggccgggagatgacccggctggccggcttcaccgcccgcatcacagagctgatgcaggtgctgaaggacctgaaccacggcaagtatgaaagaaccatggtgtcccagcaggagaagggcattgaaggagtgcaggtgatccccctcatccctggagctggggagatcatcatcgctgacaacatcatcaagtttgaccacgtgcccctggccaccccaaatggagatgtgctgatccgggacctgaactttgaggtgcgcagcggggccaacgtgctgatctgtggccccaacggctgtgggaagagcagcctcttccgggtgctgggggagctgtggcccctgtttggaggccgcctgaccaagccagagcggggcaagctgttctacgtgccccagaggccctacatgaccctgggcaccctgcgggaccaggtgatctacccagatggaagagaggaccagaagaggaagggcatcagtgacctggtgctgaaggagtacctggacaacgtgcagctgggccacatcctggagcgggagggcggctgggacagcgtgcaggactggatggatgtgctgtctggaggagagaagcagaggatggccatggcccggctcttctaccacaagccccagtttgccatcctggatgaatgtaccagcgctgtgtctgtggatgtggagggctacatctacagccactgcaggaaggtgggcatcaccctcttcaccgtgagccacaggaagagcctgtggaagcaccacgagtactacctgcacatggatggccggggcaactatgagttcaagcagatcacagaagatactgtggagtttggcagctag

SEQ ID NO: 144647 - DNA, 1467 bp, Artificial Sequence
  Description of Artificial Sequence: Synthetic coding sequence
atgctgattgtgctgaacagcaccctgaagagctttgaccagttcacctgcaacctgctgtatgtgtcctggaggaaggacctgacagagcacctgcaccggctgtacttccggggccgggcctactacaccctgaatgtgctgagagatgacatcgacaacccagaccagaggatcagccaggatgtggagcgcttctgccggcagctgagctccatggccagcaagctgatcatcagccccttcaccctggtgtactacacctaccagtgcttccagagcacaggctggctgggccctgtgtccatcttcggctacttcatcctgggcaccgtggtgaacaagaccctgatgggccccatcgtgatgaagctggtgcaccaggagaagctggagggggacttccgggccggccacgtggagcacatgaggacagaccggcggctgcagaggctgctgcagacccagcgggagctgatgagcaaggagctgtggctgtacatcggcatcaacacctttgactacctgggcagcatcctgtcctatgtggtgattgccatccccatcttctctggagtgtatggagacctgagccctgctgagctgagcaccctggtgtccaagaatgcctttgtgtgcatctacctgatcagctgcttcacccagctgattgacctgagcaccaccctgagtgatgtggccggctacacccaccgcatcggccagctgcgggagaccctgctggacatgagcctgaagagccaggactgtgagatcctgggggagagcgagtggggcctggacaccccacctggctggccagctgctgagcctgctgacacagccttcctgctggagcgggtgtccatcagcgcccccagcagtgacaagcccctcatcaaggacctgagcctgaagatcagcgagggccagagcctgctgatcaccggcaacacaggaacaggcaagaccagcctgctgcgggtgctgggcggcctgtggaccagcacccggggctctgtgcagatgctgacagactttggcccccacggcgtgctcttcctgccccagaagcccttcttcacagatggcaccctgcgggagcaggtgatctaccccctgaaggaggtgtacccagattctggcagcgcagatgatgagcgcatcctgcgcttcctggagctggccggcctgagcaacctggtggccaggacagagggcctggaccagcaggtggactggaactggtatgatgtgctgagccctggagagatgcagaggctgagctttgcccggctcttctacctgcagcccaagtatgctgtgctggatgaggccaccagcgccctgacagaggaggtggagagcgagctgtacagaattggccagcagctgggcatgaccttcatctctgtgggccaccggcagagcctggagaaggtgcctgtgctgaccaggatggcctag

SEQ ID NO: 144648 - DNA, 1821 bp, Artificial Sequence
  Description of Artificial Sequence: Synthetic coding sequence
atggctgtggccggccctgcccctggggccggggcccggccccggctggacctgcagttcctgcagcgcttcctgcagatcctgaaggtgctcttccccagctggagcagccagaatgccctgatgttcctgaccctgctgtgcctgaccctgctggagcagtttgtgatctaccaggtgggcctcatccccagccagtactacggcgtgctgggcaacaaggacctggagggcttcaagaccctgaccttcctggccgtgatgctgattgtgctgaacagcaccctgaagagctttgaccagttcacctgcaacctgctgtatgtgtcctggaggaaggacctgacagagcacctgcaccggctgtacttccggggccgggcctactacaccctgaatgtgctgagagatgacatcgacaacccagaccagaggatcagccaggatgtggagcgcttctgccggcagctgagctccatggccagcaagctgatcatcagccccttcaccctggtgtactacacctaccagtgcttccagagcacaggctggctgggccctgtgtccatcttcggctacttcatcctgggcaccgtggtgaacaagaccctgatgggccccatcgtgatgaagctggtgcaccaggagaagctggagggggacttccgcttcaagcacatgcagatccgggtgaatgctgagcctgctgccttctacagagctggccacgtggagcacatgaggacagaccggcggctgcagaggctgctgcagacccagcgggagctgatgagcaaggagctgtggctgtacatcggcatcaacacctttgactacctgggcagcatcctgtcctatgtggtgattgccatccccatcttctctggagtgtatggagacctgagccctgctgagctgagcaccctggtgtccaagaatgcctttgtgtgcatctacctgatcagctgcttcacccagctgattgacctgagcaccaccctgagtgatgtggccggctacacccaccgcatcggccagctgcgggagaccctgctggacatgagcctgaagagccaggactgtgagatcctgggggagagcgagtggggcctggacaccccacctggctggccagctgctgagcctgctgacacagccttcctgctggagcgggtgtccatcagcgcccccagcagtgacaagcccctcatcaaggacctgagcctgaagatcagcgagggccagagcctgctgatcaccggcaacacaggaacaggcaagaccagcctgctgcgggtgctgggcggcctgtggaccagcacccggggctctgtgcagatgctgacagactttggcccccacggcgtgctcttcctgccccagaagcccttcttcacagatggcaccctgcgggagcaggtgatctaccccctgaaggaggtgtacccagattctggcagcgcagatgatgagcgcatcctgcgcttcctggagctggccggcctgagcaacctggtggccaggacagagggcctggaccagcaggtggactggaactggtatgatgtgctgagccctggagagatgcagaggctgagctttgcccggctcttctacctgcagcccaagtatgctgtgctggatgaggccaccagcgccctgacagaggaggtggagagcgagctgtacagaattggccagcagctgggcatgaccttcatctctgtgggccaccggcagagcctggagaagttccacagcctggtgctgaagctgtgtggcggcggccgctgggagctgatgaggatcaaggtggagtag

SEQ ID NO: 144649 - DNA, 297 bp, Artificial Sequence
  Description of Artificial Sequence: Synthetic coding sequence
atgaggagcctgctgctgagcacagtgggcatcaacacctttgactacctgggcagcatcctgtcctatgtggtgattgccatccccatcttcagcggcgtgtatggagacctgagccctgctgagctgagcaccctggtgtccaagaatgcctttgtgtgcatctacctgatcagctgcttcacccagctgattgacctgagcaccaccctgagtgatgtggccggctacacccacagaattggccagctgcgggagaccctgctggacatgagcctgaagagccaggactgctag

SEQ ID NO: 144650 - DNA, 1800 bp, Artificial Sequence
  Description of Artificial Sequence: Synthetic coding sequence
atggctgacaagctgacccgcatcgccatcgtgaaccacgacaagtgcaagcccaagaagtgccggcaggagtgcaagaagagctgccctgtggtgaggatgggcaagctgtgcatcgaggtgaccccccagagcaagatcgcctggatcagcgagaccctgtgcatcggctgcggcatctgcatcaagaagtgcccctttggagccctgagcatcgtgaacctgcccagcaacctggagaaggagaccacccaccgctactgtgccaatgccttcaagctgcaccggctgcccatccccaggcctggagaggtgctgggcctggtgggcaccaacggcatcggcaagagcacagccctgaagatcctggccggcaagcagaagcccaacctgggcaagtatgatgatcctccagactggcaggagatcctgacctacttccggggcagcgagctgcagaactacttcaccaagatcctggaggatgacctgaaggccatcatcaagccccagtatgtggaccagatccccaaggccgccaagggcaccgtgggcagcatcctggacaggaaggatgagaccaagacccaggccatcgtgtgccagcagctggacctgacccacctgaaggagagaaatgtggaggacctgagcggcggggagctgcagagatttgcctgtgctgtggtgtgcatccagaaggctgacatcttcatgtttgatgagcccagcagctacctggatgtgaagcagaggctgaaggccgccatcaccatccgcagcctcatcaacccagaccgctacatcatcgtggtggagcatgacctgtctgtgctggactacctgagtgacttcatctgctgcctgtatggagtgcccagcgcctacggcgtggtgaccatgcccttctctgtgcgggagggcatcaacatcttcctggatggctacgtgcccacagagaacctgcgcttcagagatgccagcctggtgttcaaggtggccgagacagccaatgaggaggaggtgaagaagatgtgcatgtacaagtacccaggcatgaagaagaagatgggagaatttgagctggccatcgtggccggggagttcacagacagcgagatcatggtgatgctgggggagaatggaacaggcaagaccaccttcatccgcatgctggccggccgcctgaagccagatgaaggaggagaggtgcctgtgctgaatgtgtcctacaagccccagaagatcagccccaagagcactggatctgtgcggcagctgctgcacgagaagatcagagatgcctacacccacccccagtttgtgacagatgtgatgaagcccctgcagatcgagaacatcatcgaccaggaggtgcagaccctgtctggaggagagctgcagagggtggccctggccctgtgcctgggcaagccagcagatgtgtacctgattgatgagcccagcgcctacctggacagcgagcagaggctgatggccgcccgggtggtgaagcgcttcatcctgcacgccaagaagacagcctttgtggtggagcatgacttcatcatggccacctacctggccgacagagtgattgtgtttgatggagtgcccagcaagaacacagtggccaacagcccccagaccctgctggccggcatgaacaagttcctgagccagctggagatcaccttcagaagagaccccaacaactaccggccccgcatcaacaagctgaacagcatcaaggatgtggagcagaagaagagcggcaactacttcttcctggatgactag

SEQ ID NO: 144651 - DNA, 633 bp, Artificial Sequence
  Description of Artificial Sequence: Synthetic coding sequence
atggctgacaagctgacccgcatcgccatcgtgaaccacgacaagtgcaagcccaagaagtgccggcaggagtgcaagaagagctgccctgtggtgaggatgggcaagctgtgcatcgaggtgaccccccagagcaagatcgcctggatcagcgagaccctgtgcatcggctgcggcatctgcatcaagaagtgcccctttggagccctgagcatcgtgaacctgcccagcaacctggagaaggagaccacccaccgctactgtgccaatgccttcaagctgcaccggctgcccatccccaggcctggagaggtgctgggcctggtgggcaccaacggcatcggcaagagcacagccctgaagatcctggccggcaagcagaagcccaacctgggcaagtatgatgatcctccagactggcaggagatcctgacctacttccggggcagcgagctgcagaactacttcaccaagatcctggaggatgacctgaaggccatcatcaagccccagtatgtggaccagatccccaaggccgccaagggcaccgtgggcagcatcctggacaggaaggatgagaccaagacccaggccatcgtgtgccagcagctggacctgacccacctgaagtag

SEQ ID NO: 144652 - DNA, 2538 bp, Artificial Sequence
  Description of Artificial Sequence: Synthetic coding sequence
atgcccaaggcccccaagcagcagcccccagagcctgagtggattggagatggagagagcaccagccccagcgacaaggtggtgaagaagggcaagaaggacaagaagatcaagaagaccttctttgaggagctggccgtggaggacaagcaggccggggaggaggagaaggtgctgaaggagaaggagcagcagcagcagcagcagcagcagcagcagaagaagaagagggacaccaggaaaggaagaaggaagaaggatgtggatgatgatggagaggagaaggagctgatggagcggctgaagaagctgtctgtgcccaccagtgatgaggaggatgaggtgcctgcccccaagccccggggcggcaagaagaccaagggcggcaatgtgtttgctgccctgatccaggaccagagcgaggaggaggaggaggaggagaagcacccccccaagccagccaagccagagaagaaccgcatcaacaaggctgtgtctgaggagcagcagcctgccctgaagggcaagaagggcaaggaggagaagagcaagggcaaggccaagccccagaacaagtttgctgccctggacaatgaggaggaggacaaggaggaggagatcatcaaggagaaggagccccccaagcagggcaaggagaaggccaagaaggccgagcagggcagcgaggaggagggggagggggaggaggaggaggaggagggcggggagagcaaggcagatgacccctatgcccacctgagcaagaaggagaagaagaagctgaagaagcagatggagtatgagcggcaggtggccagcctgaaggccgccaatgctgctgaaaatgacttctctgtgtcccaggccgagatgagcagccggcaggccatgctggagaatgccagtgacatcaagctggagaagttcagcatcagcgcccacggcaaggagctgtttgtgaatgctgacctgtacatcgtggccggccgccgctatggcctggtgggccccaacgggaagggcaagaccaccctgctgaagcacatcgccaacagagccctgagcatcccccccaacattgatgtgctgctgtgtgagcaggaggtggtggctgatgagaccccagctgtgcaggccgtgctgcgggctgacaccaagaggctgaagctgctggaggaggagcggcggctgcagggccagctggagcagggagatgacacagctgctgagcggctggagaaggtgtatgaggagctgcgggccaccggggctgctgctgctgaggccaaggcccggcgcatcctggccggcctgggctttgatcctgagatgcagaaccggcccacccagaagttcagcggcggctggaggatgagggtgtccctggcccgggccctcttcatggagcccaccctgctgatgctggatgagcccaccaaccacctggacctgaatgctgtgatctggctgaacaactacctgcagggctggaggaagaccctgctgattgtgtcccatgaccagggcttcctggatgatgtgtgcacagacatcatccacctggatgcccagaggctgcactactaccggggcaactacatgaccttcaagaagatgtaccagcagaagcagaaggagctgctgaagcagtatgagaagcaggagaagaagctgaaggagctgaaggccggcggcaagagcaccaagcaggccgagaagcagaccaaggaggccctgaccaggaagcagcagaagtgcaggaggaagaaccaggatgaggagagccaggaggcccctgagctgctgaagaggcccaaggagtacacagtgcgcttcaccttcccagaccccccacccctgagcccccctgtgctgggcctgcacggcgtgaccttcggctaccagggccagaagcccctcttcaagaacctggactttggcatcgacatggacagccgcatctgcatcgtgggccccaacggggtgggcaagagcaccctgctgctgctgctgaccgggaagctgacccccacccatggagagatgaggaagaaccaccggctgaagattggcttcttcaaccagcagtatgcagagcagctgaggatggaggagacccccacagagtacctgcagaggggcttcaacctgccctaccaggatgccaggaagtgcctgggccgcttcggcctggagagccacgcccacaccatccagatctgcaagctgagcggcggccagaaggcccgggtggtgtttgctgagctggcctgccgggagccagatgtgctgatcctggatgagcccaccaacaacctggacatcgagagcattgatgccctgggggaggccatcaatgagtacaagggagctgtgattgtggtgtcccatgatgcccggctcatcacagagaccaactgccagctgtgggtggtggaggagcagagcgtgtcccagattgatggagactttgaggactacaagcgggaggtgctggaggccctgggggaggtgatggtgtcccggccccgggagtag

SEQ ID NO: 144653 - DNA, 2424 bp, Artificial Sequence
  Description of Artificial Sequence: Synthetic coding sequence
atgcccaaggcccccaagcagcagcccccagagcctgagtggattggagatggagagagcaccagccccagcgacaaggtggtgaagaagggcaagaaggacaagaagatcaagaagaccttctttgaggagctggccgtggaggacaagcaggccggggaggaggagaaggtgctgaaggagaaggagcagcagcagcagcagcagcagcagcagcagaagaagaagagggacaccaggaaaggaagaaggaagaaggatgtggatgatgatggagaggagaaggagctgatggagcggctgaagaagctgtctgtgcccaccagtgatgaggaggatgaggtgcctgcccccaagccccggggcggcaagaagaccaagggcggcaatgtgtttgctgccctgatccaggaccagagcgaggaggaggaggaggaggagaagcacccccccaagccagccaagccagagaagaaccgcatcaacaaggctgtgtctgaggagcagcagcctgccctgaagggcaagaagggcaaggaggagaagagcaagggcaaggccaagccccagaacaagtttgctgccctggacaatgaggaggaggacaaggaggaggagatcatcaaggagaaggagccccccaagcagggcaaggagaaggccaagaaggccgagcagatggagtatgagcggcaggtggccagcctgaaggccgccaatgctgctgaaaatgacttctctgtgtcccaggccgagatgagcagccggcaggccatgctggagaatgccagtgacatcaagctggagaagttcagcatcagcgcccacggcaaggagctgtttgtgaatgctgacctgtacatcgtggccggccgccgctatggcctggtgggccccaacgggaagggcaagaccaccctgctgaagcacatcgccaacagagccctgagcatcccccccaacattgatgtgctgctgtgtgagcaggaggtggtggctgatgagaccccagctgtgcaggccgtgctgcgggctgacaccaagaggctgaagctgctggaggaggagcggcggctgcagggccagctggagcagggagatgacacagctgctgagcggctggagaaggtgtatgaggagctgcgggccaccggggctgctgctgctgaggccaaggcccggcgcatcctggccggcctgggctttgatcctgagatgcagaaccggcccacccagaagttcagcggcggctggaggatgagggtgtccctggcccgggccctcttcatggagcccaccctgctgatgctggatgagcccaccaaccacctggacctgaatgctgtgatctggctgaacaactacctgcagggctggaggaagaccctgctgattgtgtcccatgaccagggcttcctggatgatgtgtgcacagacatcatccacctggatgcccagaggctgcactactaccggggcaactacatgaccttcaagaagatgtaccagcagaagcagaaggagctgctgaagcagtatgagaagcaggagaagaagctgaaggagctgaaggccggcggcaagagcaccaagcaggccgagaagcagaccaaggaggccctgaccaggaagcagcagaagtgcaggaggaagaaccaggatgaggagagccaggaggcccctgagctgctgaagaggcccaaggagtacacagtgcgcttcaccttcccagaccccccacccctgagcccccctgtgctgggcctgcacggcgtgaccttcggctaccagggccagaagcccctcttcaagaacctggactttggcatcgacatggacagccgcatctgcatcgtgggccccaacggggtgggcaagagcaccctgctgctgctgctgaccgggaagctgacccccacccatggagagatgaggaagaaccaccggctgaagattggcttcttcaaccagcagtatgcagagcagctgaggatggaggagacccccacagagtacctgcagaggggcttcaacctgccctaccaggatgccaggaagtgcctgggccgcttcggcctggagagccacgcccacaccatccagatctgcaagctgagcggcggccagaaggcccgggtggtgtttgctgagctggcctgccgggagccagatgtgctgatcctggatgagcccaccaacaacctggacatcgagagcattgatgccctgggggaggccatcaatgagtacaagggagctgtgattgtggtgtcccatgatgcccggctcatcacagagaccaactgccagctgtgggtggtggaggagcagagcgtgtcccagattgatggagactttgaggactacaagcgggaggtgctggaggccctgggggaggtgatggtgtcccggccccgggagtag

SEQ ID NO: 144654 - DNA, 2424 bp, Artificial Sequence; identical to SEQ ID NO: 144653
  Description of Artificial Sequence: Synthetic coding sequence

SEQ ID NO: 144655 - DNA, 2538 bp, Artificial Sequence; identical to SEQ ID NO: 144652
  Description of Artificial Sequence: Synthetic coding sequence

SEQ ID NO: 144656 - DNA, 717 bp, Artificial Sequence
  Description of Artificial Sequence: Synthetic coding sequence
atgcccaaggcccccaagcagcagcccccagagcctgagtggattggagatggagagagcaccagccccagcgacaaggtggtgaagaagggcaagaaggacaagaagatcaagaagaccttctttgaggagctggccgtggaggacaagcaggccggggaggaggagaaggtgctgaaggagaaggagcagcagcagcagcagcagcagcagcagcagaagaagaagagggacaccaggaaaggaagaaggaagaaggatgtggatgatgatggagaggagaaggagctgatggagcggctgaagaagctgagccggggcttcaacctgccctaccaggatgccaggaagtgcctgggccgcttcggcctggagagccacgcccacaccatccagatctgcaagctgagcggcggccagaaggcccgggtggtgtttgctgagctggcctgccgggagccagatgtgctgatcctggatgagcccaccaacaacctggacatcgagagcattgatgccctgggggaggccatcaatgagtacaagggggccgtcatcgtggtgtcccatgatgcccggctcatcacagagaccaactgccagctgtgggtggtggaggagcagagcgtgtcccagattgatggagactttgaggactacaagcgggaggtgctggaggccctgggggaggtgatggtgtcccggccccgggagtag

SEQ ID NO: 144657 - DNA, 2424 bp, Artificial Sequence; identical to SEQ ID NO: 144653
  Description of Artificial Sequence: Synthetic coding sequence

SEQ ID NO: 144658 - DNA, 717 bp, Artificial Sequence; identical to SEQ ID NO: 144656
  Description of Artificial Sequence: Synthetic coding sequence

SEQ ID NO: 144659 - DNA, 1023 bp, Artificial Sequence
  Description of Artificial Sequence: Synthetic coding sequence
atgcccaaggcccccaagcagcagcccccagagcctgagtggattggagatggagagagcaccagccccagcgacaaggtggtgaagaagggcaagaaggacaagaagatcaagaagaccttctttgaggagctggccgtggaggacaagcaggccggggaggaggagaaggtgctgaaggagaaggagcagcagcagcagcagcagcagcagcagcagcagaagaagaagagggacaccaggaagggccgcaggaagaaggatgtggatgatgatggagaggagaaggagctgatggagcggctgaagaagctgtctgtgcccaccagtgatgaagaagatgaggtgcctgcccccaagccccggggcggcaagaagaccaagggcggcaatgtgtttgctgccctgatccaggaccagagcgaggaggaggaggaggaggagaagcacccccccaagccagccaagccagagaagaaccgcatcaacaaggctgtgtctgaggagcagcagcctgccctgaagggcaagaagggcaaggaggagaagagcaagggcaaggccaagccccagaacaagtttgctgccctggacaatgaggaggaggacaaggaggaggagatcatcaaggagaaggagccccccaagcagggcaaggagaaggccaagaaggccgagcagggcagcgaggaggagggggagggggaggaggaggaggaggagggcggggagagcaaggcagatgacccctatgcccacctgagcaagaaggagaagaagaagctgaagaagcagatggagtatgaaaggcaggtggccagcctgaaggccgccaatgctgctgaaaatgacttctctgtgtcccaggccgagatgagcagccggcaggccatgctggagaatgccagtgacatcaagctggagaagttcagcatcagcgcccacggcaaggagctgtttgtgaatgctgacctgtacatcgtggccggcagaagatatggcctggtgggccccaatggatag

SEQ ID NO: 144660 - DNA, 2538 bp, Artificial Sequence; identical to SEQ ID NO: 144652
  Description of Artificial Sequence: Synthetic coding sequence

SEQ ID NO: 144661 - DNA, 2424 bp, Artificial Sequence; identical to SEQ ID NO: 144653
  Description of Artificial Sequence: Synthetic coding sequence

SEQ ID NO: 144662 - DNA, 2424 bp, Artificial Sequence; identical to SEQ ID NO: 144653
  Description of Artificial Sequence: Synthetic coding sequence

SEQ ID NO: 144663 - DNA, 717 bp, Artificial Sequence; identical to SEQ ID NO: 144656
  Description of Artificial Sequence: Synthetic coding sequence

SEQ ID NO: 144664 - DNA, 1023 bp, Artificial Sequence; identical to SEQ ID NO: 144659
  Description of Artificial Sequence: Synthetic coding sequence

SEQ ID NO: 144665 - DNA, 2538 bp, Artificial Sequence; identical to SEQ ID NO: 144652
  Description of Artificial Sequence: Synthetic coding sequence

SEQ ID NO: 144666 - DNA, 1023 bp, Artificial Sequence; identical to SEQ ID NO: 144659
  Description of Artificial Sequence: Synthetic coding sequence

SEQ ID NO: 144667 - DNA, 2538 bp, Artificial Sequence; identical to SEQ ID NO: 144652
  Description of Artificial Sequence: Synthetic coding sequence

SEQ ID NO: 144668 - DNA, 1023 bp, Artificial Sequence; identical to SEQ ID NO: 144659
  Description of Artificial Sequence: Synthetic coding sequence

SEQ ID NO: 144669 - DNA, 1023 bp, Artificial Sequence; identical to SEQ ID NO: 144659
  Description of Artificial Sequence: Synthetic coding sequence

SEQ ID NO: 144670 - DNA, 1023 bp, Artificial Sequence; identical to SEQ ID NO: 144659
  Description of Artificial Sequence: Synthetic coding sequence

SEQ ID NO: 144671 - DNA, 1023 bp, Artificial Sequence; identical to SEQ ID NO: 144659
  Description of Artificial Sequence: Synthetic coding sequence

SEQ ID NO: 144672 - DNA, 2424 bp, Artificial Sequence; identical to SEQ ID NO: 144653
  Description of Artificial Sequence: Synthetic coding sequence

SEQ ID NO: 144673 - DNA, 2424 bp, Artificial Sequence; identical to SEQ ID NO: 144653
  Description of Artificial Sequence: Synthetic coding sequence

SEQ ID NO: 144674 - DNA, 717 bp, Artificial Sequence; identical to SEQ ID NO: 144656
  Description of Artificial Sequence: Synthetic coding sequence

SEQ ID NO: 144675 - DNA, 1602 bp, Artificial Sequence
  Description of Artificial Sequence: Synthetic coding sequence
atgcccaaggcccccaagcagcagcccccagagcctgagtggattggagatggagagagcaccagccccagcgacaaggtggtgaagaagggcaagaaggacaagaagatcaagaagaccttctttgaggagctggccgtggaggacaagcaggccggggaggaggagaaggtgctgaaggagaaggagcagcagcagcagcagcagcagcagcagcagcagaagaagaagagggacaccaggaagggccgcaggaagaaggatgtggatgatgatggagaggagaaggagctgatggagcggctgaagaagctgtctgtgcccaccagtgatgaagaagatgaggtgcctgcccccaagccccggggcggcaagaagaccaagggcggcaatgtgtttgctgccctgatccaggaccagagcgaggaggaggaggaggaggagaagcacccccccaagccagccaagccagagaagaaccgcatcaacaaggctgtgtctgaggagcagcagcctgccctgaagggcaagaagggcaaggaggagaagagcaagggcaaggccaagccccagaacaagtttgctgccctggacaatgaggaggaggacaaggaggaggagatcatcaaggagaaggagccccccaagcagggcaaggagaaggccaagaaggccgagcagggcagcgaggaggagggggagggggaggaggaggaggaggagggcggggagagcaaggcagatgacccctatgcccacctgagcaagaaggagaagaagaagctgaagaagcagatggagtatgaaaggcaggtggccagcctgaaggccgccaatgctgctgaaaatgacttctctgtgtcccaggccgagatgagcagccggcaggccatgctggagaatgccagtgacatcaagctggagaagttcagcatcagcgcccacggcaaggagctgtttgtgaatgctgacctgtacatcgtggccggcagaagatatggcctggtgggccccaacgggaagggcaagaccaccctgctgaagcacatcgccaacagagccctgagcatcccccccaacattgatgtgctgctgtgtgagcaggaggtggtggctgatgagaccccagctgtgcaggccgtgctgagagatgacacagctgctgagcggctggagaaggtgtatgaggagctgcgggccactggagctgctgctgctgaggccaaggcccggcgcatcctggccggcctgggctttgatcctgagatgcagaaccggcccacccagaagttcagcggcggctggaggatgagggtgtccctggcccgggccctcttcatggagcccaccctgctgatgctggatgagcccaccaacaacctggacatcgagagcattgatgccctgggggaggccatcaatgagtacaagggagctgtgattgtggtgtcccatgatgcccggctcatcacagagaccaactgccagctgtgggtggtggaggagcagagcgtgtcccagattgatggagactttgaggactacaagcgggaggtgctggaggccctgggggaggtgatggtgtcccggccccgggagtag

SEQ ID NO: 144676 - DNA, 717 bp, Artificial Sequence; identical to SEQ ID NO: 144656
  Description of Artificial Sequence: Synthetic coding sequence

SEQ ID NO: 144677 - DNA, 2538 bp, Artificial Sequence; identical to SEQ ID NO: 144652
  Description of Artificial Sequence: Synthetic coding sequence

SEQ ID NO: 144678 - DNA, 2538 bp, Artificial Sequence; identical to SEQ ID NO: 144652
  Description of Artificial Sequence: Synthetic coding sequence

SEQ ID NO: 144679 - DNA, 717 bp, Artificial Sequence; identical to SEQ ID NO: 144656
  Description of Artificial Sequence: Synthetic coding sequence

SEQ ID NO: 144680 - DNA, 1602 bp, Artificial Sequence; identical to SEQ ID NO: 144675
  Description of Artificial Sequence: Synthetic coding sequence

SEQ ID NO: 144681 - DNA, 1599 bp, Artificial Sequence
  Description of Artificial Sequence: Synthetic coding sequence
atgcccaaggcccccaagcagcagcccccagagcctgagtggattggagatggagagagcaccagccccagcgacaaggtggtgaagaagggcaagaaggacaagaagatcaagaagaccttctttgaggagctggccgtggaggacaagcaggccggggaggaggagaaggtgctgaaggagaaggagcagcagcagcagcagcagcagcagcagcagaagaagaagagggacaccaggaaaggaagaaggaagaaggatgtggatgatgatggagaggagaaggagctgatggagcggctgaagaagctgtctgtgcccaccagtgatgaggaggatgaggtgcctgcccccaagccccggggcggcaagaagaccaagggcggcaatgtgtttgctgccctgatccaggaccagagcgaggaggaggaggaggaggagaagcacccccccaagccagccaagccagagaagaaccgcatcaacaaggctgtgtctgaggagcagcagcctgccctgaagggcaagaagggcaaggaggagaagagcaagggcaaggccaagccccagaacaagtttgctgccctggacaatgaggaggaggacaaggaggaggagatcatcaaggagaaggagccccccaagcagggcaaggagaaggccaagaaggccgagcagggcagcgaggaggagggggagggggaggaggaggaggaggagggcggggagagcaaggcagatgacccctatgcccacctgagcaagaaggagaagaagaagctgaagaagcagatggagtatgagcggcaggtggccagcctgaaggccgccaatgctgctgaaaatgacttctctgtgtcccaggccgagatgagcagccggcaggccatgctggagaatgccagtgacatcaagctggagaagttcagcatcagcgcccacggcaaggagctgtttgtgaatgctgacctgtacatcgtggccggccgccgctatggcctggtgggccccaacgggaagggcaagaccaccctgctgaagcacatcgccaacagagccctgagcatcccccccaacattgatgtgctgctgtgtgagcaggaggtggtggctgatgagaccccagctgtgcaggccgtgctgagagatgacacagctgctgagcggctggagaaggtgtatgaggagctgcgggccaccggggctgctgctgctgaggccaaggcccggcgcatcctggccggcctgggctttgatcctgagatgcagaaccggcccacccagaagttcagcggcggctggaggatgagggtgtccctggcccgggccctcttcatggagcccaccctgctgatgctggatgagcccaccaacaacctggacatcgagagcattgatgccctgggggaggccatcaatgagtacaagggggccgtcatcgtggtgtcccatgatgcccggctcatcacagagaccaactgccagctgtgggtggtggaggagcagagcgtgtcccagattgatggagactttgaggactacaagcgggaggtgctggaggccctgggggaggtgatggtgtcccggccccgggagtag

SEQ ID NO: 144682 - DNA, 1599 bp, Artificial Sequence; identical to SEQ ID NO: 144681
  Description of Artificial Sequence: Synthetic coding sequence

SEQ ID NO: 144683 - DNA, 1599 bp, Artificial Sequence; identical to SEQ ID NO: 144681
  Description of Artificial Sequence: Synthetic coding sequence

SEQ ID NO: 144684 - DNA, 1599 bp, Artificial Sequence; identical to SEQ ID NO: 144681
  Description of Artificial Sequence: Synthetic coding sequence

SEQ ID NO: 144685 - DNA, 1602 bp, Artificial Sequence; identical to SEQ ID NO: 144675
  Description of Artificial Sequence: Synthetic coding sequence

SEQ ID NO: 144686 - DNA, 1515 bp, Artificial Sequence
  Description of Artificial Sequence: Synthetic coding sequence
atggacctgatccccaactttgccatggagacctgggtgctggtggccaccagcctggtgctgctgtacatctacggcacccacagccacaagctgttcaagaagctgggcatccctggccccacccccctgcccttcctgggcaccatcctcttctacctgcggggcctgtggaactttgacagagaatgtaatgagaagtacggggagatgtggggcctgtatgagggccagcagcccatgctggtgatcatggaccctgacatgatcaagacagtgctggtgaaggagtgctacagcgtcttcaccaaccagatgcccctgggccccatgggcttcctgaagagcgccctgagctttgctgaagatgaggagtggaagaggatccgcaccctgctgagccctgccttcacctctgtgaagttcaaggagatggtgcccatcatcagccagtgtggggacatgctggtgcgcagcctgcggcaggaggccgagaacagcaagagcatcaacctgaaggacttcttcggggcctacaccatggatgtgatcaccggcaccctgtttggagtgaacctggacagcctgaacaacccccaggaccccttcctgaagaacatgaagaagctgctgaagctggacttcctggaccccttcctgctgctgatcagcctcttccccttcctgacccctgtgtttgaggccctgaacatcggcctcttccccaaggatgtgacccacttcctgaagaacagcattgaaagaatgaaggagagccggctgaaggacaagcagaagcaccgggtggacttcttccagcagatgattgacagccagaacagcaaggagaccaagagccacaaggccctgagtgacctggagctggtggcccagagcatcatcatcatctttgctgcctatgacaccaccagcaccaccctgcccttcatcatgtatgagctggccacccacccagatgtgcagcagaagctgcaggaggagattgatgctgtgctgcccaacaaggcccctgtgacctatgatgccctggtgcagatggagtacctggacatggtggtgaatgagaccctgcggctcttccctgtggtgtcccgggtgaccagggtgtgcaagaaggacatcgagatcaacggggtcttcatccccaagggcctggccgtgatggtgcccatctatgccctgcaccacgaccccaagtactggacagagcctgagaagttctgcccagagagccgcttcagcaagaagaacaaggacagcattgacctgtaccgctacatcccctttggagctggccccaggaactgcatcggcatgagatttgccctgaccaacatcaagctggccgtcatccgggccctgcagaacttctccttcaagccctgcaaggagacccagatccccctgaagctggacaacctgcccatcctgcagcctgagaagcccatcgtgctgaaggtgcacctgagagatggcatcaccagcggcccctag

SEQ ID NO: 144687 - DNA, 1872 bp, Artificial Sequence
  Description of Artificial Sequence: Synthetic coding sequence
atgcccagcgacctggccaagaagaaggccgccaagaagaaggaggccgccaaggcccggcagaggcccaggaaaggacatgaagaaaatggagatgtggtgacagagccccaggtggccgagaagaatgaggccaacggccgggagaccacagaggtggacctgctgaccaaggagctggaggactttgagatgaagaaggctgctgcccgggctgtgactggagtgctggccagccaccccaacagcacagatgtgcacatcatcaacctgagcctgaccttccacggccaggagctgctgagtgacaccaagctggagctgaacagcggccgccgctatggcctgattggcctgaatggcatcggcaagtccatgctgctgagcgccatcggcaagcgggaggtgcccatccctgagcacatcgacatctaccacctgacccgggagatgccacccagcgacaagacccccctgcactgtgtgatggaggtggacacagagcgggccatgctggagaaggaggccgagcggctggcccatgaagatgctgaatgtgagaagctgatggagctgtatgagcggctggaggagctggatgctgacaaggccgagatgagggccagccgcatcctgcacggcctgggcttcaccccagccatgcagaggaagaagctgaaggacttcagcggcggctggaggatgagggtggccctggcccgggccctcttcatccggcccttcatgctgctgctggatgagcccaccaaccacctggacctggatgcctgtgtgtggctggaggaggagctgaagaccttcaagaggatcctggtgctggtgagccacagccaggacttcctgaatggagtgtgcaccaacatcatccacatgcacaacaagaagctgaagtactacacaggcaactatgaccagtatgtgaagacccggctggagctggaggagaaccagatgaagcgcttccactgggagcaggaccagatcgcccacatgaagaactacatcgccaggtttggacatggcagcgccaagctggcccggcaggcccagagcaaggagaagaccctgcagaagatgatggccagcggcctgacagagcgggtggtgtctgacaagaccctgtccttctacttccccccctgtgggaagatccccccacctgtgatcatggtgcagaatgtgtccttcaagtacaccaaggatggcccctgcatctacaacaacctggagtttggcatcgacctggacaccagggtggccctggtgggccccaacggggccggcaagagcaccctgctgaagctgctgaccggggagctgctgcccacagatggcatgatcaggaagcacagccacgtgaagattggccgctaccaccagcacctgcaggagcagctggacctggacctgagccccctggagtacatgatgaagtgctacccagagatcaaggagaaggaggagatgaggaagatcatcggccgctatggcctgaccgggaagcagcaggtgagccccatccggaacctgagtgatggccagaagtgccgggtgtgcctggcctggctggcctggcagaacccccacatgctgttcctggatgagcccaccaaccacctggacatcgagaccattgatgccctggctgatgccatcaatgaatttgagggcggcatgatgctggtgtcccatgacttccgcctcatccagcaggtggcccaggagatctgggtgtgtgagaagcagaccatcaccaagtggccaggggacatcctggcctacaaggagcacctgaagagcaagctggtggatgaggagccccagctgaccaagaggacccacaacgtgtag

SEQ ID NO: 144688 - DNA, 723 bp, Artificial Sequence
  Description of Artificial Sequence: Synthetic coding sequence
atgcccagcgacctggccaagaagaaggccgccaagaagaaggaggccgccaaggcccggcagaggcccaggaaaggacatgaagaaaatggagatgtggtgacagagccccaggtggccgagaagaatgaggccaacggccgggagaccacagaggtggacctgctgaccaaggagctggaggactttgagatgaagaaggctgctgcccgggctgtgactggagtgctggccagccaccccaacagcacagatgtgcacatcatcaacctgagcctgaccttccacggccaggagctgctgagtgacaccaagctggagctgaacagcggccgccgctatggcctgattggcctgaatggcatcggcaagtccatgctgctgagcgccatcggcaagcgggaggtgcccatccctgagcacatcgacatctaccacctgacccgggagatgccacccagcgacaagacccccctgcactgtgtgatggaggtggacacagagcgggccatgctggagaaggaggccgagcggctggcccatgaagatgctgaatgtgagaagctgatggagctgtatgagcggctggaggagctggatgctgacaaggccgagatgagggccagccgcatcctgcacggcctgggcttcaccccagccatgcagaggaagaagctgaaggacttcagcggcggctggaggatgagggtggccctggcctag

SEQ ID NO: 144689 - DNA, 867 bp, Artificial Sequence
  Description of Artificial Sequence: Synthetic coding sequence
atgcccagcgacctggccaagaagaaggccgccaagaagaaggaggccgccaaggcccggcagaggcccaggaaaggacatgaagaaaatggagatgtggtgacagagccccaggtggccgagaagaatgaggccaacggccgggagaccacagaggtggacctgctgaccaaggagctggaggactttgagatgaagaaggctgctgcccgggctgtgactggagtgctggccagccaccccaacagcacagatgtgcacatcatcaacctgagcctgaccttccacggccaggagctgctgagtgacaccaagctggagctgaacagcggccgccgctatggcctgattggcctgaatggcatcggcaagtccatgctgctgagcgccatcggcaagcgggaggtgcccatccctgagcacatcgacatctaccacctgacccgggagatgccacccagcgacaagacccccctgcactgtgtgatggaggtggacacagagcgggccatgctggagaaggaggccgagcggctggcccatgaagatgctgaatgtgagaagctgatggagctgtatgagcggctggaggagctggatgctgacaaggccgagatgagggccagccgcatcctgcacggcctgggcttcaccccagccatgcagaggaagaagctgaaggacttcagcggcggctggaggatgagggtggccctggcccgggccctcttcatccggcccttcatgctgctgctggatgagcccaccaaccacctggacctggatgcctgtgtgtggctggaggaggagctgaagaccttcaagaggatcctggtgctggtgagccacagccaggacttcctgtag

SEQ ID NO: 144690 - DNA, 2361 bp, Artificial Sequence
  Description of Artificial Sequence: Synthetic coding sequence
atggtgagaagaggctggagcgtgtgcacagccatcctgctggcccggctgtggtgcctggtgcccacccacaccttcctgtctgagtacccagaggccgctgagtacccccaccctggctgggtgtactggctgcagatggctgtggcccctggccacctgcgggcctgggtgatgaggaacaacgtgaccaccaacatccccagcgccttcagcggcaccctgacccatgaggagaaggctgtgctgaccgtcttcaccggcacagccacagctgtgcacgtgcaggtggccgccctggccagcgccaagctggagagctctgtgtttgtgacagactgtgtgtcctgcaagattgaaaatgtgtgtgacagcgccctgcagggcaagagggtgcccatgagcggcctgcagggcagcagcatcgtcatcatgccacccagcaaccggcccctgaaggccagcgctgccagctgcacctggagcgtgcaggtgcagggcggcccccaccacctgggcgtggtggccatcagcggcaaggtgctgtctgctgcccacggggccggccgggcctacggctggggcttccctggggaccccatggaggagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggcagaagagagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggtgaagcagaccaagaggctgaagggcctgaggaaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgagggcgtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctgattgcctactttgtgctgcgctacaagatccgggcagagaggtag

SEQ ID NO: 144691 - DNA, 2034 bp, Artificial Sequence
  Description of Artificial Sequence: Synthetic coding sequence
atgaggatcagcctgccccgggcccctgagagagatggcggcgtgtctgccagcagcctgctggacacagtgaccaatgccagcagctacagcgctgagatgacagagcccaagtctgtgtgtgtgtctgtggatgaggtggtgagcagcaacatggaggccacagaaacagacctgctgaatggccacctgaagaaggtggacaacaacctgacagaggcccagcgcttcagcagcctgccccggcgggctgctgtgaacatcgagttccgggacctgagctacagcgtgcctgagggcccctggtggaggaagaagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggccggcgggagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgaaggagtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctcatcgcctactttgtgctgcgctacaagatccgggcagagaggtag

SEQ ID NO: 144692 - DNA, 1992 bp, Artificial Sequence
  Description of Artificial Sequence: Synthetic coding sequence
atgatcatgaggctgccccagccccacggcaccaatgccagcagctacagcgctgagatgacagagcccaagtctgtgtgtgtgtctgtggatgaggtggtgagcagcaacatggaggccacagaaacagacctgctgaatggccacctgaagaaggtggacaacaacctgacagaggcccagcgcttcagcagcctgccccggcgggctgctgtgaacatcgagttccgggacctgagctacagcgtgcctgagggcccctggtggaggaagaagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggccggcgggagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgaaggagtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctcatcgcctactttgtgctgcgctacaagatccgggcagagaggtag

SEQ ID NO: 144693 - DNA, 2037 bp, Artificial Sequence
  Description of Artificial Sequence: Synthetic coding sequence
atggcctgcctgatggccgccttctctgtgggcacagccatgaatgccagcagctacagcgctgagatgacagagcccaagtctgtgtgtgtgtctgtggatgaggtggtgagcagcaacatggaggccacagaaacagacctgctgaatggccacctgaagaaggtggacaacaacctgacagaggcccagcgcttcagcagcctgcccaggagagctgctgtgaacatcgagttccgggacctgagctacagcgtgcctgagggcccctggtggaggaagaagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggcagaagagagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggtgaagcagaccaagaggctgaagggcctgaggaaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgagggcgtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctgattgcctactttgtgctgcgctacaagatccgggcagagaggtag

SEQ ID NO: 144694 - DNA, 2475 bp, Artificial Sequence
  Description of Artificial Sequence: Synthetic coding sequence
atgctggccgtgcagcagacagagcacctgcctgcctgccccccagcccggcgctggagcagcaacttctgcccagagagcacagagggcggccccagcctgctgggcctgcgggacatggtgcggcggggctggagcgtgtgcacagccatcctgctggcccggctgtggtgcctggtgcccacccacaccttcctgtctgagtacccagaggccgctgagtacccccaccctggctgggtgtactggctgcagatggctgtggcccctggccacctgcgggcctgggtgatgagaaataatgtgaccaccaacatccccagcgccttcagcggcaccctgacccatgaggagaaggctgtgctgactgtgttcaccggcacagccacagctgtgcacgtgcaggtggccgccctggccagcgccaagctggagagctctgtgtttgtgacagactgtgtgtcctgcaagattgaaaatgtgtgtgacagcgccctgcagggcaagagggtgcccatgagcggcctgcagggcagcagcatcgtcatcatgccacccagcaaccggcccctggccagcgctgccagctgcacctggagcgtgcaggtgcagggcggcccccaccacctgggcgtggtggccatcagcggcaaggtgctgtctgctgcccacggggccggccgggcctacggctggggcttccctggggaccccatggaggagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggcagaagagagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggtgaagcagaccaagaggctgaagggcctgaggaaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgagggcgtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctgattgcctactttgtgctgcgctacaagatccgggcagagaggtag

SEQ ID NO: 144695 - DNA, 2001 bp, Artificial Sequence
  Description of Artificial Sequence: Synthetic coding sequence
atggcctgcctgatggccgccttctctgtgggcacagccatgaatgccagcagctacagcgctgagatgacagagcccaagtctgtgtgtgtgtctgtggatgaggtggtgagcagcaacatggaggccacagaaacagacctgctgaatggccacctgaagaaggtggacaacaacctgacagaggcccagcgcttcagcagcctgcccaggagagctgctgtgaacatcgagttccgggacctgagctacagcgtgcctgagggcccctggtggaggaagaagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggcagaagagagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgagggcgtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctgattgcctactttgtgctgcgctacaagatccgggcagagaggtag

SEQ ID NO: 144696 - DNA, 2007 bp, Artificial Sequence
  Description of Artificial Sequence: Synthetic coding sequence
atgctgggcacccagggctggaccaagcagaggaagccctgcccccagaatgccagcagctacagcgctgagatgacagagcccaagtctgtgtgtgtgtctgtggatgaggtggtgagcagcaacatggaggccacagaaacagacctgctgaatggccacctgaagaaggtggacaacaacctgacagaggcccagcgcttcagcagcctgcccaggagagctgctgtgaacatcgagttccgggacctgagctacagcgtgcctgagggcccctggtggaggaagaagggctacaagaccctgctgaagggcatcagcggcaagttcaacagcggggagctggtggccatcatgggccccagcggggccggcaagagcaccctgatgaacatcctggccggctaccgggagaccggcatgaagggagctgtgctgatcaatggcctgccccgggacctgcgctgcttcaggaaggtgtcctgctacatcatgcaggatgacatgctgctgccccacctgactgtgcaggaggccatgatggtgtctgcccacctgaagctgcaggagaaggatgagggcagaagagagatggtgaaggagatcctgacagccctgggcctgctgagctgtgccaacaccaggacaggcagcctgagcggcggccagaggaagaggctggccatcgccctggagctggtgaacaacccccctgtgatgttctttgatgagcccaccagcggcctggacagcgccagctgcttccaggtggtgtccctgatgaagggcctggcccagggcggccgcagcatcatctgcaccatccaccagcccagcgccaagctgtttgagctgtttgaccagctgtatgtgctgagccagggccagtgtgtgtaccggggcaaggtgtgcaacctggtgccctacctgcgggacctgggcctgaactgccccacctaccacaacccagctgactttgtgatggaggtggccagcggggagtatggagaccagaacagccggctggtgcgggctgtgcgggagggcatgtgtgacagcgaccacaagagggacctgggcggagatgctgaggtgaaccccttcctgtggcaccggcccagcgaggaggacagcagctccatggagggctgccacagcttcagcgccagctgcctgacccagttctgcatcctcttcaagaggaccttcctgagcatcatgagggacagcgtgctgacccacctgcgcatcaccagccacatcggcatcggcctgctgattggcctgctgtacctgggcattggaaatgaggccaagaaggtgctgagcaacagcggcttcctgttcttctccatgctgttcctgatgtttgctgccctgatgcccaccgtgctgaccttccccctggagatgggcgtcttcctgcgggagcacctgaactactggtacagcctgaaggcctactacctggccaagaccatggctgatgtgcccttccagatcatgtttcctgtggcctactgcagcatcgtgtactggatgaccagccagcccagtgatgctgtgcgctttgtgctgtttgctgccctgggcaccatgaccagcctggtggcccagagcctgggcctgctgattggagctgccagcaccagcctgcaggtggccacctttgtgggccctgtgacagccatccctgtgctgctcttcagcggcttctttgtgtcctttgacaccatccccacctacctgcagtggatgagctacatctcctatgtgcgctatggctttgagggcgtcatcctgagcatctacggcctggaccgggaggacctgcactgtgacattgatgagacctgccacttccagaagtctgaggccatcctgcgggagctggatgtggagaatgccaagctgtacctggacttcatcgtgctgggcatcttcttcatcagcctgcggctgattgcctactttgtgctgcgctacaagatccgggcagagaggtag

SEQ ID NO: 144697 - DNA, 1941 bp, Artificial Sequence
  Description of Artificial Sequence: Synthetic coding sequence
atggccgagaaggccctggaggccgtgggctgcggcctgggccctggagctgtggccatggctgtgaccctggaggatggagctgagccccctgtgctgaccacccacctgaagaaggtggagaaccacatcacagaggcccagcgcttcagccacctgcccaagaggtctgctgtggacattgaatttgtggagctgagctacagcgtgcgggagggcccctgctggaggaagaggggctacaagaccctgctgaagtgcctgagcggcaagttctgccggcgggagctgattggcatcatgggccccagcggggccggcaagagcaccttcatgaacatcctggccggctaccgggagagcggcatgaagggccagatcctggtgaatggccggccccgggagctgcggaccttcaggaagatgagctgctacatcatgcaggatgacatgctgctgccccacctgactgtgctggaggccatgatggtgtctgccaacctgaagctgtctgagaagcaggaggtgaagaaggagctggtgacagagatcctgacagccctgggcctgatgagctgcagccacaccaggacagccctgctgagcggcggccagaggaagaggctggccatcgccctggagctggtgaacaacccccctgtgatgttctttgatgagcccaccagcggcctggacagcgccagctgcttccaggtggtgtccctgatgaagagcctggcccagggcggccgcaccatcatctgcaccatccaccagcccagcgccaagctgtttgagatgtttgacaagctgtacatcctgagccagggccagtgcatcttcaagggcgtggtgaccaacctgatcccctacctgaagggcctgggcctgcactgccccacctaccacaacccagctgacttcatcatcgaggtggccagcggggagtatggagacctgaaccccatgctgttccgggctgtgcagaatggcctgtgtgccatggccgagaagaagagcagccctgagaagaatgaggtgcctgccccctgccccccctgccccccagaggtggaccccatcgagagccacacctttgccaccagcaccctgacccagttctgcatcctcttcaagaggaccttcctgagcatcctgcgggacacagtgctgacccacctgcgcttcatgagccacgtggtgattggagtgctgattggcctgctgtacctgcacatcggagatgatgccagcaaggtgttcaacaacacaggctgcctcttcttctccatgctgttcctgatgtttgctgccctgatgcccaccgtgctgaccttccccctggagatggctgtgttcatgagggagcacctgaactactggtacagcctgaaggcctactacctggccaagaccatggctgatgtgcccttccaggtggtgtgccctgtggtgtactgcagcatcgtgtactggatgacaggccagcctgctgagaccagccgcttcctgctcttcagcgccctggccacagccacagccctggtggcccagagcctgggcctgctgattggagctgccagcaacagcctgcaggtggccacctttgtgggccctgtgacagccatccctgtgctgctcttcagcggcttctttgtgtccttcaagaccatccccacctacctgcagtggagcagctacctgtcctatgtgcgctatggctttgaaggagtcatcctgaccatctacggcatggagcggggggacctgacctgcctggaggagcgctgccccttccgggagccccagagcatcctgcgggccctggatgtggaggatgccaagctgtacatggacttcctggtgctgggcatcttcttcctggccctgcggctgctggcctacctggtgctgcgctacagagtgaagtctgagaggtag

SEQ ID NO: 144698 - DNA, 1941 bp, Artificial Sequence; identical to SEQ ID NO: 144697
  Description of Artificial Sequence: Synthetic coding sequence

SEQ ID NO: 144699 - DNA, 1941 bp, Artificial Sequence; identical to SEQ ID NO: 144697
  Description of Artificial Sequence: Synthetic coding sequence

SEQ ID NO: 144700 - DNA, 1956 bp, Artificial Sequence
  Description of Artificial Sequence: Synthetic coding sequence
atgggagacctgagcagcctgaccccaggcggctccatgggcctgcaggtgaacagaggcagccagagcagcctggagggcgccccagccacagcccctgagccccacagcctgggcatcctgcacgccagctacagcgtgagccaccgggtgcggccctggtgggacatcaccagctgccggcagcagtggacccggcagatcctgaaggatgtgtccctgtatgtggagagcggccagatcatgtgcatcctgggcagcagcggcagcggcaagaccaccctgctggatgccatgagcggccgcctgggccgggccggcaccttcctgggggaggtgtatgtgaatggccgggccctgcggcgggagcagttccaggactgcttctcctatgtgctgcagagcgacaccctgctgagcagcctgactgtgcgggagaccctgcactacacagccctgctggccatcagaagaggcaaccctggcagcttccagaagaaggtggaggccgtgatggccgagctgagcctgagccacgtggccgaccggctgattggcaactacagcctgggcggcatcagcactggagagaggagaagagtgtccattgctgcccagctgctgcaggaccccaaggtgatgctgtttgatgagcccaccaccggcctggactgcatgacagccaaccagatcgtggtgctgctggtggagctggcccggaggaaccgcatcgtggtgctgaccatccaccagcccaggtctgagctgttccagctgtttgacaagatcgccatcctgagctttggagagctgatcttctgtggcaccccagctgagatgctggacttcttcaatgactgtggctacccctgcccagagcacagcaacccctttgacttctacatggacctgacctctgtggacacccagagcaaggagcgggagattgagaccagcaagagggtgcagatgattgaaagtgcctacaagaagagcgccatctgccacaagaccctgaagaacatcgagaggatgaagcacctgaagaccctgcccatggtgcccttcaagaccaaggacagccctggggtcttcagcaagctgggcgtgctgctgcggcgggtgaccaggaacctggtgaggaacaagctggccgtcatcacccggctgctgcagaacctgatcatgggcctcttcctgctcttctttgtgctgcgggtgcgcagcaatgtgctgaagggggccatccaggacagagtgggcctgctgtaccagtttgtgggcgccaccccctacacaggcatgctgaatgctgtgaacctcttccctgtgctgcgggctgtgtctgaccaggagagccaggacggcctgtaccagaagtggcagatgatgctggcctatgccctgcacgtgctgcccttctctgtggtggccaccatgatcttcagctctgtgtgctactggaccctgggcctgcaccctgaggtggccaggtttggctacttctctgctgccctgctggccccccacctgattggagagttcctgaccctggtgctgctgggcatcgtgcagaaccccaacatcgtgaacagcgtggtggccctgctgagcattgctggggtgctggtgggcagcggcttcctgaggaacatccaggagatgcccatccccttcaagatcatctcctacttcaccttccagaagtactgcagcgagatcctggtggtgaatgagttctacggcctgaacttcacctgtggcagcagcaatgtgtctgtgaccaccaaccccatgtgtgccttcacccagggcatccagttcatcgagaagacctgccctggggccaccagccgcttcaccatgaacttcctgatcctgtacagcttcatcccagccctggtgatcctgggcatcgtggtgttcaagatccgggaccacctgatcagcaggtag

SEQ ID NO: 144701 - DNA, 1443 bp, Artificial Sequence
  Description of Artificial Sequence: Synthetic coding sequence
atgtgcatcctgggcagcagcggcagcggcaagaccaccctgctggatgccatgagcggccgcctgggccgggccggcaccttcctgggggaggtgtatgtgaatggccgggccctgcggcgggagcagttccaggactgcttctcctatgtgctgcagagcgacaccctgctgagcagcctgactgtgcgggagaccctgcactacacagccctgctggccatccggcggggcaaccctggcagcttccagaagaaggtggaggccgtgatggccgagctgagcctgagccacgtggccgacaggctcatcggcaactacagcctgggcggcatcagcactggagagcggcggcgggtgtccattgctgcccagctgctgcaggaccccatggacctgacctctgtggacacccagagcaaggagcgggagattgagaccagcaagagggtgcagatgattgagagcgcctacaagaagagcgccatctgccacaagaccctgaagaacattgaaagaatgaagcacctgaagaccctgcccatggtgcccttcaagaccaaggacagccctggggtcttcagcaagctgggcgtgctgctgcggcgggtgaccaggaacctggtgaggaacaagctggccgtcatcacccggctgctgcagaacctgatcatgggcctcttcctgctcttctttgtgctgcgggtgcgcagcaatgtgctgaagggggccatccaggacagagtgggcctgctgtaccagtttgtgggcgccaccccctacacaggcatgctgaatgctgtgaacctcttccctgtgctgcgggctgtgtctgaccaggagagccaggacggcctgtaccagaagtggcagatgatgctggcctatgccctgcacgtgctgcccttctctgtggtggccaccatgatcttcagctctgtgtgctactggaccctgggcctgcaccctgaggtggcccgcttcggctacttctctgctgccctgctggccccccacctgattggagagttcctgaccctggtgctgctgggcatcgtgcagaaccccaacatcgtgaacagcgtggtggccctgctgagcattgctggggtgctggtgggcagcggcttcctgaggaacatccaggagatgcccatccccttcaagatcatctcctacttcaccttccagaagtactgcagcgagatcctggtggtgaatgagttctacggcctgaacttcacctgtggcagcagcaatgtgtctgtgaccaccaaccccatgtgtgccttcacccagggcatccagttcatcgagaagacctgccctggggccaccagccgcttcaccatgaacttcctgatcctgtacagcttcatcccagccctggtgatcctgggcatcgtggtgttcaagatccgggaccacctgatcagcaggtag

SEQ ID NO: 144702 - DNA, 771 bp, Artificial Sequence
  Description of Artificial Sequence: Synthetic coding sequence
atgggcctcttcctgctcttctttgtgctgcgggtgcgcagcaatgtgctgaagggggccatccaggacagagtgggcctgctgtaccagtttgtgggcgccaccccctacacaggcatgctgaatgctgtgaacctcttccctgtgctgcgggctgtgtctgaccaggagagccaggacggcctgtaccagaagtggcagatgatgctggcctatgccctgcacgtgctgcccttctctgtggtggccaccatgatcttcagctctgtgtgctactggaccctgggcctgcaccctgaggtggcccgcttcggctacttctctgctgccctgctggccccccacctgattggagagttcctgaccctggtgctgctgggcatcgtgcagaaccccaacatcgtgaacagcgtggtggccctgctgagcattgctggggtgctggtgggcagcggcttcctgaggaacatccaggagatgcccatccccttcaagatcatctcctacttcaccttccagaagtactgcagcgagatcctggtggtgaatgagttctacggcctgaacttcacctgtggcagcagcaatgtgtctgtgaccaccaaccccatgtgtgccttcacccagggcatccagttcatcgagaagacctgccctggggccaccagccgcttcaccatgaacttcctgatcctgtacagcttcatcccagccctggtgatcctgggcatcgtggtgttcaagatccgggaccacctgatcagcaggtag

SEQ ID NO: 144703 - DNA, 2022 bp, Artificial Sequence
  Description of Artificial Sequence: Synthetic coding sequence
atggccggcaaggctgctgaggagcggggcctgcccaagggggccaccccccaggacaccagcggcctgcaggacaggctcttcagcagcgagagtgacaacagcctgtacttcacctacagcggccagcccaacaccctggaggtgcgggacctgaactaccaggtggacctggccagccaggtgccctggtttgagcagctggcccagttcaagatgccctggaccagccccagctgccagaacagctgtgagctgggcatccagaacctgtccttcaaggtgcgcagcggccagatgctggccatcatcggcagcagcggctgcggccgggccagcctgctggatgtgatcaccggccggggccatggaggcaagatcaagagcggccagatctggatcaatggccagcccagcagcccccagctggtgaggaaatgtgtggcccacgtgcggcagcacaaccagctgctgcccaacctgactgtgcgggagaccctggccttcatcgcccagatgaggctgcccaggaccttcagccaggcccagagggacaagagggtggaggatgtgattgctgagctgcggctgcggcagtgtgccgacaccagggtgggcaacatgtatgtgcggggcctgagcggcggggagaggagaagagtgtccattggagtgcagctgctgtggaaccctggcatcctgatcctggatgagcccaccagcggcctggacagcttcaccgcccacaacctggtgaagaccctgagccggctggccaagggcaaccggctggtgctgatcagcctgcaccagcccaggagtgacatcttccggctgtttgacctggtgctgctgatgaccagcggcacccccatctacctgggcgccgcccagcacatggtgcagtacttcaccgccatcggctacccctgcccccgctacagcaacccagctgacttctacgtggacctgaccagcattgacagaagaagccgggagcaggagctggccacccgggagaaggcccagagcctggccgccctcttcctggagaaggtgcgggacctggatgacttcctgtggaaggccgagaccaaggacctggatgaggacacctgtgtggagagctctgtgacccccctggacaccaactgcctgcccagccccaccaagatgcctggagctgtgcagcagttcaccaccctcatccggcggcagatcagcaatgacttccgggacctgcccaccctgctgatccacggggctgaggcctgcctgatgtccatgaccatcggcttcctgtacttcggccacggcagcatccagctgtccttcatggacacagctgccctgctcttcatgattggagccctgatccccttcaacgtcatcctggatgtgatcagcaagtgctacagcgagcgggccatgctgtactatgagctggaggatggcctgtacaccaccggcccctacttctttgccaagatcctgggggagctgcctgagcactgtgcctacatcatcatctacggcatgcccacctactggctggccaacctgcggcccggcctgcagcccttcctgctgcacttcctgctggtgtggctggtggtgttctgctgccgcatcatggccctggccgccgccgccctgctgcccaccttccacatggccagcttcttcagcaatgccctgtacaacagcttctacctggccggcggcttcatgatcaacctgagcagcctgtggacagtgcctgcctggatcagcaaggtgtccttcctgcgctggtgctttgagggcctgatgaagatccagttcagcaggaggacctacaagatgcccctgggcaacctgaccatcgctgtgtctggggacaagatcctgtctgtgatggagctggacagctaccccctgtatgccatctacctgattgtcatcggcctgagcggcggcttcatggtgctgtactacgtgtccctgcgcttcatcaagcagaagcccagccaggactggtag

SEQ ID NO: 144704 - DNA, 2376 bp, Artificial Sequence
  Description of Artificial Sequence: Synthetic coding sequence
atggccggcaccagcgcccctggcagcaagagaagaagtgagcccccagccccccggcccggccccccacctggcaccggccacccccccagcaagagggcccggggcttctctgctgctgctgccccagaccctgatgacccctttggagcccacggggacttcaccgcagatgacctggaggagctggacaccctggccagccaggccctgagccagtgcccagctgctgccagagatgtgtccagtgaccacaaggtgcaccggctgctggatggcatgagcaagaaccccagcggcaagaaccgggagaccgtgcccatcaaggacaactttgagctggaggtgctgcaggcccagtacaaggagctgaaggagaagatgaaggtgatggaggaggaggtgctgatcaagaatggagagatcaagatcctgcgggacagcctgcaccagacagagagcgtgctggaggagcagaggaggagccacttcctgctggagcaggagaagacccaggccctgagtgacaaggagaaggagttcagcaagaagctgcagagcctgcagagcgagctgcagttcaaggatgctgagatgaatgagctgcggaccaagctgcagaccagcgagcgggccaacaagctggccgcccccagcgtgagccacgtgagccccaggaagaaccccagcgtggtgatcaagccagaggcctgcagcccccagtttgggaagaccagcttccccaccaaggagagcttcagcgccaacatgagcctgccccacccctgccagacagaaagtggctacaagcccctggtgggccgggaggacagcaagccccacagcctgcggggggacagcatcaagcaggaggaggcccagaagagctttgtggacagctggaggcagaggagcaacacccagggcagcatcctgatcaacctgctgctgaagcagcccctcatccctggcagcagcctgagcctgtgccacctgctgagcagcagcagcgagagccctgctggcacccccctgcagcccccaggcttcggcagcaccctggccggcatgagcggcctgcggaccaccggcagctatgatggcagcttcagcctgagcgccctgcgggaggcccagaacctggccttcaccggcctgaacctggtggccagaaatgaatgttccagagatggagaccctgctgagggcggcagaagagccttccccctgtgccagctgcccggggctgtgcacttcctgcccctggtgcagttcttcatcggcctgcactgccaggccctgcaggacctggccgccgccaagaggtctggggcccctggggacagccccacccacagcagctgtgtgagcagcggcgtggagaccaacccagaagattctgtgtgcatcctggagggcttctctgtgacagccctgagcatcctgcagcacctggtgtgccacagcggggctgtggtgtccctgctgctgagcggcgtgggcgctgacagcgctgctggggagggcaacagaagcctggtgcaccggctgagtgatggagacatgaccagcgccctgcggggcgtggctgatgaccagggccagcaccccctgctgaagatgctgctgcacctgctggccttcagcagcgctgccaccggccacctgcaggcctctgtgctgacccagtgcctgaaggtgctggtgaagctggccgagaacaccagctgtgacttcctgccccgcttccagtgtgtgttccaggtgctgcccaagtgcctgagccctgagacccccctgcccagcgtgctgctggccgtggagctgctgagcctgctggccgaccatgaccagctggccccccagctgtgcagccacagcgagggctgcctgctgctgctgctgtacatgtacatcaccagcaggccagacagagtggccctggagacccagtggctgcagctggagcaggaggtggtgtggctgctggccaagctgggcgtgcagagccccctgccccctgtgacaggcagcaactgccagtgcaatgtggaggtggtgcgggccctgactgtgatgctgcaccggcagtggctgactgtgcggcgggccggcggcccccccaggacagaccagcagaggagaacagtgcgctgcctgcgggacacagtgctgctgctgcacggcctgagccagaaggacaagctgttcatgatgcactgtgtggaggtgctgcaccagtttgaccaggtgatgcctggggtgtccatgctgatccggggcctgcctgatgtgacagactgtgaggaggccgccctggatgacctgtgtgccgctgagacagatgtggaggaccctgaggtggagtgtggctag

SEQ ID NO: 144705 - DNA, 2295 bp, Artificial Sequence
  Description of Artificial Sequence: Synthetic coding sequence
atggccggcaccagcgcccctggcagcaagagaagaagtgagcccccagccccccggcccggccccccacctggcaccggccacccccccagcaagagggcccggggcttctctgctgctgctgccccagaccctgatgacccctttggagcccacggggacttcaccgcagatgacctggaggagctggacaccctggccagccaggccctgagccagtgcccagctgctgccagagatgtgtccagtgaccacaaggtgcaccggctgctggatggcatgagcaagaaccccagcggcaagaaccgggagaccgtgcccatcaaggacaactttgagctggaggtgctgcaggcccagtacaaggagctgaaggagaagatgaaggtgatggaggaggaggtgctgatcaagaatggagagatcaagatcctgcgggacagcctgcaccagacagagagcgtgctggaggagcagaggaggagccacttcctgctggagcaggagaagacccaggccctgagtgacaaggagaaggagttcagcaagaagctgcagagcctgcagagcgagctgcagttcaaggatgctgagatgaatgagctgcggaccaagctgcagaccagcgagcgggccaacaagctggccgcccccagcgtgagccacgtgagccccaggaagaaccccagcgtggtgatcaagccagaggcctgcagcccccagtttgggaagaccagcttccccaccaaggagagcttcagcgccaacatgagcctgccccacccctgccagacagaaagtggctacaagcccctggtgggccgggaggacagcaagccccacagcctgcggggggacagcatcaagcaggaggaggcccagaagagctttgtggacagctggaggcagaggagcaacacccagggcagcatcctgatcaacctgctgctgaagcagcccctcatccctggcagcagcctgagcctgtgccacctgctgagcagcagcagcgagagccctgctggcacccccctgcagcccccaggcttcggcagcaccctggccggcatgagcggcctgcggaccaccggcagctatgatggcagcttcagcctgagcgccctgcgggaggcccagaacctggccttcaccggcctgaacctggtggccagaaatgaatgttccagagatggagaccctgctgagggcggcagaagagccttccccctgtgccagctgcccggggctgtgcacttcctgcccctggtgcagttcttcatcggcctgcactgccaggccctgcaggacctggccgccgccaagaggtctggggcccctggggacagccccacccacagcagctgtgtgagcagcggcgtggagaccaacccagaagattctgtgtgcatcctggagggcttctctgtgacagccctgagcatcctgcagcacctggtgtgccacagcggggctgtggtgtccctgctgctgagcggcgtgggcgctgacagcgctgctggggagggcaacagaagcctggtgcaccggctgagtgatggagacatgaccagcgccctgcggggcgtggctgatgaccagggccagcaccccctgctgaagatgctgctgcacctgctggccttcagcagcgctgccaccggccacctgcaggcctctgtgctgacccagtgcctgaaggtgctggtgaagctggccgagaacaccagctgtgacttcctgccccgcttccagtgtgtgttccaggtgctgcccaagtgcctgagccctgagacccccctgcccagcgtgctgctggccgtggagctgctgagcctgctggccgaccatgaccagctggccccccagctgtgcagccacagcgagggctgcctgctgctgctgctgtacatgtacatcaccagcaggccagacagagtggccctggagacccagtggctgcagctggagcaggaggtggtgcgggccctgactgtgatgctgcaccggcagtggctgactgtgagaagagctgggggcccccccaggacagaccagcagaggagaacagtgcgctgcctgcgggacacagtgctgctgctgcacggcctgagccagaaggacaagctgttcatgatgcactgtgtggaggtgctgcaccagtttgaccaggtgatgcctggggtgtccatgctgatccggggcctgcctgatgtgacagactgtgaggaggccgccctggatgacctgtgtgccgctgagacagatgtggaggaccctgaggtggagtgtggctag

SEQ ID NO: 144706 - DNA, 1995 bp, Artificial Sequence
  Description of Artificial Sequence: Synthetic coding sequence
atgaaggtgatggaggaggaggtgctgatcaagaatggagagatcaagatcctgcgggacagcctgcaccagacagaatctgtgctggaggagcagaggaggagccacttcctgctggagcaggagaagacccaggccctgagtgacaaggagaaggagttcagcaagaagctgcagagcctgcagagcgagctgcagttcaaggatgctgagatgaatgagctgcggaccaagctgcagaccagcgagcgggccaacaagctggccgcccccagcgtgagccacgtgagccccaggaagaaccccagcgtggtgatcaagccagaggcctgcagcccccagtttgggaagaccagcttccccaccaaggagagcttcagcgccaacatgagcctgccccacccctgccagacagagagcggctacaagcccctggtgggccgggaggacagcaagccccacagcctgcggggggacagcatcaagcaggaggaggcccagaagagctttgtggacagctggaggcagaggagcaacacccagggcagcatcctgatcaacctgctgctgaagcagcccctcatccctggcagcagcctgagcctgtgccacctgctgagcagcagcagcgagagccctgctggcacccccctgcagcccccaggcttcggcagcaccctggccggcatgagcggcctgcggaccaccggcagctatgatggcagcttcagcctgagcgccctgcgggaggcccagaacctggccttcaccggcctgaacctggtggccagaaatgaatgttccagagatggagaccctgctgagggcggccggcgggccttccccctgtgccagctgcctggagctgtgcacttcctgcccctggtgcagttcttcatcggcctgcactgccaggccctgcaggacctggccgccgccaagaggtctggggcccctggggacagccccacccacagcagctgtgtgtcctctggagtggagaccaaccctgaggacagcgtgtgcatcctggagggcttctctgtgacagccctgagcatcctgcagcacctggtgtgccacagcggggctgtggtgtccctgctgctgtctggagtgggcgctgacagcgctgctggggagggcaacagaagcctggtgcaccggctgagtgatggagacatgaccagcgccctgcggggcgtggctgatgaccagggccagcaccccctgctgaagatgctgctgcacctgctggccttcagcagcgctgccaccggccacctgcaggcctctgtgctgacccagtgcctgaaggtgctggtgaagctggccgagaacaccagctgtgacttcctgccccgcttccagtgtgtgttccaggtgctgcccaagtgcctgagccctgagacccccctgcccagcgtgctgctggccgtggagctgctgagcctgctggccgaccatgaccagctggccccccagctgtgcagccacagcgagggctgcctgctgctgctgctgtacatgtacatcaccagcaggccagacagagtggccctggagacccagtggctgcagctggagcaggaggtggtgtggctgctggccaagctgggcgtgcagagccccctgccccctgtgacaggcagcaactgccagtgcaatgtggaggtggtgcgggccctgactgtgatgctgcaccggcagtggctgactgtgagaagagctgggggcccccccaggacagaccagcagaggagaacagtgcgctgcctgcgggacacagtgctgctgctgcacggcctgagccagaaggacaagctgttcatgatgcactgtgtggaggtgctgcaccagtttgaccaggtgatgcctggggtgtccatgctgatccggggcctgcctgatgtgacagactgtgaggaggccgccctggatgacctgtgtgccgctgagacagatgtggaggaccctgaggtggagtgtggctag

SEQ ID NO: 144707 - DNA, 2097 bp, Artificial Sequence
  Description of Artificial Sequence: Synthetic coding sequence
atgagcaagaaccccagcggcaagaaccgggagaccgtgcccatcaaggacaactttgagctggaggtgctgcaggcccagtacaaggagctgaaggagaagatgaaggtgatggaggaggaggtgctgatcaagaatggagagatcaagatcctgcgggacagcctgcaccagacagaatctgtgctggaggagcagaggaggagccacttcctgctggagcaggagaagacccaggccctgagtgacaaggagaaggagttcagcaagaagctgcagagcctgcagagcgagctgcagttcaaggatgctgagatgaatgagctgcggaccaagctgcagaccagcgagcgggccaacaagctggccgcccccagcgtgagccacgtgagccccaggaagaaccccagcgtggtgatcaagccagaggcctgcagcccccagtttgggaagaccagcttccccaccaaggagagcttcagcgccaacatgagcctgccccacccctgccagacagagagcggctacaagcccctggtgggccgggaggacagcaagccccacagcctgcggggggacagcatcaagcaggaggaggcccagaagagctttgtggacagctggaggcagaggagcaacacccagggcagcatcctgatcaacctgctgctgaagcagcccctcatccctggcagcagcctgagcctgtgccacctgctgagcagcagcagcgagagccctgctggcacccccctgcagcccccaggcttcggcagcaccctggccggcatgagcggcctgcggaccaccggcagctatgatggcagcttcagcctgagcgccctgcgggaggcccagaacctggccttcaccggcctgaacctggtggccagaaatgaatgttccagagatggagaccctgctgagggcggccggcgggccttccccctgtgccagctgcctggagctgtgcacttcctgcccctggtgcagttcttcatcggcctgcactgccaggccctgcaggacctggccgccgccaagaggtctggggcccctggggacagccccacccacagcagctgtgtgtcctctggagtggagaccaaccctgaggacagcgtgtgcatcctggagggcttctctgtgacagccctgagcatcctgcagcacctggtgtgccacagcggggctgtggtgtccctgctgctgtctggagtgggcgctgacagcgctgctggggagggcaacagaagcctggtgcaccggctgagtgatggagacatgaccagcgccctgcggggcgtggctgatgaccagggccagcaccccctgctgaagatgctgctgcacctgctggccttcagcagcgctgccaccggccacctgcaggcctctgtgctgacccagtgcctgaaggtgctggtgaagctggccgagaacaccagctgtgacttcctgccccgcttccagtgtgtgttccaggtgctgcccaagtgcctgagccctgagacccccctgcccagcgtgctgctggccgtggagctgctgagcctgctggccgaccatgaccagctggccccccagctgtgcagccacagcgagggctgcctgctgctgctgctgtacatgtacatcaccagcaggccagacagagtggccctggagacccagtggctgcagctggagcaggaggtggtgtggctgctggccaagctgggcgtgcagagccccctgccccctgtgacaggcagcaactgccagtgcaatgtggaggtggtgcgggccctgactgtgatgctgcaccggcagtggctgactgtgagaagagctgggggcccccccaggacagaccagcagaggagaacagtgcgctgcctgcgggacacagtgctgctgctgcacggcctgagccagaaggacaagctgttcatgatgcactgtgtggaggtgctgcaccagtttgaccaggtgatgcctggggtgtccatgctgatccggggcctgcctgatgtgacagactgtgaggaggccgccctggatgacctgtgtgccgctgagacagatgtggaggaccctgaggtggagtgtggctag

SEQ ID NO: 144708 - DNA, 591 bp, Artificial Sequence
  Description of Artificial Sequence: Synthetic coding sequence
atgagcaagaaccccagcggcaagaaccgggagaccgtgcccatcaaggacaactttgagctggaggtgctgcaggcccagtacaaggagctgaaggagaagatgaaggtgatggaggaggaggtgctgatcaagaatggagagatcaagatcctgcgggacagcctgcaccagacagaatctgtgctggaggagcagaggaggagccacttcctgctggagcaggagaagacccaggccctgagtgacaaggagaaggagttcagcaagaagctgcagagcctgcagagcgagctgcagttcaaggatgctgagatgaatgagctgcggaccaagctgcagaccagcgagcgggccaacaagctggccgcccccagcgtgagccacgtgagccccaggaagaaccccagcgtggtgatcaagccagaggcctgcagcccccagtttgggaagaccagcttccccaccaaggagagcttcagcgccaacatgagcctgccccacccctgccagacagagagcggctacaagcccctggtgggccgggaggacagcaagccccacagcctgcggggggacagcatcaagtag

SEQ ID NO: 144709 - DNA, 141 bp, Artificial Sequence
  Description of Artificial Sequence: Synthetic coding sequence
atgagcaagaaccccagcggcaagaaccgggagaccgtgcccatcaaggacaactttgagctggaggtgctgcaggcccagtacaaggagctgaaggagaagctgtgcaagaaggctgacaccagctaccaccacctgtag

SEQ ID NO: 144710 - DNA, 1305 bp, Artificial Sequence
  Description of Artificial Sequence: Synthetic coding sequence
atgagcattgagaagatctgggcccgggagatcctggacagccggggcaaccccaccgtggaggtggacctgtacacagccaagggcctcttccgggctgctgtgcccagcggggccagcacaggcatctatgaggccctggagctgagagatggagacaagcagcgctacctgggcaagggcgtgctgaaggctgtggaccacatcaacagcaccatcgccccagccctgatcagcagcggcctgtctgtggtggagcaggagaagctggacaacctgatgctggagctggatggaacagagaacaagagcaagtttggagccaatgccatcctgggcgtgtccctggccgtgtgcaaggccggggctgctgagcgggagctgcccctgtaccgccacatcgcccagctggccggcaacagcgacctgatcctgcctgtgcctgccttcaacgtcatcaatggaggcagccatgctggcaacaagctggccatgcaggagttcatgatcctgcctgtgggcgctgagagcttcagagatgccatgaggctgggcgctgaggtgtaccacaccctgaagggcgtcatcaaggacaagtatggcaaggatgccaccaacgtgggagatgaaggaggctttgcccccaacatcctggagaacagcgaggccctggagctggtgaaggaggccatcgacaaggccggctacacagagaagatcgtcatcggcatggatgtggccgccagcgagttctacagagatggcaagtatgacctggacttcaagagccccacagaccccagccgctacatcaccggggaccagctgggcgccctgtaccaggactttgtgcgggactaccctgtggtgtccattgaggacccctttgaccaggatgactgggccgcctggagcaagttcaccgccaacgtgggcatccagatcgtgggagatgacctgactgtgaccaaccccaagagaattgaaagagctgtggaggagaaggcctgcaactgcctgctgctgaaggtgaaccagatcggctctgtgacagaggccatccaggcctgcaagctggcccaggagaatggctggggcgtgatggtgagccacaggtctggagaaacagaggacaccttcatcgctgacctggtggtgggcctgtgcaccggccagatcaagacaggagccccctgccgctctgagcggctggccaagtacaaccagctgatgagaattgaggaggagctgggagatgaggccaggtttgctggccacaacttcaggaaccccagcgtgctgtag

SEQ ID NO: 144711 - DNA, 3573 bp, Artificial Sequence
  Description of Artificial Sequence: Synthetic coding sequence
atgaagacccggcagaacaaggacagcatgtccatgaggagcggcaggaagaaggaggcccctggcccccgggaggagctgcggagccggggccgggccagccctggaggagtgtccaccagcagcagtgatggcaaggccgagaagagccggcagacagccaagaaggcccgggtggaggaggccagcacccccaaggtgaacaagcagggccgctctgaggagatcagcgagagcgagagcgaggagaccaatgcccccaagaagaccaagacagagcaggagctgccccggccccagagccccagcgacctggacagcctggatggccgcagcctgaatgatgatggcagcagtgacccccgggacatcgaccaggacaacagaagcaccagccccagcatctacagccctggctctgtggagaatgacagcgacagcagcagcggcctgagccagggccctgcccggccctaccaccccccacccctcttcccccccagcccccagcccccagacagcaccccccggcagcctgaggccagctttgagccccaccccagcgtgacccccaccggctaccacgcccccatggagccccccaccagcaggatgttccaggcccctcctggggcccccccaccccacccccagctgtacccaggcggcaccggcggcgtgctgagcggcccccccatgggccccaagggcggcggggccgccagctctgtgggcggccccaacggcggcaagcagcaccccccacccaccacccccatctctgtgagcagcagcggggccagcggggccccacccaccaagccacccaccacccctgtgggcggcggcaacctgcccagcgcccctcctccagccaacttcccccacgtgacccccaacctgcccccacctccagccctgcggcccctgaacaatgccagcgccagccccccaggcctgggcgcccagcccctgcccggccacctgcccagcccccacgccatgggccagggcatgggcggcctgcccccaggccctgagaagggccccaccctggcccccagcccccacagcctgcccccagccagcagcagcgccccagccccacccatgaggttcccctacagcagcagcagcagcagcagcgctgctgccagcagcagcagcagcagcagcagcagcagcgccagccccttccctgccagccaggccctgcccagctacccccacagcttccccccacccaccagcctgtctgtgagcaaccagccccccaagtacacccagcccagcctgcccagccaggccgtgtggagccagggccccccacctcctccaccctacggccgcctgctggccaacagcaatgcccaccctggccccttcccccccagcactggagcccagagcacagcccacccccctgtgtccacccaccaccaccaccaccagcagcagcagcagcagcagcagcagcagcagcagcagcagcagcagcagcagcagcaccacggcaacagcggccccccacctcctggggccttcccccaccccctggagggcggcagcagccaccacgcccacccctatgccatgagccccagcctgggcagcctgcggccctacccacctggccctgcccacctgcccccaccccacagccaggtgtcctacagccaggccggccccaacggcccccctgtgagcagcagcagcaacagcagcagcagcaccagccagggcagctacccctgcagccaccccagccccagccagggcccccagggcgccccctaccccttcccccctgtgcccaccgtgaccaccagcagcgccaccctgagcaccgtcatcgccaccgtggccagcagccctgctggctacaagacagccagccccccaggccccccaccctacggcaagagggcccccagccctggggcctacaagacagccaccccacctggctacaagccaggcagcccccccagcttcagaacaggcaccccacctggctaccggggcaccagccccccagctggccctggcaccttcaagccaggcagccccaccgtgggccctggccccctgcccccagctggccccagcggcctgcccagcctgcccccacctcctgctgccccagccagcggcccccccctgagcgccacccagatcaagcaggagcctgctgaggagtatgagaccccagagagccctgtgcccccagcccggagccccagccccccacccaaggtggtggatgtgcccagccacgccagccagagcgcccgcttcaacaagcacctggaccggggcttcaacagctgtgcccggagtgacctgtactttgtgcccctggagggcagcaagctggccaagaagagagctgacctggtggagaaggtgcggcgggaggccgagcagagggcccgggaggagaaggagcgggagcgggagcgggagcgggagaaggagcgggagcgggagaaggagcgggagctggagaggtctgtgaagctggcccaggagggccgggcccctgtggagtgccccagcctgggccctgtgccccaccggcccccatttgagcccggcagcgctgtggccaccgtgcccccctacctgggccctgacaccccagccctgcggaccctgtctgaatatgcccggccccacgtgatgagccctggcaacagaaaccaccccttctacgtgcccctgggcgctgtggaccccggcctgctgggctacaacgtgcctgccctgtacagcagtgaccctgctgcccgggagcgggagcgggaggcccgggagcgggacctgcgggaccggctgaagccaggctttgaggtgaagcccagcgagctggagcccctgcatggagtgcccggccctggcctggaccccttccccaggcatggaggcctggccctgcagcccggccccccaggcctgcaccccttccccttccaccccagcctgggccccctggagcgggagcggctggccctggccgccggccctgccctgcggccagacatgtcctatgcagagcggctggccgctgagcggcagcacgccgagcgggtggccgccctgggcaatgaccccctggcccggctgcagatgctgaatgtgaccccccaccaccaccagcacagccacatccacagccacctgcacctgcaccagcaggatgccatccatgctgccagcgcctctgtgcaccccctgattgaccccctggccagcggcagccacctgacccgcatcccctacccagctggcaccctgcccaaccccctgctgccccaccccctgcatgaaaatgaggtgctgcggcaccagctgtttgctgccccctacagagacctgcctgccagcctgagcgcccccatgtctgctgcccaccagctgcaggccatgcacgcccagagcgctgagctgcagaggctggccctggagcagcagcagtggctgcacgcccaccaccccctgcacagcgtgcccctgcctgcccaggaggactactacagccacctgaagaaggagagtgacaagcccctgtag

SEQ ID NO: 144712 - DNA, 3573 bp, Artificial Sequence; identical to SEQ ID NO: 144711
  Description of Artificial Sequence: Synthetic coding sequence

SEQ ID NO: 144713 - DNA, 3573 bp, Artificial Sequence; identical to SEQ ID NO: 144711
  Description of Artificial Sequence: Synthetic coding sequence

SEQ ID NO: 144714 - DNA, 519 bp, Artificial Sequence
  Description of Artificial Sequence: Synthetic coding sequence
atgctggtgatccacctggaggagcacgtgatcatcgccttcagccagcacaacaccatcatggacctggtgcagttctttgtgaccttcttcagctgcttcctgagcctgctgctggtggccgctgtggtgtggaagatcaagcagacctgctgggccagcagaagaagagagcagctgctgcgggagcggcagcagatggccagccggccctttgcctctgtggatgtggccctggaggtgggcgctgagcagacagagttcctgcggggccccctggagggcgcccccaagcccatcgccatcgagccctgtgccggcaacagagctgctgtgctgaccgtcttcctgtgcctgccccggggcagcagcggggcccctcctcctggccagagcggcctggccatcgccagcgccctgattgacatcagccagcagaaggccagtgacagcaaggacaagaccagcggcgtgaggaacaggaagcacctgagcacccggcagggcacctgtgtgtag

SEQ ID NO: 144715 - DNA, 4140 bp, Artificial Sequence
  Description of Artificial Sequence: Synthetic coding sequence
atggagactggaggccgggccaggacaggcaccccccagcctgctgcccctggggtgtggagggcccggcctgctgggggcggcggcggcggggccagctcctggctgctggatggcaacagctggctgctgtgctacggcttcctgtacctggccctgtatgcccaggtgtcccagagcaagccctgtgagaggacaggcagctgcttcagcggccgctgtgtgaacagcacctgcctgtgtgaccccggctgggtgggggaccagtgccagcactgccagggccgcttcaagctgacagagcccagcggctacctgacagatggccccatcaactacaagtacaagaccaagtgcacctggctgattgagggctacccaaatgctgtgctgcggctgcgcttcaaccactttgccacagaatgttcctgggaccacatgtatgtgtatgatggagacagcatctatgcccccctgattgctgtgctgagcggcctgattgtgcctgagatcagaggaaatgagaccgtgcctgaggtggtgaccaccagcggctacgccctgctgcacttcttcagtgatgctgcctacaacctgaccggcttcaacatcttctacagcatcaacagctgccccaacaactgcagcggccacggcaagtgcaccacctctgtgtctgtgcccagccaggtgtactgtgaatgtgacaagtactggaagggggaggcctgtgacatcccctactgcaaggccaactgtggcagcccagaccacggctactgtgacctgaccggggagaagctgtgtgtgtgcaatgacagctggcagggccctgactgcagcctgaatgtgcccagcacagagagctactggatcctgcccaacgtgaagcccttcagccccagcgtgggccgggccagccacaaggctgtgctgcacggcaagttcatgtgggtgattggaggctacaccttcaactacagcagcttccagatggtgctgaactacaacctggagagcagcatctggaatgtgggcacccccagccggggccccctgcagagatatggccacagcctggccctgtaccaggagaacatcttcatgtatggaggccgcatcgagaccaatgatggaaatgtgacagatgagctgtgggtgttcaacatccacagccagagctggagcaccaagacccccaccgtgctgggccacggccagcagtatgctgtggagggccacagcgcccacatcatggagctggacagcagagatgtggtgatgatcatcatcttcggctacagcgccatctacggctacaccagcagcatccaggagtaccacatcagcagcaacacctggctggtgcctgagaccaagggggccatcgtgcagggcggctacggccacacctctgtgtatgatgagatcaccaagagcatctacgtgcacggcggctacaaggccctgcccggcaacaagtatggcctggtggatgacctgtacaagtatgaggtgaacaccaagacctggaccatcctgaaggagagcggctttgcccgctacctgcacagcgctgtgctgatcaacggggccatgctgatctttggaggcaacacccacaatgacaccagcctgagcaatggagccaagtgcttctctgctgacttcctggcctatgacatcgcctgtgatgagtggaagatcctgcccaagcccaacctgcacagagatgtgaaccgcttcggccacagcgctgtggtgatcaatggctccatgtacatctttggaggcttcagctctgtgctgctgaatgacatcctggtgtacaagccacccaactgcaaggccttcagagatgaggagctgtgcaagaatgccggccctggcatcaagtgtgtgtggaacaagaaccactgtgagagctgggagagcggcaacaccaacaacatcctgcgggccaagtgcccccccaagacagctgccagtgatgaccgctgctaccgctatgctgactgtgccagctgcacagccaacaccaacggctgccagtggtgtgatgacaagaagtgcatcagcgccaacagcaactgcagcatgtctgtgaagaactacaccaagtgccacgtgagaaatgagcagatctgcaacaagctgaccagctgcaagagctgcagcctgaacctgaactgccagtgggaccagaggcagcaggagtgccaggccctgcctgcccacctgtgtggggagggctggagccacatcggagatgcctgcctgcgggtgaacagcagcagagaaaattatgacaatgccaagctgtactgctacaacctgagcggcaacctggccagcctgaccaccagcaaggaggtggagtttgtgctggatgagatccagaagtacacccagcagaaggtgagcccctgggtgggcctgaggaagatcaacatctcctactggggctgggaggacatgagccccttcaccaacaccaccctgcagtggctgcccggggagcccaatgacagcggcttctgtgcctacctggagagagctgctgtggccggcctgaaggccaacccctgcacctccatggccaacggcctggtgtgtgagaagcctgtggtgagccccaaccagaatgcccggccctgcaagaagccctgcagcctgcggaccagctgcagcaactgcaccagcaatggcatggagtgcatgtggtgcagcagcaccaagagatgtgtggacagcaatgcctacatcatctccttcccctacggccagtgcctggagtggcagacagccacctgcagcccccagaactgcagcggcctgcggacctgtggccagtgcctggagcagcccggctgcggctggtgcaatgaccccagcaacacaggccggggccactgcatcgagggcagcagccggggccccatgaagctgattggcatgcaccacagcgagatggtgctggacaccaacctgtgccccaaggagaagaactatgagtggagcttcatccagtgcccagcctgccagtgcaatggccacagcacctgcatcaacaacaacgtgtgtgagcagtgcaagaacctgaccaccgggaagcagtgccaggactgcatgcctggctactacggggaccccaccaatggaggccagtgcacagcctgcacctgcagcggccacgccaacatctgccacctgcacacaggcaagtgcttctgcaccaccaagggcatcaagggggaccagtgccagctgtgtgacagcgagaacagatatgtgggcaaccccctgcggggcacctgctactacagcctgctgattgactaccagttcaccttcagcctgctgcaggaggatgacagacaccacacagccatcaacttcatcgccaaccctgagcagagcaacaagaacctggacatcagcatcaatgccagcaacaacttcaacctgaacatcacctggagcgtgggcagcacagctggcaccatcagcggggaggagaccagcatcgtgtccaagaacaacatcaaggagtacagagacagcttctcctatgagaagttcaacttccgcagcaaccccaacatcaccttctacgtgtatgtgagcaacttctcctggcccatcaagatccagatcgccttcagccagcacaacaccatcatggacctggtgcagttctttgtgaccttcttcagctgcttcctgagcctgctgctggtggccgctgtggtgtggaagatcaagcagacctgctgggccagcagaagaagagagcagctgctgcgggagcggcagcagatggccagccggccctttgcctctgtggatgtggccctggaggtgggcgctgagcagacagagttcctgcggggccccctggagggcgcccccaagcccatcgccatcgagccctgtgccggcaacagagctgctgtgctgactgtgttcctgtgcctgccccggggcagcagcggggcccctcctcctggccagagcggcctggccatcgccagcgccctgattgacatcagccagcagaaggccagtgacagcaaggacaagaccagcggcgtgaggaacaggaagcacctgagcacccggcagggcacctgtgtgtag

SEQ ID NO: 144716 - DNA, 1293 bp, Artificial Sequence
  Description of Artificial Sequence: Synthetic coding sequence
atggagtgcatgtggtgcagcagcaccaagagatgtgtggacagcaatgcctacatcatctccttcccctacggccagtgcctggagtggcagacagccacctgcagcccccagaactgcagcggcctgcggacctgtggccagtgcctggagcagcccggctgcggctggtgcaatgaccccagcaacacaggccggggccactgcatcgagggcagcagccggggccccatgaagctgattggcatgcaccacagcgagatggtgctggacaccaacctgtgccccaaggagaagaactatgagtggagcttcatccagtgcccagcctgcacctgcagcggccacgccaacatctgccacctgcacacaggcaagtgcttctgcaccaccaagggcatcaagggggaccagtgccagctgtgtgacagtgaaaatcgctacgtgggcaaccccctgcggggcacctgctactacagcctgctgattgactaccagttcaccttcagcctgctgcaggaggatgacagacaccacacagccatcaacttcatcgccaaccctgagcagagcaacaagaacctggacatcagcatcaatgccagcaacaacttcaacctgaacatcacctggagcgtgggcagcacagctggcaccatctctggagaggagaccagcatcgtgtccaagaacaacatcaaggagtacagagacagcttctcctatgagaagttcaacttccgcagcaaccccaacatcaccttctacgtgtatgtgagcaacttctcctggcccatcaagatccagatcgccttcagccagcacaacaccatcatggacctggtgcagttctttgtgaccttcttcagctgcttcctgagcctgctgctggtggccgctgtggtgtggaagatcaagcagacctgctgggccagcagaagaagagagcagctgctgcgggagcggcagcagatggccagccggccctttgcctctgtggatgtggccctggaggtgggcgctgagcagacagagttcctgcggggccccctggagggcgcccccaagcccatcgccatcgagccctgtgccggcaacagagctgctgtgctgaccgtcttcctgtgcctgccccggggcagcagcggggcccctcctcctggccagagcggcctggccatcgccagcgccctgattgacatcagccagcagaaggccagtgacagcaaggacaagaccagcggcgtgaggaacaggaagcacctgagcacccggcagggcacctgtgtgtag

SEQ ID NO: 144717 - DNA, 207 bp, Artificial Sequence
  Description of Artificial Sequence: Synthetic coding sequence
atgcccaagcatgagttctctgtggacatgacctgtggcggctgtgccgaggccgtgtcccgggtgctgaacaagctgggcggcgtgaagtatgacatcgacctgcccaacaagaaggtgtgcatcgagagcgagcacagcatggacaccctgctggccaccctgaagaagacaggcaagacagtgtcctacctgggcctggagtag

SEQ ID NO: 144718 - DNA, 207 bp, Artificial Sequence; identical to SEQ ID NO: 144717
  Description of Artificial Sequence: Synthetic coding sequence

SEQ ID NO: 144719 - DNA, 207 bp, Artificial Sequence; identical to SEQ ID NO: 144717
  Description of Artificial Sequence: Synthetic coding sequence

SEQ ID NO: 144720 - DNA, 933 bp, Artificial Sequence
  Description of Artificial Sequence: Synthetic coding sequence
atggctgctgctgtggccgccgcccctggggccctgggcagcctgcatgctggaggagcccggctggtggccgcctgcagcgcctggctgtgccccggcctgcggctgcccggcagcctggccggcagaagagctggccctgccatctgggcccagggctgggtgcctgctgctgggggccctgcccccaagaggggctacagcagcgagatgaagacagaagatgagctgcgggtgcgccacctggaggaggagaacagaggaattgtggtgctgggcatcaacagagcctacggcaagaacagcctgagcaagaacctgatcaagatgctgagcaaggctgtggatgccctgaagagtgacaagaaggtgaggaccatcatcatccgctctgaggtgcccggcatcttctgtgccgccaacctgcctgtgcccaccatcgccgccattgatggcctggccctgggcggcggcctggagctggccctggcctgtgacatccgggtggccgccagcagcgccaagatgggcctggtggagaccaagctggccatcatccctgggggcggcggcacccagaggctgccccgggccatcggcatgagcctggccaaggagctgatcttcagcgcccgggtgctggatggcaaggaggccaaggctgtgggcctcatcagccacgtgctggagcagaaccaggagggagatgctgcctacaggaaggccctggacctggcccgggagttcctgccccagggccctgtggccatgagggtggccaagctggccatcaaccagggcatggaggtggacctggtgacaggcctggccatcgaggaggcctgctacgcccagaccatccccaccaaggaccggctggagggcctgctggccttcaaggagaagaggcctccccgctacaagggggagtag

SEQ ID NO: 144721 - DNA, 1020 bp, Artificial Sequence
  Description of Artificial Sequence: Synthetic coding sequence
atggctgctgctgtggccgccgcccctggggccctgggcagcctgcatgctggaggagcccggctggtggccgcctgcagcgcctggctgtgccccggcctgcggctgcccggcagcctggccggcagaagagctggccctgccatctgggcccagggctgggtgcctgctgctgggggccctgcccccaagaggggctacagcagcgagatgaagacagaagatgagctgcgggtgcgccacctggaggaggagaacagaggaattgtggtgctgggcatcaacagagcctacggcaagaacagcctgagcaagaacctgatcaagatgctgagcaaggctgtggatgccctgaagagtgacaagaaggtgaggaccatcatcatccgctctgaggtgcccggcatcttctgtgccggggctgacctgaaggagcgggccaagatgagcagcagcgaggtgggcccctttgtgtccaagatccgggctgtgatcaatgacatcgccaacctgcctgtgcccaccatcgccgccattgatggcctggccctgggcggcggcctggagctggccctggcctgtgacatccgggtggccgccagcagcgccaagatgggcctggtggagaccaagctggccatcatccctgggggcggcggcacccagaggctgccccgggccatcggcatgagcctggccaaggagctgatcttcagcgcccgggtgctggatggcaaggaggccaaggctgtgggcctcatcagccacgtgctggagcagaaccaggagggagatgctgcctacaggaaggccctggacctggcccgggagttcctgccccagggccctgtggccatgagggtggccaagctggccatcaaccagggcatggaggtggacctggtgacaggcctggccatcgaggaggcctgctacgcccagaccatccccaccaaggaccggctggagggcctgctggccttcaaggagaagaggcctccccgctacaagggggagtag

SEQ ID NO: 144722 - DNA, 768 bp, Artificial Sequence
  Description of Artificial Sequence: Synthetic coding sequence
atggctgctgctgtggccgccgcccctggggccctgggcagcctgcatgctggaggagcccggctggtggccgcctgcagcgcctggctgtgccccggcctgcggctgcccggcagcctggccggcagaagagctggccctgccatctgggcccagggctgggtgcctgctgctgggggccctgcccccaagaggggctacagcagcgagatgaagacagaagatgagctgcgggtgcgccacctggaggaggagaacagaggaattgtggtgctgggcatcaacagagcctacggcaagaacagcctgagcaagaacctgatcaagatgctgagcaaggctgtggatgccctgaagagtgacaagaaggtgaggaccatcatcatccgctctgaggtgcccggcatcttctgtgccggggctgacctgaaggagcgggccaagatgagcagcagcgaggtgggcccctttgtgtccaagatccgggctgtgatcaatgacatcgccaacctgcctgtgcccaccatcgccgccattgatggcctggccctgggcggcggcctggagctggccctggcctgtgacatccgggtggccgccagcagcgccaagatgggcctggtggagaccaagctggccatcatccctgggggcgtgaccagcagcacagaggtgctgaaccccagcaagagctccatgaagattggcatcatcatcttccagacccctgtgaacatcgacatcctggccagcagccatgagagctag

SEQ ID NO: 144723 - DNA, 1932 bp, Artificial Sequence
  Description of Artificial Sequence: Synthetic coding sequence
atgcccctgctcttcctggagcgcttcccctggcccagcctgcggacctacacaggcctgagcggcctggccctgctgggcaccatcatcagcgcctaccgggccctgagccagcctgaggccggccctggagagccagaccagctgacagccagcctgcagcctgagcccccagccccagcccggcccagcgctgggggcccccgggccagagatgtggcccagtacctgctgagtgacagcctgtttgtgtgggtgctggtgaacacagcctgctgcgtgctgatgctggtggccaagctgatccagtgcatcgtgtttggccccctgcgggtgtctgagcggcagcacctgaaggacaagttctggaacttcatcttctacaagttcatcttcatcttcggcgtgctgaatgtgcagacagtggaggaggtggtgatgtggtgcctgtggtttgctggcctggtgttcctgcacctgatggtgcagctgtgcaaggacagatttgagtacctgtccttcagccccaccacccccatgagcagccacggccgggtgctgagcctgctggtggccatgctgctgagctgctgcggcctggccgctgtgtgcagcatcaccggctacacccacggcatgcacaccctggccttcatggctgctgagagcctgctggtgacagtgaggacagcccacgtgatcctgcgctacgtgatccacctgtgggacctgaaccacgagggcacctgggagggcaagggcacctacgtgtactacacagactttgtgatggagctgaccctgctgagcctggacctgatgcaccacatccacatgctgctgtttggaaacatctggctgtccatggccagcctggtgatcttcatgcagctgcgctacctgttccacgaggtgcagaggcgcatccgccgccacaagaactacctgcgggtggtgggcaacatggaggccaggtttgctgtggccaccccagaggagctggccgtgaacaatgatgactgtgccatctgctgggacagcatgcaggccgccaggaagctgccctgtggccacctgttccacaacagctgcctgcgctcctggctggagcaggacaccagctgccccacctgcaggatgagcctgaacattgctgacaacaacagagtgcgggaggagcaccagggcgagaacctggatgagaacctggtgcctgtggccgctgctgagggccggccccggctgaaccagcacaaccacttcttccactttgatggcagcagaattgcctcctggctgcccagcttctctgtggaggtgatgcacaccaccaacatcctgggcatcacccaggccagcaacagccagctgaatgccatggcccaccagatccaggagatgttcccccaggtgccctaccacctggtgctgcaggacctgcagctgaccaggtctgtggagatcaccacagacaacatcctggagggccgcatccaggtgcccttccccacccagaggagtgacagcatccggcctgccctgaacagccctgtggagcggcccagcagtgaccaggaggagggggagaccagcgcccagacagagcgggtgcccctggacctgagcccccggctggaggagaccctggactttggagaggtggaggtggagcccagcgaggtggaggactttgaggcccggggcagccgcttcagcaagtctgcagatgagcggcagaggatgctggtgcagaggaaggatgagctgctgcagcaggccaggaagcgcttcctgaacaagagcagtgaagatgatgctgccagcgagagcttcctgcccagcgagggcgccagcagtgaccctgtgaccctgcggcggaggatgctggccgctgctgctgagcggcggctgcagaagcagcagaccagctag

SEQ ID NO: 144724 - DNA, 954 bp, Artificial Sequence
  Description of Artificial Sequence: Synthetic coding sequence
atgagggacagcgcctgctggcagaggaaggatgagctgctgcagcaggccaggaagcgcttcctgaacaagagcagtgaagatgatgctgccagcgagagcttcctgcccagcgagggcgccagcagtgaccctgtgaccctgcggcggaggatgctggccgccagaaatggaggcttccgcagcagcaggcctccttctgcccccctgcccagcagcgctgccagctgtgccctgtgccccacagactggaggaggcctgtgcccatccccctgcacggcaaggccggcctgacagccctgcccctgtacaaggcctgtggcctcatcgtgtttggccagctgatcaacctgatcctgctgtgcaacaccttctacgtgaccttcctgttccccctggagaccctgcagatcctgactgtgggcatgatcagcagcggcgtggactggacagcctggggcggcggccgcagcggcggcagcgaggtggcctgcctgcagcaggccgccagcaccccagccagctgtgtgcggcccaccaatgctggggtgctgagcaccacccccagcggcaagtctgtgggggaggcccacagcgtgagccccccaccaagaagaggagtgaccagcgtcatcaagctgctgagcctgctgtggaagcacgtggactgtgcccggcggcccaccggcagctgcaccccccagcagggcatcctggagaaggagctgctggtgcgctacctggagcagaggcggggcaagagccgggccatcggctgtgatgaggtgacccccttctgccccaccaccagcggcacagacttccccagcctgcagagcaaggccggcctcatctctgtgaacagcggggccccagccagccatgaatgtgccccctgggtgcccagccccctgagcatcagcctgagccggctggacctgggcagcggctag

SEQ ID NO: 144725 - DNA, 1638 bp, Artificial Sequence
  Description of Artificial Sequence: Synthetic coding sequence
atggccacagatgctgccctgcggcggctgctgcggctgcacaggacagaaattgctgtggccgtggacagcgccttccccctgctgcacgccctggccgaccatgatgtggtgcctgaggacaagttccaggagaccctgcacctgaaggagaaggagggctgcccccaggccttccacgccctgctgtcctggctgctgacccaggacagcacagccatcctggacttctggagggtgctcttcaaggactacaacctggagagatatggccgcctgcagcccatcctggacagcttccccaaggatgtggacctgagccagcccaggaaaggaaggaagcccccagctgtgcccaaggccctggtgcccccaccccggctgcccaccaagaggaaggccagcgaggaggcccgggctgctgccccagctgccctgaccccccggggcacagccagccctggcagccagctgaaggccaagccacccaagaagccagagagcagcgctgagcagcagaggctgcccctgggcaatggcatccagaccatgtctgcctctgtgcagagagctgtggccatgagcagtggagatgtgcctggggcccggggagctgtggagggcatcctgatccagcaggtgtttgaaagtggcggcagcaagaagtgcatccaggtgggcggggagttctacacccccagcaagtttgaagattctggcagcggcaagaacaaggcccggagcagcagcggccccaagcccctggtgcgggccaagggggcccagggcgccgcccctgggggcggggaggcccggctgggccagcagggctctgtgcctgcccccctggccctgcccagcgacccccagctgcaccagaagaatgaagatgaatgtgctgtgtgcagagatggaggagagctgatctgctgtgatggctgcccccgggccttccacctggcctgcctgagcccccccctgcgggagatccccagcggcacctggcgctgcagcagctgcctgcaggccaccgtgcaggaggtgcagcccagggctgaggagccccggccccaggagccccctgtggagacccccctgcccccaggcctgcggtctgctggggaggaggtgcggggccccccaggagagcccctggccggcatggacaccaccctggtgtacaagcacctgcctgccccacccagcgctgcccccctgcccggcctggacagcagcgccctgcaccccctgctgtgtgtgggccctgagggccagcagaacctggcccctggggcccgctgtggggtgtgtggagatggaacagatgtgctgcgctgcacccactgtgccgccgccttccactggcgctgccacttccctgctggcaccagccggcccggcaccggcctgcgctgccgcagctgcagcggagatgtgaccccagcccctgtggagggcgtgctggcccccagccctgcccggctggcccctggccctgccaaggatgacacagccagccatgagcccgccctgcacagagatgacctggagagcctgctgtctgagcacacctttgatggcatcctgcagtgggccatccagagcatggcccggcctgctgcccccttccccagctag

SEQ ID NO: 144726 - DNA, 735 bp, Artificial Sequence
  Description of Artificial Sequence: Synthetic coding sequence
atgtggctggtgtacagcagcggggcccctggcacccagcagcctgccaggaacagagtcttcttccccatcggcatggcccctgggggcgtgtgctggaggccagatggctggggcaccggcggccagggccgcatcagcggccctggctccatgggcgccggccagaggctgggcagcagcggcacccagcgctgctgctggggcagctgcttcggcaaggaggtggccctgcggcgggtgctgcaccccagccccaagaatgaagatgaatgtgctgtgtgcagagatggaggagagctgatctgctgtgatggctgcccccgggccttccacctggcctgcctgagcccccccctgcgggagatccccagcggcacctggcgctgcagcagctgcctgcaggccaccgtgcaggaggtgcagcccagggctgaggagccccggccccaggagccccctgtggagacccccctgcccccaggcctgcggtctgctggggaggagccccgctgccagggctggaccccccggccctgcaccccctactgtgtgtgggtgctgcgggtgtccaggacctggctgctggtgcgggtggccggctgtgccgagatggtgaggacctgctgcggcgtgctgacagcccccctgcccagcactggagctgccaccagccagcctgcccctcctggccctggccgggcctgtgccgctgaccctgcccaggagacctag

SEQ ID NO: 144727 - DNA, 1047 bp, Artificial Sequence
  Description of Artificial Sequence: Synthetic coding sequence
atgtggctggtgtacagcagcggggcccctggcacccagcagcctgccaggaacagagtcttcttccccatcggcatggcccctgggggcgtgtgctggaggccagatggctggggcaccggcggccagggccgcatcagcggccctggctccatgggcgccggccagaggctgggcagcagcggcacccagcgctgctgctggggcagctgcttcggcaaggaggtggccctgcggcgggtgctgcaccccagccctgtgtgcatgggcgtgtcctgcctgtgccagaagaatgaagatgaatgtgctgtgtgcagagatggaggagagctgatctgctgtgatggctgcccccgggccttccacctggcctgcctgagcccccccctgcgggagatccccagcggcacctggcgctgcagcagctgcctgcaggccaccgtgcaggaggtgcagcccagggctgaggagccccggccccaggagccccctgtggagacccccctgcccccaggcctgcggtctgctggggaggaggtgcggggccccccaggagagcccctggccggcatggacaccaccctggtgtacaagcacctgcctgcccctccttctgctgcccccctgcccggcctggacagcagcgccctgcaccccctgctgtgtgtgggccctgagggccagcagaacctggcccctggggcccgctgtggggtgtgtggagatggaacagatgtgctgcgctgcacccactgtgccgccgccttccactggcgctgccacttccctgctggcaccagcaggcctggcaccggcctgcgctgccgcagctgcagcggagatgtgaccccagcccctgtggagggcgtgctggcccccagccctgcccggctggcccctggccctgccaaggatgacacagccagccatgagcccgccctgcacagagatgacctggagagcctgctgtctgagcacacctttgatggcatcctgcagtgggccatccagagcatggcccggcctgctgcccccttccccagctag

SEQ ID NO: 144728 - DNA, 1017 bp, Artificial Sequence
  Description of Artificial Sequence: Synthetic coding sequence
atgtggctggtgtacagcagcggggcccctggcacccagcagcctgccaggaacagagtcttcttccccatcggcatggcccctgggggcgtgtgctggaggccagatggctggggcaccggcggccagggccgcatcagcggccctggctccatgggcgccggccagaggctgggcagcagcggcacccagcgctgctgctggggcagctgcttcggcaaggaggtggccctgcggcgggtgctgcaccccagccccaagaatgaagatgaatgtgctgtgtgcagagatggaggagagctgatctgctgtgatggctgcccccgggccttccacctggcctgcctgagcccccccctgcgggagatccccagcggcacctggcgctgcagcagctgcctgcaggccaccgtgcaggaggtgcagcccagggctgaggagccccggccccaggagccccctgtggagacccccctgcccccaggcctgcggtctgctggggaggaggtgcggggccccccaggagagcccctggccggcatggacaccaccctggtgtacaagcacctgcctgcccctccttctgctgcccccctgcccggcctggacagcagcgccctgcaccccctgctgtgtgtgggccctgagggccagcagaacctggcccctggggcccgctgtggggtgtgtggagatggaacagatgtgctgcgctgcacccactgtgccgccgccttccactggcgctgccacttccctgctggcaccagcaggcctggcaccggcctgcgctgccgcagctgcagcggagatgtgaccccagcccctgtggagggcgtgctggcccccagccctgcccggctggcccctggccctgccaaggatgacacagccagccatgagcccgccctgcacagagatgacctggagagcctgctgtctgagcacacctttgatggcatcctgcagtgggccatccagagcatggcccggcctgctgcccccttccccagctag

SEQ ID NO: 144729 - DNA, 1047 bp, Artificial Sequence; identical to SEQ ID NO: 144727
  Description of Artificial Sequence: Synthetic coding sequence

SEQ ID NO: 144730 - DNA, 3717 bp, Artificial Sequence
  Description of Artificial Sequence: Synthetic coding sequence
atgaaggtggtgcctgagaagaatgctgtgcgcatcctgtggggccgggagcggggggcccgggccatgggcgcccagaggctgctgcaggagctggtggaggacaagacccgctggatgaagtgggagggcaagagggtggagctgcctgacagccccaggagcaccttcctgctggccttctccccagacaggaccctgctggccagcacccacgtgaaccacaacatctacatcacagaggtgaagacaggaaaatgtgtgcacagcctcatcggccacaggaggaccccctggtgtgtgaccttccaccccaccatcagcggcctgattgccagcggctgcctggatggagaggtgcgcatctgggacctgcacggcggcagcgagagctggttcacagacagcaacaatgccatcgccagcctggccttccaccccacagcccagctgctgctgattgccacagccaatgagatccacttctgggactggagcagaagagagccctttgctgtggtgaagacagccagcgagatggagcgggtgcggctggtgcgctttgaccccctgggccactacctgctgacagccatcgtgaaccccagcaaccagcagggagatgatgagcctgagatccccattgatggaacagagctgagccactaccggcagagggccctgctgcagagccagcctgtgcggaggacccccctgctgcacaacttcctgcacatgctgagcagccgcagcagcggcatccaggtgggggagcagagcacagtgcaggacagcgccacccccagccccccacctcctccaccccagcccagcacagagcggcccaggaccagcgcctacatccggctgcggcagagggtgtcctaccccacagctgagtgctgccagcacctgggcatcctgtgcctgtgcagccgctgcagcggcaccagggtgcccagcctgctgccccaccaggacagcgtgcccccagccagcgcccgggccaccacccccagcttctcctttgtgcagacagagcccttccaccccccagagcaggccagcagcacccagcaggaccagggcctgctgaaccggcccagcgccttcagcacagtgcagagcagcacagctggcaacaccctgaggaacctgagcctgggccccacccggcgcagcctgggcggccccctgagcagccaccccagccgctaccaccgggagatcgcccctggcctgactggaagtgagtggaccaggacagtgctgagcctgaacagccgctctgaggccgagagcatgcccccacccaggaccagcgccagctctgtgtccctgctgtctgtgctgcggcagcaggagggcggcagccaggcctctgtgtacaccagcgccacagagggccggggcttccctgccagcggcctggccacagaaagtgatggcggcaatggcagcagccagaacaacagcggcagcatcagacatgagctgcagtgtgacctgcggcgcttcttcctggagtatgaccggctgcaggagctggaccagagcctgtctggagaggccccccagacccagcaggcccaggagatgctgaacaacaacatcgagagcgagaggcctggccccagccaccagcccaccccccacagcagcgagaacaacagcaacctgagccggggccacctgaaccgctgccgggcctgccacaacctgctgaccttcaacaatgacaccctgcgctgggagaggaccacccccaactacagcagtggagaggccagcagctcctggcaggtgcccagcagctttgagagcgtgcccagcagcggcagccagctgccccccctggagaggacagagggccagacccccagcagcagccggctggagctgagcagcagcgccagcccccaggaggagaggacagtgggcgtggccttcaaccaggagaccggccactgggagcgcatctacacccagagcagccgctctggaacagtgtcccaggaggccctgcaccaggacatgcctgaggagagcagcgaggaggacagcctgcggcggcggctgctggagagcagcctcatcagcctgagccgctatgatggagctggcagccgggagcaccccatctacccagaccctgcccgggacaacggggacaggagccgccaccgggcccccagaaatgccaggatgtctgcccccagcctgggccgctttgtgccccggcgcttcctgctgcctgagtacctgccctatgccggcatcttccacgagcggggccagcccggcctggccacccacagctctgtgaacagagtgctggccggggctgtgattggagatggccagagcgctgtggccagcaacatcgccaacaccacctaccgcctgcagtggtgggacttcaccaagtttgacctgcctgagatcagcaatgcctctgtgaatgtgctggtgcagaactgcaagatctacaatgatgccagctgtgacatctctgcagatggccagctgctggccgccttcatccccagcagccagaggggcttcccagatgagggcatcctggccgtgtacagcctggccccccacaacctgggggagatgctgtacaccaagcgcttcggccccaatgccatctctgtgtccctgagccccatgggccgctacgtgatggtgggcctggccagccgccgcatcctgctgcaccccagcacagagcacatggtggcccaggtgttccggctgcagcaggcccatggaggagagacctccatgagaagagtcttcaacgtgctgtaccccatgcctgctgaccagaggagacatgtgtccatcaacagcgcccgctggctgcctgagcccggcctgggcctggcctacggcaccaacaagggggacctggtgatctgcaggcctgaggccctgaacagcggcgtggagtactactgggaccagctgaatgaaacagtgttcaccgtgcacagcaacagccgcagcagcgagaggcctggcaccagccgggccacctggaggacagaccgggacatgggcctgatgaatgccatcggcctgcagcccagaaatcctgccacctctgtgaccagccagggcacccagaccctggccctgcagctgcagaatgctgagacccagacagagcgggaggtgcctgagcctggaacagctgccagcggccctggagagggggagggctctgaatatggagccagcggagaagatgccctgagccgcatccagaggctgatggccgagggcggcatgacagctgtggtgcagcgggagcagagcaccaccatggcctccatgggcggcttcggcaacaacatcatcgtgagccaccgcatccacaggagcagccagacaggaacagagcccggggccgcccacaccagcagcccccagcccagcaccagccggggcctgctgcctgaggccggccagctggccgagcggggcctgagccccaggacagcctcctgggaccagcccggcaccccaggccgggagcccacccagcccaccctgcccagcagcagccctgtgcccatccctgtgtccctgcccagcgctgagggccccaccctgcactgtgagctgaccaacaacaaccacctgctggatggcggcagcagcagaggagatgctgctggccccagaggagagcccaggaacagatag

SEQ ID NO: 144731 - DNA, 2169 bp, Artificial Sequence
  Description of Artificial Sequence: Synthetic coding sequence
atgaaggtggtgcctgagaagaatgctgtgcgcatcctgtggggccgggagcggggggcccgggccatgggcgcccagaggctgctgcaggagctggtggaggacaagacccgctggatgaagtgggagggcaagagggtggagctgcctgacagccccaggagcaccttcctgctggccttctccccagacaggaccctgctggccagcacccacgtgaaccacaacatctacatcacagaggtgaagacaggaaaatgtgtgcacagcctcatcggccacaggaggaccccctggtgtgtgaccttccaccccaccatcagcggcctgattgccagcggctgcctggatggagaggtgcgcatctgggacctgcacggcggcagcgagagctggttcacagacagcaacaatgccatcgccagcctggccttccaccccacagcccagctgctgctgattgccacagccaatgagatccacttctgggactggagcagaagagagccctttgctgtggtgaagacagccagcgagatggagcgggtgcggctggtgcgctttgaccccctgggccactacctgctgacagccatcgtgaaccccagcaaccagcagggagatgatgagcctgagatccccattgatggaacagagctgagccactaccggcagagggccctgctgcagagccagcctgtgcggaggacccccctgctgcacaacttcctgcacatgctgagcagccgcagcagcggcatccagacagagcccttccaccccccagagcaggccagcagcacccagcaggaccagggcctgctgaaccggcccagcgccttcagcacagtgcagagcagcacagctggcaacaccctgaggaacctgagcctgggccccacccggcgcagcctgggcggccccctgagcagccaccccagccgctaccaccgggagatcgcccctggcctgactggaagtgagtggaccaggacagtgctgagcctgaacagccgctctgaggccgagagcatgcccccacccaggaccagcgccagctctgtgtccctgctgtctgtgctgcggcagcaggagggcggcagccaggcctctgtgtacaccagcgccacagagggccggggcttccctgccagcggcctggccacagaaagtgatggcggcaatggcagcagccagaacaacagcggcagcatcagacatgagctgcagtgtgacctgcggcgcttcttcctggagtatgaccggctgcaggagctggaccagagcctgtctggagaggccccccagacccagcaggcccaggagatgctgaacaacaacatcgagagcgagaggcctggccccagccaccagcccaccccccacagcagcgagaacaacagcaacctgagccggggccacctgaaccgctgccgggcctgccacaacctgctgaccttcaacaatgacaccctgcgctgggagaggaccacccccaactacagcagtggagaggccagcagctcctggcaggtgcccagcagctttgagagcgtgcccagcagcggcagccagctgccccccctggagaggacagagggccagacccccagcagcagccggctggagctgagcagcagcgccagcccccaggaggagaggacagtgggcgtggccttcaaccaggagaccggccactgggagcgcatctacacccagagcagccgctctggaacagtgtcccaggaggccctgcaccaggacatgcctgaggagagcagcgaggaggacagcctgcggcggcgcagcctggccctgagcccccggctggagtacagcggggccatcctggcccactgcaagctgcggctgcccggcagctgccacagccctgccagcgccagccaggtggccggcaccactggagcccaccaccacgcccggctcatctttgccttcctggtggagatggagttccaccacgtgtcccaggccggcctggagctgctgaccagcggggacctgcccaccagcgccagccagagcgctggcatcaccggggtgagccaccgggcctggccccggctgctggagagcagcctcatcagcctgagccgctatgatggagctggcagccgggagcaccccatctacccagaccctgcctag

SEQ ID NO: 144732 - DNA, 3627 bp, Artificial Sequence
  Description of Artificial Sequence: Synthetic coding sequence
atgaaggtggtgcctgagaagaatgctgtgcgcatcctgtggggccgggagcggggggcccgggccatgggcgcccagaggctgctgcaggagctggtggaggacaagacccgctggatgaagtgggagggcaagagggtggagctgcctgacagccccaggagcaccttcctgctggccttctccccagacaggaccctgctggccagcacccacgtgaaccacaacatctacatcacagaggtgaagacaggaaaatgtgtgcacagcctcatcggccacaggaggaccccctggtgtgtgaccttccaccccaccatcagcggcctgattgccagcggctgcctggatggagaggtgcgcatctgggacctgcacggcggcagcgagagctggttcacagacagcaacaatgccatcgccagcctggccttccaccccacagcccagctgctgctgattgccacagccaatgagatccacttctgggactggagcagaagagagccctttgctgtggtgaagacagccagcgagatggagcgggtgcggctggtgcgctttgaccccctgggccactacctgctgacagccatcgtgaaccccagcaaccagcagggagatgatgagcctgagatccccattgatggaacagagctgagccactaccggcagagggccctgctgcagagccagcctgtgcggaggacccccctgctgcacaacttcctgcacatgctgagcagccgcagcagcggcatccagacagagcccttccaccccccagagcaggccagcagcacccagcaggaccagggcctgctgaaccggcccagcgccttcagcacagtgcagagcagcacagctggcaacaccctgaggaacctgagcctgggccccacccggcgcagcctgggcggccccctgagcagccaccccagccgctaccaccgggagatcgcccctggcctgactggaagtgagtggaccaggacagtgctgagcctgaacagccgctctgaggccgagagcatgcccccacccaggaccagcgccagctctgtgtccctgctgtctgtgctgcggcagcaggagggcggcagccaggcctctgtgtacaccagcgccacagagggccggggcttccctgccagcggcctggccacagaaagtgatggcggcaatggcagcagccagaacaacagcggcagcatcagacatgagctgcagtgtgacctgcggcgcttcttcctggagtatgaccggctgcaggagctggaccagagcctgtctggagaggccccccagacccagcaggcccaggagatgctgaacaacaacatcgagagcgagaggcctggccccagccaccagcccaccccccacagcagcgagaacaacagcaacctgagccggggccacctgaaccgctgccgggcctgccacaacctgctgaccttcaacaatgacaccctgcgctgggagaggaccacccccaactacagcagtggagaggccagcagctcctggcaggtgcccagcagctttgagagcgtgcccagcagcggcagccagctgccccccctggagaggacagagggccagacccccagcagcagccggctggagctgagcagcagcgccagcccccaggaggagaggacagtgggcgtggccttcaaccaggagaccggccactgggagcgcatctacacccagagcagccgctctggaacagtgtcccaggaggccctgcaccaggacatgcctgaggagagcagcgaggaggacagcctgcggcggcggctgctggagagcagcctcatcagcctgagccgctatgatggagctggcagccgggagcaccccatctacccagaccctgcccggctgagccctgctgcctactatgcccagaggatgatccagtacctgagcagaagagacagcatccggcagaggtccatgagataccagcagaaccggctgcggagcagcaccagcagcagcagcagtgacaaccagggccccagcgtggagggcacagacctggagtttgaagattttgaggacaacggggacaggagccgccaccgggcccccagaaatgccaggatgtctgcccccagcctgggccgctttgtgccccggcgcttcctgctgcctgagtacctgccctatgccggcatcttccacgagcggggccagcccggcctggccacccacagctctgtgaacagagtgctggccggggctgtgattggagatggccagagcgctgtggccagcaacatcgccaacaccacctaccgcctgcagtggtgggacttcaccaagtttgacctgcctgagatcagcaatgcctctgtgaatgtgctggtgcagaactgcaagatctacaatgatgccagctgtgacatctctgcagatggccagctgctggccgccttcatccccagcagccagaggggcttcccagatgagggcatcctggccgtgtacagcctggccccccacaacctgggggagatgctgtacaccaagcgcttcggccccaatgccatctctgtgtccctgagccccatgggccgctacgtgatggtgggcctggccagccgccgcatcctgctgcaccccagcacagagcacatggtggcccaggtgttccggctgcagcaggcccatggaggagagacctccatgagaagagtcttcaacgtgctgtaccccatgcctgctgaccagaggagacatgtgtccatcaacagcgcccgctggctgcctgagcccggcctgggcctggcctacggcaccaacaagggggacctggtgatctgcaggcctgaggccctgaacagcggcgtggagtactactgggaccagctgaatgaaacagtgttcaccgtgcacagcaacagccgcagcagcgagaggcctggcaccagccgggccacctggaggacagaccgggacatgggcctgatgaatgccatcggcctgcagcccagaaatcctgccacctctgtgaccagccagggcacccagaccctggccctgcagctgcagaatgctgagacccagacagagcgggaggtgcctgagcctggaacagctgccagcggccctggagagggggagggctctgaatatggagccagcggagaagatgccctgagccgcatccagaggctgatggccgagggcggcatgacagctgtggtgcagcgggagcagagcaccaccatggcctccatgggcggcttcggcaacaacatcatcgtgagccaccgcatccacaggagcagccagacaggaacagagcccggggccgcccacaccagcagcccccagcccagcaccagccggggcctgctgcctgaggccggccagctggccgagcggggcctgagccccaggacagcctcctgggaccagcccggcaccccaggccgggagcccacccagcccaccctgcccagcagcagccctgtgcccatccctgtgtccctgcccagcgctgagggccccaccctgcactgtgagctgaccaacaacaaccacctgctggatggcggcagcagcagaggagatgctgctggccccagaggagagcccaggaacagatag

SEQ ID NO: 144733 - DNA, 3810 bp, Artificial Sequence
  Description of Artificial Sequence: Synthetic coding sequence
atgaaggtggtgcctgagaagaatgctgtgcgcatcctgtggggccgggagcggggggcccgggccatgggcgcccagaggctgctgcaggagctggtggaggacaagacccgctggatgaagtgggagggcaagagggtggagctgcctgacagccccaggagcaccttcctgctggccttctccccagacaggaccctgctggccagcacccacgtgaaccacaacatctacatcacagaggtgaagacaggaaaatgtgtgcacagcctcatcggccacaggaggaccccctggtgtgtgaccttccaccccaccatcagcggcctgattgccagcggctgcctggatggagaggtgcgcatctgggacctgcacggcggcagcgagagctggttcacagacagcaacaatgccatcgccagcctggccttccaccccacagcccagctgctgctgattgccacagccaatgagatccacttctgggactggagcagaagagagccctttgctgtggtgaagacagccagcgagatggagcgggtgcggctggtgcgctttgaccccctgggccactacctgctgacagccatcgtgaaccccagcaaccagcagggagatgatgagcctgagatccccattgatggaacagagctgagccactaccggcagagggccctgctgcagagccagcctgtgcggaggacccccctgctgcacaacttcctgcacatgctgagcagccgcagcagcggcatccaggtgggggagcagagcacagtgcaggacagcgccacccccagccccccacctcctccaccccagcccagcacagagcggcccaggaccagcgcctacatccggctgcggcagagggtgtcctaccccacagctgagtgctgccagcacctgggcatcctgtgcctgtgcagccgctgcagcggcaccagggtgcccagcctgctgccccaccaggacagcgtgcccccagccagcgcccgggccaccacccccagcttctcctttgtgcagacagagcccttccaccccccagagcaggccagcagcacccagcaggaccagggcctgctgaaccggcccagcgccttcagcacagtgcagagcagcacagctggcaacaccctgaggaacctgagcctgggccccacccggcgcagcctgggcggccccctgagcagccaccccagccgctaccaccgggagatcgcccctggcctgactggaagtgagtggaccaggacagtgctgagcctgaacagccgctctgaggccgagagcatgcccccacccaggaccagcgccagctctgtgtccctgctgtctgtgctgcggcagcaggagggcggcagccaggcctctgtgtacaccagcgccacagagggccggggcttccctgccagcggcctggccacagaaagtgatggcggcaatggcagcagccagaacaacagcggcagcatcagacatgagctgcagtgtgacctgcggcgcttcttcctggagtatgaccggctgcaggagctggaccagagcctgtctggagaggccccccagacccagcaggcccaggagatgctgaacaacaacatcgagagcgagaggcctggccccagccaccagcccaccccccacagcagcgagaacaacagcaacctgagccggggccacctgaaccgctgccgggcctgccacaacctgctgaccttcaacaatgacaccctgcgctgggagaggaccacccccaactacagcagtggagaggccagcagctcctggcaggtgcccagcagctttgagagcgtgcccagcagcggcagccagctgccccccctggagaggacagagggccagacccccagcagcagccggctggagctgagcagcagcgccagcccccaggaggagaggacagtgggcgtggccttcaaccaggagaccggccactgggagcgcatctacacccagagcagccgctctggaacagtgtcccaggaggccctgcaccaggacatgcctgaggagagcagcgaggaggacagcctgcggcggctgagccctgctgcctactatgcccagaggatgatccagtacctgagccggcgggacagcatccggcagaggtccatgagataccagcagaaccggctgcggagcagcaccagcagcagcagcagtgacaaccagggccccagcgtggagggcacagacctggagtttgaggactttgaagataatggagacaggagccgccaccgggcccccagaaatgccaggatgtctgcccccagcctgggccgctttgtgccccggcgcttcctgctgcctgagtacctgccctatgccggcatcttccacgagcggggccagcccggcctggccacccacagctctgtgaacagagtgctggccggggctgtgattggagatggccagagcgctgtggccagcaacatcgccaacaccacctaccgcctgcagtggtgggacttcaccaagtttgacctgcctgagatcagcaatgcctctgtgaatgtgctggtgcagaactgcaagatctacaatgatgccagctgtgacatctctgcagatggccagctgctggccgccttcatccccagcagccagaggggcttcccagatgagggcatcctggccgtgtacagcctggccccccacaacctgggggagatgctgtacaccaagagatttggccccaatgccatctctgtgtccctgagccccatgggccgctacgtgatggtgggcctggccagccgccgcatcctgctgcaccccagcacagagcacatggtggcccaggtgttccggctgcagcaggcccacggcggggagacctccatgagaagagtcttcaacgtgctgtaccccatgcctgctgaccagaggagacatgtgtccatcaacagcgcccgctggctgcctgagcccggcctgggcctggcctacggcaccaacaagggggacctggtgatctgcaggcctgaggccctgaacagcggcgtggagtactactgggaccagctgaatgagaccgtcttcaccgtgcacagcaacagccgcagcagcgagcggcccggcaccagccgggccacctggaggacagaccgggacatgggcctgatgaatgccatcggcctgcagcccaggaacccagccacctctgtgaccagccagggcacccagaccctggccctgcagctgcagaatgctgagacccagacagagcgggaggtgcctgagcccggcacagctgccagcggccctggagagggggagggctctgaatatggagccagcggggaggatgccctgagccgcatccagaggctgatggccgagggcggcatgacagctgtggtgcagcgggagcagagcaccaccatggcctccatgggcggctttggaaacaacatcatcgtgagccaccgcatccacaggagcagccagacaggaacagagcctggagctgcccacaccagcagcccccagcccagcaccagccggggcctgctgcctgaggccggccagctggccgagcggggcctgagccccaggacagcctcctgggaccagcccggcaccccaggccgggagcccacccagcccaccctgcccagcagcagccctgtgcccatccctgtgtccctgcccagcgctgagggccccaccctgcactgtgagctgaccaacaacaaccacctgctggatggcggcagcagcagaggagatgctgctggccccagaggagagcccaggaacagatag

SEQ ID NO: 144734 - DNA, 3897 bp, Artificial Sequence
  Description of Artificial Sequence: Synthetic coding sequence
atgaaggtggtgcctgagaagaatgctgtgcgcatcctgtggggccgggagcggggggcccgggccatgggcgcccagaggctgctgcaggagctggtggaggacaagacccgctggatgaagtgggagggcaagagggtggagctgcctgacagccccaggagcaccttcctgctggccttctccccagacaggaccctgctggccagcacccacgtgaaccacaacatctacatcacagaggtgaagacaggaaaatgtgtgcacagcctcatcggccacaggaggaccccctggtgtgtgaccttccaccccaccatcagcggcctgattgccagcggctgcctggatggagaggtgcgcatctgggacctgcacggcggcagcgagagctggttcacagacagcaacaatgccatcgccagcctggccttccaccccacagcccagctgctgctgattgccacagccaatgagatccacttctgggactggagcagaagagagccctttgctgtggtgaagacagccagcgagatggagcgggtgcggctggtgcgctttgaccccctgggccactacctgctgacagccatcgtgaaccccagcaaccagcagggagatgatgagcctgagatccccattgatggaacagagctgagccactaccggcagagggccctgctgcagagccagcctgtgcggaggacccccctgctgcacaacttcctgcacatgctgagcagccgcagcagcggcatccaggtgggggagcagagcacagtgcaggacagcgccacccccagccccccacctcctccaccccagcccagcacagagcggcccaggaccagcgcctacatccggctgcggcagagggtgtcctaccccacagctgagtgctgccagcacctgggcatcctgtgcctgtgcagccgctgcagcggcaccagggtgcccagcctgctgccccaccaggacagcgtgcccccagccagcgcccgggccaccacccccagcttctcctttgtgcagacagagcccttccaccccccagagcaggccagcagcacccagcaggaccagggcctgctgaaccggcccagcgccttcagcacagtgcagagcagcacagctggcaacaccctgaggaacctgagcctgggccccacccggcgcagcctgggcggccccctgagcagccaccccagccgctaccaccgggagatcgcccctggcctgactggaagtgagtggaccaggacagtgctgagcctgaacagccgctctgaggccgagagcatgcccccacccaggaccagcgccagctctgtgtccctgctgtctgtgctgcggcagcaggagggcggcagccaggcctctgtgtacaccagcgccacagagggccggggcttccctgccagcggcctggccacagaaagtgatggcggcaatggcagcagccagaacaacagcggcagcatcagacatgagctgcagtgtgacctgcggcgcttcttcctggagtatgaccggctgcaggagctggaccagagcctgtctggagaggccccccagacccagcaggcccaggagatgctgaacaacaacatcgagagcgagaggcctggccccagccaccagcccaccccccacagcagcgagaacaacagcaacctgagccggggccacctgaaccgctgccgggcctgccacaacctgctgaccttcaacaatgacaccctgcgctgggagaggaccacccccaactacagcagtggagaggccagcagctcctggcaggtgcccagcagctttgagagcgtgcccagcagcggcagccagctgccccccctggagaggacagagggccagacccccagcagcagccggctggagctgagcagcagcgccagcccccaggaggagaggacagtgggcgtggccttcaaccaggagaccggccactgggagcgcatctacacccagagcagccgctctggaacagtgtcccaggaggccctgcaccaggacatgcctgaggagagcagcgaggaggacagcctgcggcggcggctgctggagagcagcctcatcagcctgagccgctatgatggagctggcagccgggagcaccccatctacccagaccctgcccggctgagccctgctgcctactatgcccagaggatgatccagtacctgagcagaagagacagcatccggcagaggtccatgagataccagcagaaccggctgcggagcagcaccagcagcagcagcagtgacaaccagggccccagcgtggagggcacagacctggagtttgaagattttgaggacaacggggacaggagccgccaccgggcccccagaaatgccaggatgtctgcccccagcctgggccgctttgtgccccggcgcttcctgctgcctgagtacctgccctatgccggcatcttccacgagcggggccagcccggcctggccacccacagctctgtgaacagagtgctggccggggctgtgattggagatggccagagcgctgtggccagcaacatcgccaacaccacctaccgcctgcagtggtgggacttcaccaagtttgacctgcctgagatcagcaatgcctctgtgaatgtgctggtgcagaactgcaagatctacaatgatgccagctgtgacatctctgcagatggccagctgctggccgccttcatccccagcagccagaggggcttcccagatgagggcatcctggccgtgtacagcctggccccccacaacctgggggagatgctgtacaccaagcgcttcggccccaatgccatctctgtgtccctgagccccatgggccgctacgtgatggtgggcctggccagccgccgcatcctgctgcaccccagcacagagcacatggtggcccaggtgttccggctgcagcaggcccatggaggagagacctccatgagaagagtcttcaacgtgctgtaccccatgcctgctgaccagaggagacatgtgtccatcaacagcgcccgctggctgcctgagcccggcctgggcctggcctacggcaccaacaagggggacctggtgatctgcaggcctgaggccctgaacagcggcgtggagtactactgggaccagctgaatgaaacagtgttcaccgtgcacagcaacagccgcagcagcgagaggcctggcaccagccgggccacctggaggacagaccgggacatgggcctgatgaatgccatcggcctgcagcccagaaatcctgccacctctgtgaccagccagggcacccagaccctggccctgcagctgcagaatgctgagacccagacagagcgggaggtgcctgagcctggaacagctgccagcggccctggagagggggagggctctgaatatggagccagcggagaagatgccctgagccgcatccagaggctgatggccgagggcggcatgacagctgtggtgcagcgggagcagagcaccaccatggcctccatgggcggcttcggcaacaacatcatcgtgagccaccgcatccacaggagcagccagacaggaacagagcccggggccgcccacaccagcagcccccagcccagcaccagccggggcctgctgcctgaggccggccagctggccgagcggggcctgagccccaggacagcctcctgggaccagcccggcaccccaggccgggagcccacccagcccaccctgcccagcagcagccctgtgcccatccctgtgtccctgcccagcgctgagggccccaccctgcactgtgagctgaccaacaacaaccacctgctggatggcggcagcagcagaggagatgctgctggccccagaggagagcccaggaacagatag

SEQ ID NO: 144735 - DNA, 75 bp, Artificial Sequence
  Description of Artificial Sequence: Synthetic coding sequence
atgaaggtggtgcctgagaagaatgctgtgcgcatcctgtggggccgggagcggggggcccgggccatgggctag

SEQ ID NO: 144736 - DNA, 3810 bp, Artificial Sequence; identical to SEQ ID NO: 144733
  Description of Artificial Sequence: Synthetic coding sequence

SEQ ID NO: 144737 - DNA, 3717 bp, Artificial Sequence; identical to SEQ ID NO: 144730
  Description of Artificial Sequence: Synthetic coding sequence

SEQ ID NO: 144738 - DNA, 3540 bp, Artificial Sequence
  Description of Artificial Sequence: Synthetic coding sequence
atgaaggtggtgcctgagaagaatgctgtgcgcatcctgtggggccgggagcggggggcccgggccatgggcgcccagaggctgctgcaggagctggtggaggacaagacccgctggatgaagtgggagggcaagagggtggagctgcctgacagccccaggagcaccttcctgctggccttctccccagacaggaccctgctggccagcacccacgtgaaccacaacatctacatcacagaggtgaagacaggaaaatgtgtgcacagcctcatcggccacaggaggaccccctggtgtgtgaccttccaccccaccatcagcggcctgattgccagcggctgcctggatggagaggtgcgcatctgggacctgcacggcggcagcgagagctggttcacagacagcaacaatgccatcgccagcctggccttccaccccacagcccagctgctgctgattgccacagccaatgagatccacttctgggactggagcagaagagagccctttgctgtggtgaagacagccagcgagatggagcgggtgcggctggtgcgctttgaccccctgggccactacctgctgacagccatcgtgaaccccagcaaccagcagggagatgatgagcctgagatccccattgatggaacagagctgagccactaccggcagagggccctgctgcagagccagcctgtgcggaggacccccctgctgcacaacttcctgcacatgctgagcagccgcagcagcggcatccagacagagcccttccaccccccagagcaggccagcagcacccagcaggaccagggcctgctgaaccggcccagcgccttcagcacagtgcagagcagcacagctggcaacaccctgaggaacctgagcctgggccccacccggcgcagcctgggcggccccctgagcagccaccccagccgctaccaccgggagatcgcccctggcctgactggaagtgagtggaccaggacagtgctgagcctgaacagccgctctgaggccgagagcatgcccccacccaggaccagcgccagctctgtgtccctgctgtctgtgctgcggcagcaggagggcggcagccaggcctctgtgtacaccagcgccacagagggccggggcttccctgccagcggcctggccacagaaagtgatggcggcaatggcagcagccagaacaacagcggcagcatcagacatgagctgcagtgtgacctgcggcgcttcttcctggagtatgaccggctgcaggagctggaccagagcctgtctggagaggccccccagacccagcaggcccaggagatgctgaacaacaacatcgagagcgagaggcctggccccagccaccagcccaccccccacagcagcgagaacaacagcaacctgagccggggccacctgaaccgctgccgggcctgccacaacctgctgaccttcaacaatgacaccctgcgctgggagaggaccacccccaactacagcagtggagaggccagcagctcctggcaggtgcccagcagctttgagagcgtgcccagcagcggcagccagctgccccccctggagaggacagagggccagacccccagcagcagccggctggagctgagcagcagcgccagcccccaggaggagaggacagtgggcgtggccttcaaccaggagaccggccactgggagcgcatctacacccagagcagccgctctggaacagtgtcccaggaggccctgcaccaggacatgcctgaggagagcagcgaggaggacagcctgcggcggctgagccctgctgcctactatgcccagaggatgatccagtacctgagccggcgggacagcatccggcagaggtccatgagataccagcagaaccggctgcggagcagcaccagcagcagcagcagtgacaaccagggccccagcgtggagggcacagacctggagtttgaggactttgaagataatggagacaggagccgccaccgggcccccagaaatgccaggatgtctgcccccagcctgggccgctttgtgccccggcgcttcctgctgcctgagtacctgccctatgccggcatcttccacgagcggggccagcccggcctggccacccacagctctgtgaacagagtgctggccggggctgtgattggagatggccagagcgctgtggccagcaacatcgccaacaccacctaccgcctgcagtggtgggacttcaccaagtttgacctgcctgagatcagcaatgcctctgtgaatgtgctggtgcagaactgcaagatctacaatgatgccagctgtgacatctctgcagatggccagctgctggccgccttcatccccagcagccagaggggcttcccagatgagggcatcctggccgtgtacagcctggccccccacaacctgggggagatgctgtacaccaagagatttggccccaatgccatctctgtgtccctgagccccatgggccgctacgtgatggtgggcctggccagccgccgcatcctgctgcaccccagcacagagcacatggtggcccaggtgttccggctgcagcaggcccacggcggggagacctccatgagaagagtcttcaacgtgctgtaccccatgcctgctgaccagaggagacatgtgtccatcaacagcgcccgctggctgcctgagcccggcctgggcctggcctacggcaccaacaagggggacctggtgatctgcaggcctgaggccctgaacagcggcgtggagtactactgggaccagctgaatgagaccgtcttcaccgtgcacagcaacagccgcagcagcgagcggcccggcaccagccgggccacctggaggacagaccgggacatgggcctgatgaatgccatcggcctgcagcccaggaacccagccacctctgtgaccagccagggcacccagaccctggccctgcagctgcagaatgctgagacccagacagagcgggaggtgcctgagcccggcacagctgccagcggccctggagagggggagggctctgaatatggagccagcggggaggatgccctgagccgcatccagaggctgatggccgagggcggcatgacagctgtggtgcagcgggagcagagcaccaccatggcctccatgggcggctttggaaacaacatcatcgtgagccaccgcatccacaggagcagccagacaggaacagagcctggagctgcccacaccagcagcccccagcccagcaccagccggggcctgctgcctgaggccggccagctggccgagcggggcctgagccccaggacagcctcctgggaccagcccggcaccccaggccgggagcccacccagcccaccctgcccagcagcagccctgtgcccatccctgtgtccctgcccagcgctgagggccccaccctgcactgtgagctgaccaacaacaaccacctgctggatggcggcagcagcagaggagatgctgctggccccagaggagagcccaggaacagatag

SEQ ID NO: 144739 - DNA, 1947 bp, Artificial Sequence
  Description of Artificial Sequence: Synthetic coding sequence
atggagaaggccaggagaggaggagatggagtgccccggggccctgtgctgcacatcgtggtggtgggcttccaccacaagaagggctgccaggtggagttctcctacccacccctcatccctggagatggccatgacagccacaccctgcctgaggagtggaagtacctgcccttcctggccctgcctgatggagcccacaactaccaggaggacacagtgttcttccacctgcccccaagaaatggaaatggagccaccgtgtttggcatcagctgctaccggcagatcgaggccaaggccctgaaggtgcggcaggccgacatcacccgggagaccgtgcagaagtctgtgtgtgtgctgagcaagctgcccctgtatggcctgctgcaggccaagctgcagctgatcacccacgcctactttgaggagaaggacttcagccagatcagcatcctgaaggagctgtatgagcacatgaacagcagcctgggcggggccagcctggagggcagccaggtgtacctgggcctgagcccccgggacctggtgctgcacttccgccacaaggtgctgatcctcttcaagctgatcctgctggagaagaaggtgctcttctacatcagccctgtgaacaagctggtgggcgccctgatgacagtgctgagcctcttccctggcatgattgaacatggcctgagtgactgcagccagtaccggcccaggaagtccatgtctgaagatggcggcctgcaggagagcaacccctgtgctgatgactttgtgtctgccagcacagcagatgtgagccacaccaacctgggcaccatcaggaaggtgatggccggcaaccacggagaagatgctgccatgaagacagaggagcccctcttccaggtggaggacagcagcaagggccaggagcccaatgacaccaaccagtacctgaagccacccagccggcccagcccagacagcagcgagagtgactgggagaccctggaccccagcgtgctggaggaccccaacctgaaggagcgggagcagctgggcagtgaccagaccaacctcttccccaaggacagcgtgcccagcgagagcctgcccatcaccgtgcagccccaggccaacacaggccaggtggtgctgatccctggcctcatcagcggcctggaggaggaccagtatggcatgcccctggccatcttcaccaagggctacctgtgcctgccctacatggccctgcagcagcaccacctgctgagtgatgtgacagtgcggggctttgtggccggggccaccaacatcctcttccggcagcagaagcacctgagtgatgccatcgtggaggtggaggaggccctgatccagatccatgaccctgagctgaggaagctgctgaaccccaccacagctgacctgcgctttgctgactacctggtgagacatgtgacagagaacagagatgatgtgttcctggatggcaccggctgggagggcggagatgagtggatccgggcccagtttgctgtgtacatccacgccctgctggccgccaccctgcagctggacaatgagaagatcctgagtgactatggcaccacctttgtgacagcctggaagaacacccacaactacagagtgtggaacagcaacaagcacccagccctggccgagatcaaccccaaccaccccttccagggccagtacagcgtgtctgacatgaagctgcgcttcagccacagcgtgcagaacagcgagcggggcaagaagattggaaatgtgatggtgaccaccagcagaaatgtggtgcagacaggcaaggctgtgggccagagcgtgggcggggccttcagcagcgccaagacagccatgagctcctggctgagcaccttcaccaccagcaccagccagagcctgacagagcccccagatgagaagccctag

SEQ ID NO: 144740 - DNA, 1773 bp, Artificial Sequence
  Description of Artificial Sequence: Synthetic coding sequence
atggagaaggccaggagaggaggagatggagtgccccggggccctgtgctgcacatcgtggtggtgggcttccaccacaagaagggctgccaggtggagttctcctacccacccctcatccctggagatggccatgacagccacaccctgcctgaggagtggaagtacctgcccttcctggccctgcctgatggagcccacaactaccaggaggacacagtgttcttccacctgcccccaagaaatggaaatggagccaccgtgtttggcatcagctgctaccggcagatcgaggccaaggccctgaaggtgcggcaggccgacatcacccgggagaccgtgcagaagtctgtgtgtgtgctgagcaagctgcccctgtatggcctgctgcaggccaagctgcagctgatcacccacgcctactttgaggagaaggacttcagccagatcagcatcctgaaggagctgtatgagcacatgaacagcagcctgggcggggccagcctggagggcagccaggtgtacctgggcctgagcccccgggacctggtgctgcacttccgccacaaggtgctgatcctcttcaagctgatcctgctggagaagaaggtgctcttctacatcagccctgtgaacaagctggtgggcgccctgatgacagtgctgagcctcttccctggcatgattgaacatggcctgagtgactgcagccagtaccggcccaggaagtccatgtctgaagatggcggcctgcaggagagcaacccctgtgctgatgactttgtgtctgccagcacagcagatgtgagccacaccaacctgggcaccatcaggaaggtgatggccggcaaccacggagaagatgctgccatgaagacagaggagcccctcttccaggtggaggacagcagcaagggccaggagcccaatgacaccaaccagtacctgaagccacccagccggcccagcccagacagcagcgagagtgactgggagaccctggaccccagcgtgctggaggaccccaacctgaaggagcgggagcagctgggcagtgaccagaccaacctcttccccaaggacagcgtgcccagcgagagcctgcccatcaccgtgcagccccaggccaacacaggccaggtggtgctgatccctggcctcatcagcggcctggaggaggaccagtatggcatgcccctggccatcttcaccaagggctacctgtgcctgccctacatggccctgcagcagcaccacctgctgagtgatgtgacagtgcggggctttgtggccggggccaccaacatcctcttccggcagcagaagcacctgagtgatgccatcgtggaggtggaggaggccctgatccagatccatgaccctgagctgaggaagctgctgaaccccaccacagctgacctgcgctttgctgactacctggtgagacatgtgacagagaacagagatgatgtgttcctggatggcaccggctgggagggcggagatgagtggatccgggcccagtttgctgtgtacatccacgccctgctggccgccaccctgcagctggtgctcttccgcatcgtgaatgtgaagaagattggaaatgtgatggtgaccaccagcagaaatgtggtgcagacaggcaaggctgtgggccagagcgtgggcggggccttcagcagcgccaagacagccatgagctcctggctgagcaccttcaccaccagcaccagccagagcctgacagagcccccagatgagaagccctag

SEQ ID NO: 144741 - DNA, 1392 bp, Artificial Sequence
  Description of Artificial Sequence: Synthetic coding sequence
atggagaaggccaggagaggaggagatggagtgccccggggccctgtgctgcacatcgtggtggtgggcttccaccacaagaagggctgccaggtggagttctcctacccacccctcatccctggagatggccatgacagccacaccctgcctgaggagtggaagtacctgcccttcctggccctgcctgatggagcccacaactaccaggaggacacagtgttcttccacctgcccccaagaaatggaaatggagccaccgtgtttggcatcagctgctaccggcagatcgaggccaaggccctgaaggtgcggcaggccgacatcacccgggagaccgtgcagaagtctgtgtgtgtgctgagcaagctgcccctgtatggcctgctgcaggccaagctgcagctgatcacccacgcctactttgaggagaaggacttcagccagatcagcatcctgaaggagctgtatgagcacatgaacagcagcctgggcggggccagcctggagggcagccaggtgtacctgggcctgagcccccgggacctggtgctgcacttccgccacaaggtgctgatcctcttcaagctgatcctgctggagaagaaggtgctcttctacatcagccctgtgaacaagctggtgggcgccctgatgacagtgctgagcctcttccctggcatgattgaacatggcctgagtgactgcagccagtaccggcccaggaagtccatgtctgaagatggcggcctgcaggagagcaacccctgtgctgatgactttgtgtctgccagcacagcagatgtgagccacaccaacctgggcaccatcaggaaggtgatggccggcaaccacggagaagatgctgccatgaagacagaggagcccctcttccaggtggaggacagcagcaagggccaggagcccaatgacaccaaccagtacctgaagccacccagccggcccagcccagacagcagcgagagtgactgggagaccctggaccccagcgtgctggaggaccccaacctgaaggagcgggagcagctgggcagtgaccagaccaacctcttccccaaggacagcgtgcccagcgagagcctgcccatcaccgtgcagccccaggccaacacaggccaggtggtgctgatccctggcctcatcagcggcctggaggaggaccagtatggcatgcccctggccatcttcaccaagtgcacccaggatgtgctgccccaggccaaccacagcttcaagttcctgatcacagaccggcgcatcaccccccggcccctgcggcggcggctggtgtctgccaccctgaccaacatgctgcaggagaagagctgctggaagaagcacatcaagtgcagaagaagagtgcagaagtag

SEQ ID NO: 144742 - DNA, 2532 bp, Artificial Sequence
  Description of Artificial Sequence: Synthetic coding sequence
atgagcagcgccatgctggtgacctgcctgcctgaccccagcagcagcttcagagaagatgccccccggccccctgtgcctggagaggagggggagaccccaccctgccagcccggggtgggcaagggccaggtgaccaagcccatgcctgtgagcagcaacaccaggagaaatgaagatggcctgggggagcctgagggccgggccagcccagacagccccctgacccgctggaccaagagcctgcacagcctgctgggggaccaggatggagcctacctgttccgcaccttcctggagcgggagaagtgtgtggacaccctggacttctggtttgcctgcaatggcttccggcagatgaacctgaaggacaccaagaccctgcgggtggccaaggccatctacaagcgctacatcgagaacaacagcatcgtgtccaagcagctgaagccagccaccaagacctacatcagagatggcatcaagaagcagcagattgacagcatcatgtttgaccaggcccagacagagatccagagcgtgatggaggagaatgcctaccagatgttcctgaccagtgacatctacctggagtatgtgcgctctggaggagaaaatacagcctacatgagcaatggaggcctgggcagcctgaaggtggtgtgtggctacctgcccaccctgaatgaggaggaggagtggacctgtgccgacttcaagtgcaagctgagccccaccgtggtgggcctgagcagcaagaccctgcgggccacagcctctgtgcgcagcacagagaccgtggacagcggctaccgctccttcaagagaagtgaccctgtgaacccctaccacatcggcagcggctacgtgtttgccccagccaccagcgccaatgacagcgagatcagcagtgatgccctgacagatgacagcatgtccatgacagacagctctgtggatggcatccccccctacagagtgggcagcaagaagcagctgcagcgggagatgcacaggtctgtgaaggccaacggccaggtgtccctgccccacttccccaggacccaccggctgcccaaggagatgacccctgtggagcccgccacctttgctgctgagctgatcagccggctggagaagctgaagctggagctggagagccgccacagcctggaggagcggctgcagcagatccgggaggatgaggagcgggagggcagcgagctgaccctgaacagccgggagggcgcccccacccagcaccccctgagcctgctgcccagcggcagctatgaggaggacccccagaccatcctggatgaccacctgagccgggtgctgaagaccccaggctgccagagccctggggtgggccgctacagccccaggagccgcagcccagaccaccaccaccaccaccacagccagtaccacagcctgctgcccccaggcggcaagctgcccccagctgctgccagccctggggcctgccccctgctgggcggcaaaggatttgtgaccaagcagaccaccaagcacgtgcaccaccactacatccaccaccacgctgtgcccaagaccaaggaggagattgaagctgaggccacccagagggtgcactgcttctgccctgggggcagcgagtactactgctacagcaagtgcaagagccacagcaaggcccctgagaccatgcccagcgagcagtttggaggcagccggggcagcaccctgcccaagagaaatggcaagggcacagagcccggcctggccctgcctgcccgggagggcggggcccctgggggcgctggggccctgcagctgccccgggaggagggggacaggagccaggatgtgtggcagtggatgctggagagcgagcggcagagcaagcccaagccccacagcgcccagagcaccaagaaggcctaccccctggagagcgcccggagcagccctggagagcgggccagccgccaccacctgtggggcggcaacagcggccaccccaggaccaccccccgggcccacctgttcacccaggaccctgccatgccacccctgaccccacccaacaccctggcccagctggaggaggcctgccggcggctggccgaggtgtccaagccacccaagcagcgctgctgcgtggccagccagcagagggacaggaaccacagcgccaccgtgcagacaggagccacccccttcagcaaccccagcctggcccctgaggaccacaaggagcccaagaagctggccggcgtgcacgccctgcaggccagcgagctggtggtgacctacttcttctgtggggaggagatcccctacagaaggatgctgaaggcccagagcctgaccctgggccacttcaaggagcagctgagcaagaagggcaactaccgctactacttcaagaaggccagtgatgaatttgcctgtggggctgtgtttgaggagatctgggaggatgagaccgtgctgcccatgtatgagggccgcatcctgggcaaggtggagagaattgattag

SEQ ID NO: 144743 - DNA, 2337 bp, Artificial Sequence
  Description of Artificial Sequence: Synthetic coding sequence
atgagcagcgccatgctggtgacctgcctgcctgaccccagcagcagcttcagagaagatgccccccggccccctgtgcctggagaggagggggagaccccaccctgccagcccggggtgggcaagggccaggtgaccaagcccatgcctgtgagcagcaacaccaggagaaatgaagatggcctgggggagcctgagggccgggccagcccagacagccccctgacccgctggaccaagagcctgcacagcctgctgggggaccaggatggagcctacctgttccgcaccttcctggagcgggagaagtgtgtggacaccctggacttctggtttgcctgcaatggcttccggcagatgaacctgaaggacaccaagaccctgcgggtggccaaggccatctacaagcgctacatcgagaacaacagcatcgtgtccaagcagctgaagccagccaccaagacctacatcagagatggcatcaagaagcagcagattgacagcatcatgtttgaccaggcccagacagagatccagagcgtgatggaggagaatgcctaccagatgttcctgaccagtgacatctacctggagtatgtgcgctctggaggagaaaatacagcctacatgagcaatggaggcctgggcagcctgaaggtggtgtgtggctacctgcccaccctgaatgaggaggaggagtggacctgtgccgacttcaagtgcaagctgagccccaccgtggtgggcctgagcagcaagaccctgcgggccacagcctctgtgcgcagcacagagaccgtggacagcggctaccgctccttcaagagaagtgaccctgtgaacccctaccacatcggcagcggctacgtgtttgccccagccaccagcgccaatgacagcgagatcagcagtgatgccctgacagatgacagcatgtccatgacagacagctctgtggatggcatccccccctacagagtgggcagcaagaagcagctgcagcgggagatgcacaggtctgtgaaggccaacggccaggtgtccctgccccacttccccaggacccaccggctgcccaaggagatgacccctgtggagcccgccacctttgctgctgagctgatcagccggctggagaagctgaagctggagctggagagccgccacagcctggaggagcggctgcagcagatccgggaggatgaggagcgggagggcagcgagctgaccctgaacagccgggagggcgcccccacccagcaccccctgagcctgctgcccagcggcagctatgaggaggacccccagaccatcctggatgaccacctgagccgggtgctgaagaccccaggctgccagagccctggggtgggccgctacagccccaggagccgcagcccagaccaccaccaccaccaccacagccagtaccacagcctgctgcccccaggcggcaagctgcccccagctgctgccagccctggggcctgccccctgctgggcggcaaaggatttgtgaccaagcagaccaccaagcacgtgcaccaccactacatccaccaccacgctgtgcccaagaccaaggaggagattgaagctgaggccacccagagggtgcactgcttctgccctgggggcagcgagtactactgctacagcaagtgcaagagccacagcaaggcccctgagaccatgcccagcgagcagtttggagcccagagcaccaagaaggcctaccccctggagagcgcccggagcagccctggagagcgggccagccgccaccacctgtggggcggcaacagcggccaccccaggaccaccccccgggcccacctgttcacccaggaccctgccatgccacccctgaccccacccaacaccctggcccagctggaggaggcctgccggcggctggccgaggtgtccaagccacccaagcagcgctgctgcgtggccagccagcagagggacaggaaccacagcgccaccgtgcagacaggagccacccccttcagcaaccccagcctggcccctgaggaccacaaggagcccaagaagctggccggcgtgcacgccctgcaggccagcgagctggtggtgacctacttcttctgtggggaggagatcccctacagaaggatgctgaaggcccagagcctgaccctgggccacttcaaggagcagctgagcaagaagggcaactaccgctactacttcaagaaggccagtgatgaatttgcctgtggggctgtgtttgaggagatctgggaggatgaaacagtgctgcccatgtatgagggccgcatcctgggcaaggtggagagaattgattag

SEQ ID NO: 144744 - DNA, 483 bp, Artificial Sequence
  Description of Artificial Sequence: Synthetic coding sequence
atgagcagcgccatgctggtgacctgcctgcctgaccccagcagcagcttcagagaagatgccccccggccccctgtgcctggagaggagggggagaccccaccctgccagcccggggtgggcaagggccaggtgaccaagcccatgcctgtgagcagcaacaccaggagaaatgaagatggcctgggggagcctgagggccgggccagcccagacagccccctgacccgctggaccaagagcctgcacagcctgctgggggaccaggatggagcctacctgttccgcaccttcctggagcgggagaagtgtgtggacaccctggacttctggtttgcctgcaatggcttccggcagatgaacctgaaggacaccaagaccctgcgggtggtgaatgacttctgccacgacatcctcttctacctgtactgcaagctgtgcatcatcaagagcagcttcaaggagaactacctggtgcagtag

SEQ ID NO: 144745 - DNA, 921 bp, Artificial Sequence
  Description of Artificial Sequence: Synthetic coding sequence
atgtctgaggtgaccaggagcctgctgcagcgctggggcgccagcttcagaagaggagctgactttgacagctggggccagctggtggaggccattgatgagtaccagatcctggcccggcacctgcagaaggaggcccaggcccagcacaacaacagcgagttcacagaggagcagaagaagaccatcggcaagatcgccacctgcctggagctgcggtctgctgccctgcagagcacccagagccaggaggagttcaagctggaggacctgaagaagctggagcccatcctgaagaacatcctgacctacaacaaggagttcccctttgatgtgcagcctgtgcccctgcggcgcatcctggcccctggagaggaggagaacctggagtttgaagaagatgaggaggagggcggggccggggccggcagcccagacagcttccctgcccgggtgcccggcaccctgctgccccggctgcccagcgagcccggcatgaccctgctgaccatcagaattgagaagattggcctgaaggatgctggccagtgcatcgacccctacatcaccgtgtctgtgaaggacctgaatggaattgacctgacccctgtgcaggacacccctgtggccagcaggaaggaggacacctacgtgcacttcaacgtggacatcgagctgcagaagcacgtggagaagctgaccaagggagctgccatcttctttgagttcaagcactacaagcccaagaagcgcttcaccagcaccaagtgctttgccttcatggagatggatgagatcaagccaggccccatcgtgattgagctgtacaagaagcccacagacttcaagaggaagaagctgcagctgctgaccaagaagcccctgtacctgcacctgcaccagaccctgcacaaggagtag

SEQ ID NO: 144746 - DNA, 675 bp, Artificial Sequence
  Description of Artificial Sequence: Synthetic coding sequence
atgtctgaggtgaccaggagcctgctgcagcgctggggcgccagcttcagaagaggagctgactttgacagctggggccagctggtggaggccattgatgagtaccagatcctggcccggcacctgcagaaggaggcccaggcccagcacaacaacagcgagttcacagaggagcagaagaagaccatcggcaagatcgccacctgcctggagctgcggtctgctgccctgcagagcacccagagccaggaggagttcaagctggaggacctgaagaagctggagcccatcctgaagaacatcctgacctacaacaaggagttcccctttgatgtgcagcctgtgcccctgcggcgcatcctggcccctggagaggaggagaacctggagtttgaagaagatgaggaggagggcggggccggggccggcagcccagacagcttccctgcccgggtgcctggagctgccatcttctttgagttcaagcactacaagcccaagaagcgcttcaccagcaccaagtgctttgccttcatggagatggatgagatcaagccaggccccatcgtgattgagctgtacaagaagcccacagacttcaagaggaagaagctgcagctgctgaccaagaagcccctgtacctgcacctgcaccagaccctgcacaaggagtag

SEQ ID NO: 144747 - DNA, 849 bp, Artificial Sequence
  Description of Artificial Sequence: Synthetic coding sequence
atgattgccacagaggccgtggtgcgggccgcccagggcctggcccggcacctgcagaaggaggcccaggcccagcacaacaacagcgagttcacagaggagcagaagaagaccatcggcaagatcgccacctgcctggagctgcggtctgctgccctgcagagcacccagagccaggaggagttcaagctggaggacctgaagaagctggagcccatcctgaagaacatcctgacctacaacaaggagttcccctttgatgtgcagcctgtgcccctgcggcgcatcctggcccctggagaggaggagaacctggagtttgaagaagatgaggaggagggcggggccggggccggcagcccagacagcttccctgcccgggtgcccggcaccctgctgccccggctgcccagcgagcccggcatgaccctgctgaccatcagaattgagaagattggcctgaaggatgctggccagtgcatcgacccctacatcaccgtgtctgtgaaggacctgaatggaattgacctgacccctgtgcaggacacccctgtggccagcaggaaggaggacacctacgtgcacttcaacgtggacatcgagctgcagaagcacgtggagaagctgaccaagggagctgccatcttctttgagttcaagcactacaagcccaagaagcgcttcaccagcaccaagtgctttgccttcatggagatggatgagatcaagccaggccccatcgtgattgagctgtacaagaagcccacagacttcaagaggaagaagctgcagctgctgaccaagaagcccctgtacctgcacctgcaccagaccctgcacaaggagtag

SEQ ID NO: 144748 - DNA, 2685 bp, Artificial Sequence
  Description of Artificial Sequence: Synthetic coding sequence
atggcctggcgctgccccaggatgggccgggtgcccctggcctggtgcctggccctgtgtggctgggcctgcatggccccccggggcacccaggccgaggagagcccctttgtgggcaaccctggcaacatcactggagcccggggcctgaccggcaccctgcgctgccagctgcaggtgcagggcgagcccccagaggtgcactggctgagagatggccagatcctggagctggccgacagcacccagacccaggtgcccctgggggaggatgagcaggatgactggatcgtggtgtcccagctgcgcatcaccagcctgcagctgagtgacaccggccagtaccagtgcctggtgttcctgggccaccagacctttgtgtcccagcccggctacgtgggcctggagggcctgccctacttcctggaggagcctgaggacagaacagtggccgccaacacccccttcaacctgagctgccaggcccagggccccccagagcctgtggacctgctgtggctgcaggatgctgtgcccctggccacagcccctggccacggcccccagaggagcctgcacgtgcccggcctgaacaagaccagcagcttcagctgtgaggcccacaatgccaagggcgtgaccaccagcaggacagccaccatcaccgtgctgccccagcagcccaggaacctgcacctggtgtcccggcagcccacagagctggaggtggcctggaccccaggcctgagcggcatctaccccctgacccactgcaccctgcaggccgtgctgagcaatgatggcatgggcatccaggccggggagccagaccccccagaggagcccctgaccagccaggcctctgtgcccccccaccagctgcggctgggcagcctgcacccccacaccccctaccacatccgggtggcctgcaccagcagccagggccccagctcctggacccactggctgcctgtggagaccccagagggcgtgcccctgggccccccagagaacatcagcgccaccagaaatggcagccaggcctttgtgcactggcaggagccccgggcccccctgcagggcaccctgctgggctaccgcctggcctaccagggccaggacaccccagaggtgctgatggacatcggcctgcggcaggaggtgaccctggagctgcagggagatggctctgtgagcaacctgactgtgtgtgtggccgcctacacagctgctggagatggcccctggagcctgcctgtgcccctggaggcctggaggcctggccaggcccagcctgtgcaccagctggtgaaggagcccagcaccccagccttctcctggccctggtggtacgtgctgctgggcgctgtggtggccgccgcctgtgtgctgatcctggccctcttcctggtgcacaggaggaagaaggagaccaggtatggagaggtgtttgagcccaccgtggagcggggggagctggtggtgcgctacagagtgaggaagagctacagcaggaggaccacagaggccaccctgaacagcctgggcatcagcgaggagctgaaggagaagctgagagatgtgatggtggacagacacaaggtggccctgggcaagaccctgggggagggggagtttggagctgtgatggagggccagctgaaccaggatgacagcatcctgaaggtggccgtgaagaccatgaagatcgccatctgcaccaggtctgagctggaggacttcctgtctgaggccgtgtgcatgaaggagtttgaccaccccaacgtgatgaggctgattggagtgtgcttccagggcagcgagcgggagagcttccctgcccctgtggtgatcctgcccttcatgaagcatggagacctgcacagcttcctgctgtacagccggctgggggaccagcctgtgtacctgcccacccagatgctggtgaagttcatggctgacatcgccagcggcatggagtacctgagcaccaagcgcttcatccaccgggacctggccgccaggaactgcatgctgaatgaaaacatgtctgtgtgtgtggccgactttggcctgagcaagaagatctacaatggagactactaccggcagggccgcatcgccaagatgcctgtgaagtggatcgccatcgagagcctggccgacagagtgtacaccagcaagagtgatgtgtggagctttggagtgaccatgtgggagatcgccacccggggccagaccccctacccaggagtggagaacagcgagatctatgactacctgcggcagggcaaccggctgaagcagcctgctgactgcctggatggcctgtatgccctgatgagccgctgctgggagctgaacccccaggaccggcccagcttcacagagctgcgggaggacctggagaacaccctgaaggccctgcccccagcccaggagccagatgagatcctgtatgtgaacatggatgaaggaggcggctacccagagcccccaggagctgctggaggagctgacccccccacccagcctgaccccaaggacagctgcagctgcctgacagctgctgaggtgcaccctgctggccgctacgtgctgtgccccagcaccacccccagccctgcccagcctgctgaccggggcagccctgctgcccctggccaggaggatggagcctag

SEQ ID NO: 144749 - DNA, 2658 bp, Artificial Sequence
  Description of Artificial Sequence: Synthetic coding sequence
atggcctggcgctgccccaggatgggccgggtgcccctggcctggtgcctggccctgtgtggctgggcctgcatggccccccggggcacccaggccgaggagagcccctttgtgggcaaccctggcaacatcactggagcccggggcctgaccggcaccctgcgctgccagctgcaggtgcagggcgagcccccagaggtgcactggctgagagatggccagatcctggagctggccgacagcacccagacccaggtgcccctgggggaggatgagcaggatgactggatcgtggtgtcccagctgcgcatcaccagcctgcagctgagtgacaccggccagtaccagtgcctggtgttcctgggccaccagacctttgtgtcccagcccggctacgtgggcctggagggcctgccctacttcctggaggagcctgaggacagaacagtggccgccaacacccccttcaacctgagctgccaggcccagggccccccagagcctgtggacctgctgtggctgcaggatgctgtgcccctggccacagcccctggccacggcccccagaggagcctgcacgtgcccggcctgaacaagaccagcagcttcagctgtgaggcccacaatgccaagggcgtgaccaccagcaggacagccaccatcaccgtgctgccccagcagcccaggaacctgcacctggtgtcccggcagcccacagagctggaggtggcctggaccccaggcctgagcggcatctaccccctgacccactgcaccctgcaggccgtgctgagcaatgatggcatgggcatccaggccggggagccagaccccccagaggagcccctgaccagccaggcctctgtgcccccccaccagctgcggctgggcagcctgcacccccacaccccctaccacatccgggtggcctgcaccagcagccagggccccagctcctggacccactggctgcctgtggagaccccagagggcgtgcccctgggccccccagagaacatcagcgccaccagaaatggcagccaggcctttgtgcactggcaggagccccgggcccccctgcagggcaccctgctgggctaccgcctggcctaccagggccaggacaccccagaggtgctgatggacatcggcctgcggcaggaggtgaccctggagctgcagggagatggctctgtgagcaacctgactgtgtgtgtggccgcctacacagctgctggagatggcccctggagcctgcctgtgcccctggaggcctggaggcctgtgaaggagcccagcaccccagccttctcctggccctggtggtacgtgctgctgggcgctgtggtggccgccgcctgtgtgctgatcctggccctcttcctggtgcacaggaggaagaaggagacccgctacggggaggtgtttgagcccaccgtggagcggggggagctggtggtgcgctacagagtgaggaagagctacagcaggaggaccacagaggccaccctgaacagcctgggcatcagcgaggagctgaaggagaagctgagagatgtgatggtggacagacacaaggtggccctgggcaagaccctgggggagggggagtttggagctgtgatggagggccagctgaaccaggatgacagcatcctgaaggtggccgtgaagaccatgaagatcgccatctgcaccaggtctgagctggaggacttcctgtctgaggccgtgtgcatgaaggagtttgaccaccccaacgtgatgaggctcatcggcgtgtgcttccagggcagcgagcgggagagcttccctgcccctgtggtgatcctgcccttcatgaagcacggggacctgcacagcttcctgctgtacagccggctgggggaccagcctgtgtacctgcccacccagatgctggtgaagttcatggctgacatcgccagcggcatggagtacctgagcaccaagcgcttcatccaccgggacctggccgccaggaactgcatgctgaatgaaaacatgtctgtgtgtgtggccgactttggcctgagcaagaagatctacaacggggactactaccggcagggcagaattgccaagatgcctgtgaagtggatcgccatcgagagcctggccgacagagtgtacaccagcaagagtgatgtgtggagctttggagtgaccatgtgggagatcgccacccggggccagaccccctacccaggagtggagaacagcgagatctatgactacctgcggcagggcaaccggctgaagcagcctgctgactgcctggatggcctgtatgccctgatgagccgctgctgggagctgaacccccaggaccggcccagcttcacagagctgcgggaggacctggagaacaccctgaaggccctgcccccagcccaggagccagatgagatcctgtatgtgaacatggatgagggcggcggctacccagagcccccaggagctgctgggggcgctgacccccccacccagcctgaccccaaggacagctgcagctgcctgacagctgctgaggtgcaccctgctggccgctacgtgctgtgccccagcaccacccccagccctgcccagcctgctgaccggggcagccctgctgcccctggccaggaggatggagcctag

SEQ ID NO: 144750 - DNA, 2439 bp, Artificial Sequence
  Description of Artificial Sequence: Synthetic coding sequence
atggagcccctgggcaactggaggagcctgcgggcccccctgccccccatgctgctgctgctgctgctgcaggtggccggccctgtgggcgccctggccgagaccctgctgaatgccccccgggccatgggcaccagcagcagcccccccagccctgcctctgtggtggcccctggcaccaccctgtttgaggagagccggctgcctgtgttcaccctggactacccccacgtgcagatcccctttgagatcaccctgtggatcctgctggccagcctggccaagattggcttccacctgtaccacaagctgcccaccatcgtgcctgagagctgcctgctgatcatggtgggcctgctgctgggcggcatcatcttcggcgtggatgagaagagccccccagccatgaagacagatgtgttcttcctgtacctgctgccccccatcgtgctggatgctggctacttcatgcccacccggcccttctttgagaacatcggcaccatcttctggtatgctgtggtgggcaccctgtggaacagcatcggcatcggcgtgtccctgtttggcatctgccagatcgaggccttcggcctgagtgacatcaccctgctgcagaacctgctgtttggcagcctcatctctgctgtggaccctgtggccgtgctggccgtgtttgagaacatccacgtgaatgagcagctgtacatcctggtgtttggagagagcctgctgaatgatgctgtgacagtggtgctgtacaacctcttcaagagcttctgccagatgaagaccatcgagaccattgatgtgtttgctggcatcgccaacttctttgtggtgggcattggaggagtgctgattggcatcttcctgggcttcatcgccgccttcaccacccgcttcacccacaacatccgggtgattgagcccctgtttgtgttcctgtacagctacctgagctacatcacagctgagatgttccacctgagcggcatcatggccatcacagcctgtgccatgaccatgaacaagtatgtggaggagaatgtgtcccagaagagctacaccaccatcaagtacttcatgaagatgctgagctctgtgtctgagaccctcatcttcatcttcatgggcgtgtccacagtgggcaagaaccacgagtggaactgggcctttgtgtgcttcaccctggccttctgcctgatgtggagggccctgggcgtgtttgtgctgacccaggtgatcaaccgcttccgcaccatccccctgaccttcaaggaccagttcatcatcgcctacggcggcctgcggggggccatctgctttgccctggtgttcctgctgcctgctgctgtgttccccaggaagaagctgttcatcacagctgccatcgtggtgatcttcttcaccgtcttcatcctgggcatcaccatccggcccctggtggagttcctggatgtgaagaggagcaacaagaagcagcaggccgtgtctgaggagatctactgccgcctgtttgaccacgtgaagacaggaattgaagatgtgtgtggccactggggccacaacttctggagggacaagttcaagaagtttgatgacaagtacctgaggaagctgctgatccgggagaaccagcccaagagcagcatcgtgtccctgtacaagaagctggagatcaagcacgccatcgagatggccgagaccggcatgatcagcacagtgcccacctttgccagcctgaatgactgccgggaggagaagatcaggaaggtgaccagcagcgagacagatgagatccgggagctgctgagcaggaacctgtaccagatccggcagaggaccctgagctacaacagacacagcctgacagctgacaccagcgagcggcaggccaaggagatcctgatcagaagaagacacagcctgcgggagagcatcaggaaggacagcagcctgaaccgggagcaccgggccagcaccagcaccagccgctacctgagcctgcccaagaacaccaagctgcctgagaagctgcagaagaggaggaccatcagcattgctgatggcaacagcagtgacagtgatgctgatgctggcaccaccgtgctgaacctgcagccccgggcccggcgcttcctgcctgagcagttcagcaagaagagcccccagagctacaagatggagtggaagaatgaggtggatgtggacagcggccgggacatgcccagcaccccacccaccccccacagccgggagaagggcacccagaccagcggcctgctgcagcagcccctgctgagcaaggaccagagcggcagcgagcgggaggacagcctgacagagggcatcccccccaagcccccaccccggctggtgtggagggccagcgagcccggcagcaggaaggccaggtttggaagtgagaagccctag

SEQ ID NO: 144751 - DNA, 681 bp, Artificial Sequence
  Description of Artificial Sequence: Synthetic coding sequence
gctgagggcaagtggggcctggcccacggccgggcagaggcccacgtgtggccaggccagggcggctggaggctgggccccccccagggccgctggacaggcagcagccccctgctggacatcgtgggcggcaggaaggcccggccccggcagttccccttcctggccagcatccagaaccagggccgccacttctgtggcggggccctgatccacgccaggtttgtgatgacagctgccagctgcttccagagccagaaccctggggtgtccacagtggtgctgggcgcctatgacctgcggcggcgggagcggcagagccggcagaccttcagcatcagctccatgtctgaaaatggctatgacccccagcagaacctgaatgacctgatgctgctgcagctggaccgggaggccaacctgaccagctctgtgaccatcctgcccctgcccctgcagaatgccaccgtggaggccggcacccgctgccaggtggccggctggggcagccagaggtctgggggccgcctgagccgcttccccaggtttgtgaatgtgacagtgaccccagaggaccagtgccggcccaacaacgtgtgcacaggagtgctgacccggcggggcggcatctgcaatgtgtctgccccctgtggcggccggcggggccctgagcgctactag

SEQ ID NO: 144752 - DNA, 7875 bp, Artificial Sequence
  Description of Artificial Sequence: Synthetic coding sequence
atgttcagaagagcccggctgtctgtgaagcccaacgtgcggcctggggtgggcgcccggggcagcacagccagcaacccccagaggggccgggagagcccccggcccccagaccctgccacagattctgccagcaagccagctgagcccacagatgtgcccaccgtggactttggaggagctgagccccaggagaaggcccccaggagcagcacagagaagacaggaggagacaatgatgtggaggagagcagccgcagcagcagcacagtgtcccagaggaggaagaggatcagcagcaccagcagcctggtgaagagctctgtgtctgtgcccagcgagagccaccccctgagcaccatcaaccaggaggccccccagcccacagccaccagcaccaaggagaagcagccctgcagcgaccgctaccgcatctacaaggcccagaagctgcgggagatgctgaaggaggagctgaggaaggagaagaagcagtggaagaacaagtatgccatcaatgaaagccagaggcccccagacaggagcaagatgaccatgagggacttcatctactacctgcctgacaacaaccccatgaccagcagcctggagcaggagaagaagacagagaagcccagcacccctgtgcagacccgggagcaggagggcaagagcaccccaaatgctgaggacaatgagatggaggaggagacagatgatggccccctgctggtgccccgggtgaaggtggccgaggatggcagcatcatcctggatgaggagagcctgactgtggaggtgctgcggaccaagggcccctgtgtggtggaggagaatgaccccatctttgagcggggcagcaccaccacctacagcagcttcaggaagaactactacagcaagccctggagcaacaaggagacagacatgttcttcctggccatctccatggtgggcacagacttctccatgattggccagctgttcccccaccgggccagaattgagatcaagaacaagttcaagcgggaggagaagaccaacggctggagaattgacaaggccttccaggagaagaggccctttgattttgacttctttgcccacctgctgcagaaggtgctggccgaggaggagaagaggaagcagaagtctgtgaagaaccacagcctgaaggagaagaagagcaccaagcccaggaagaatgtgaaggtgaagaaggtggcctgtgagggcgtgaacaatgaccctgatgagagcatgagcagccgcatcagtgacacagagaggagccagaaggatgcccagacagtggaggaggagagcctgaccctgagccgggaggatgctgagcaggtggccctggaggtggacctgaaccagaagaagagaagaaggaagaagcaggatggagccaatgagctgggcgtgaacaacctgctggagaatgccaccgtgcaggccggccccagcaagggggagaagcacaagaacaagtgccaggccatccggcctgagctgaaggagggagaatgttccaaggagcagatgctgagctgcacccagaacattgatggcatcgtgggctttgccagcacagagaaggtggagaagaggacagaccccatcctgagcctgagcaaccagcaggatgccacctctgtggccacagagagcagcgagagcagcaccagtgacctgcccagctttgaggtgggcatccgggccctgtgtgaggtgaacaatgctgagggcagctgcatcgaggagagaaatgtggacctgaagaacaacagcctggagattgaccagacagaaaatgtgaagcccatgctgcggggccgcttccagaggcccaagcccaacctgagccgggccggcaagaagtctgtgctgagccagggcaagacagaaagtgagagcaagaacagccacagcaagacctctgtggagaagaaccacgtggagaaggacaagatgaacaccctggacatcctgaggatggagaccacagagcgggagaaccctgaggccgagaccgtgtctgtgctgggggagaagaactgcctgcaggagggcagccagctgaaggccctgcggcctgtgcaggtgcggggccgcctgcagaagcccaagcccaatgccggcaaggctgctgagaggaaggagatcctgatcagccaggaggagattggagccaacgtggagaagaatgaaaatgaaagctgtgccgaccgggacaccccccagcacatggaggaccagagcaggaaggactttgaggaggaggatgtgatcctgcagcctgagaagaatgacagcttccagaatgtgcagccagatgagcccaaggtgctgaatgaatgtctgtctgtgcaggagaacaacaaggccaacaagctgaaccaggtgcccatcctgcggacccgcttccagaagcccaagcccaacatcggccggggcaccggccggcgggagatcagcagcaaggaggaggtgctggagaagatcctggtgtctggagagatggctgctgccctgcgggagaccgtgcggctggacaccagccccaaggagatggtgcctgctgagatcaacaccaaggagatgcagagcgacctgaaggagactggaagaagagccatcagcccccgggagaagatcctggatgtgattgatgacaccatcgagatggagaccggcctgaaggccatgggccgggagatctgcctgcgggagaagaccccagaggtgattgatgccacagaggagattgacaaggacctggaggaggccggccggcgggagatcagcccccagaagaatggacctgaggaggtgaagcccctgggggaggtggagacagacctgaaggccactggaaatgaaagcagcccccgggagaagaccccagaggtgacagatgccacagaggagattgacaagaacctggaggagactggaagaaggaagatcagcccccgggagaatggacctgaggaggtgaagcctgtggatgagatggagacagacctgaatgccaccggccgggagagcagcccccgggagaagaccccagaggtgattgatgccacagaggagattgacctggaggagacagagcgggaggtgagcccccaggagaatggcctggaggaggtgaagcccctgggggagatggagacagacctgaaggccaccggccgggacagcttcccccggggcaagaccccagaggtgattgatgccatcgaggagattgaaattgacctggaggagacagagcgggagatcagcccccaggagaatggcctggaggaggtgaagcccctgggggagatgcagacagacctgaaggccaccggccgggagatcagcccccgggagaagaccccagaggtgattgatgccacagaggagattgacaaggacctggaggagaccggccggcgggagatcagcccagaagaaaatggacctgaggaggtgaagcctgtggatgagatggagacagacctgaagaccaccggccgggagggcagcagccgggagaagacccgggaggtgattgatgctgctgaggtgattgaaacagacctggaggagacagagcgggagatcagcccccaggagaatggacctgaggaggtgaagcctgtgggcaagatggagacagacctgaaggagatccgggaggagatcagccagcgggagaaggtgctggccgagttcagcgccatccgggagaaggagattgacctgaaggagaccgggaagagggacatccccatcatggagaaggtgtctgggaagatggctgtggtggaggagatggaggccgacctgaaggagaccgggaaggagaacttccgggagcggggcagcgaggagatctgtgtgacagaggagaaggtggccgagctgaagcagacaggcaagacagacatcagcccccgggagaatgagctggaggagaccagcaccagccggcagacagacacccacctgatgcagagcggcagcaatgacttctctgctgtgcccagcctggacatccagaacatcagcagcgaggtgctgtccatgatgcacacccctgtggaggagaagagaaattctgagaaggaggtgagcagccacttcagccacttcaagatcagcagccagacccatgaaagtgacaagacagaggtgcagggcatccagagcccagatgtgcctgagcagttcagtgacatcaacctgagcaagagcctgccccaggagcagaagcccctggagatcaagccagccccctttgtgcgcagccgcttcaagaggcccaagcccaacctggcccgggccgccctgaagcgggagaccacagaaagtgagaagtacatctatgagaagaagtctgagaccaagaagatggagaccatcgtgatgcaggagaacaatgagcagacagacaccctgcccagccagcatgatgaggccagcctgatgatcagccgggagaaggacaccctgggccacagaaatgaggaggccgtcatcctgccctgcacccagacagaaagaaacctgagccccagcaacagctgtgagcccaaggaggagagccagagcgcccctgtgcagaagaatgattctgtggtgtctgtgggcaccaacaacgtgaacaccttccagcaggagatgaaggagagcgtcatccagacagcccggcaggtgcggggccgcctgcagaggccccggcccaacatcaggaagacaggccagaggcagatcgtggacaagggggaggccaagggcatcatcaaggagggccgcaccatcctgcccaaggatgaaacagagaagaaggtgctgactgtgagcaacagccagattgaaacagaaattgaggtgcccagcagcgctgtgcctgagcacaggatgtatgagaaccagagccaggtggtgctggtggagaacctgcacgtgaacaagaccaatgagaccatcagacatgagaacaagccctacgtgcccagcagcgcccagatgaccaggaggaagttccagaaggccaagcccaacctgggccgggcccacagcaagaaggaggagcctgtgctggagaaggtgaccacagaccagagcaaggagggcaagccagaggaccacctgctgcagaagggggccagcaacacccagctgctgctgaaggagaaggccgagctgctgaccagcctggaggtgtctgccaggaaggactgtgtgggcagcaaggagagcgccctggccaagattgatgctgagctggaggaggtgggccccagccggcgggtgggggaggagaccgtgggggacaacagccccagctctgtggtggaggagcagtacctgaacaagctgaccagctgcccccagcccctgaatgagaccagctacagcaagatcgccctggatggcaagaccaccatcagcagcaccagtgaatatgaaagaaacagaggagagcggcgcagccacaagaagttcaagcccaacgtgacccggggccggggcagcaagagggtgcggggcaagaccagcaagaaggagccccgggccagcaaggccatgctggtgaccctgcgggccagccaggaggaggatgatgatgctgatgactttgaaagtgactatgaggaggagagctaccacctggcccctgaggaggtgaacaaggcccctgtgtttgtgcctgtgggcctgcggagccctgagcctgtgtctgcccagatcgaggagaccatggaggagctggagatcaccgtgaatgtgcctgatgtgggctgcatcgctgtggtggagcacgagctgcccaacacagatgtgaccacagaggagatgaagcaggaggagaacctgtctgtgccctttgagatgaccaccagcgagcacatccaggatgagcccggcaccaatgatggcagcacagaagctgccatcaccctgctgaccatgggagacctggtgctgcagagcgagatcagcagcgagcagggagatgtgggcgtgtgcatcatcccccacgtgcacagcaaggacaagagccacatccccagcagcctggacaacgtgaaccacaagatcgtgcatgagtgccaggagctgagcagccctgtgatcaccaccagccctgccagctttgaggagaacaagatcgtgctggaggagcagagcagccgggaggagatcagcctgatggagaaggtgaaggaaaatgccacccccaccaggaacaccatcagcaaggtgaccagcaacctgcgcatccgcagccggctggccaagcccaagcccaacctggagaagaccctgggcaccaaccggctggatgactaccaggaggtgagcagcctgtgtgtgaccaagggagctgagatggagacccagcgggagacagagaagaatgccagcaaggccacagagctggagaacaagaacctgggccctgtgaccacagctgagaacaaggaccagagcaagctggcctgtgtgcacggcatcaagggcaccagcatcagcagcgaggtgaacctgacagaaagaaatgaaaaccaggaggagagcagccaggaggtgcacatgctgtctgtggcccctgtggccagcagcgagaccggcccctgcaccctgggcctggaccggggcctgggagaaaattctgtggaggagccccagatcaaggacagcaaaggagacagcgtgctgaccctgcctgtgcctgagtacacccccaccagcatccctgaggtgcagcaggagaacatcatcaacccccaggacctgactgtgaacctggtggccaacgtgccccaggatggagaagatgagcaggccttcatcctgaccctggtggagatcccagccaatgctgtggaggagttcacagatgccacagcccagttcatgcccaaccccctgctgcctgcccccatcctggtgaagtctgtgaacacagaggagcggggggacatgagcatctgcctgcctgccacctctgtgggccaggatgccatgggcctgagcatcagcggccgggacaacagcaagaagcccccagacaacctggacctggtgtccaggaagcgcttccagtgccgcctggacaagaatgaccacatccccccagccaagaagaggagcctgaccctgagagatgactgccaggagtacaccacagaggtgcacagcaaggagctgaccaacgtgtttgaggagactggagagagccacaagggccaggacatcttcctgaccagcggcagcaccctgaccaccccagagccccagaggcagcaggtggaggccgccttccagagccggggcagccgcagcccagatgcctgcatggacaagaatgtgccccagctgccccaggatgagatgattgtgtctgacaaggaggagaggacagatgctgcccccaagagccagcagatggacagcaggaccagcagcagcaaggccagcctgagccggcccggccggcggcccctgggcttcctgagcctcatctgcagcaagaacagcctggagagtgatgagcccatgcaggtgcacagcaagaagaggctgaagcccctcatccctggcctgaggaagaagctgaagaggagcaaccccttcaatgaaagccaggagaagaaccgggagagcagtgacctgctgcccagccccagcgtcatcaccacccagagcgagaacatcagcagcagcgccacccaggtgtcctgtgaccagcccctgctgaaggagggctacaagagcgcccagaagagggccccccagggcgaggccaccaccgtgtctgagtacttcttcaatgacatcttcatcgaggtggatgaaacagaatag

SEQ ID NO: 144753 - DNA, 1392 bp, Artificial Sequence
  Description of Artificial Sequence: Synthetic coding sequence
atgctggtgaccctgcgggccagccaggaggaggatgatgatgctgatgactttgaaagtgactatgaggaggagagctaccacctggcccctgaggaggtgaacaaggcccctgtgtttgtgcctgtgggcctgcggagccctgagcctgtgtctgcccagatcgaggagaccatggaggagctggagatcaccgtgaatgtgcctgatgtgggctgcatcgctgtggtggagcacgagctgcccaacacagatgtgaccacagaggagatgaagcaggaggagaacctgtctgtgccctttgagatgaccaccagcgagcacatccaggatgagcccggcaccaatgatggcagcacagaggccgccatcaccctgctgaccatgggagacctggtgctgcagagcgagatcagcagcgagcagggagatggagtgtgcatcatcccccacgtgcacagcaaggacaagagccacatccccagcagcctggacaacgtgaaccacaagatcgtgcatgagtgccaggagctgagcagccctgtgatcaccaccagccctgccagctttgaggagaacaagatcgtgctggaggagcagagcagccgggaggagatcagcctgatggagaaggtgaaggaaaatgccacccccaccaggaacaccatcagcaaggtgaccagcaacctgcgcatccgcagccggctggccaagcccaagcccaacctggagaagaccctgggcaccaaccggctggatgactaccaggaggtgagcagcctgtgtgtgaccaagggagctgagatggagacccagcgggagacagagaagaatgccagcaaggccacagagctggagaacaagaacctgggccctgtgaccacagctgagaacaaggaccagagcaagctggcctgtgtgcacggcatcaagggcaccagcatcagcagcgaggtgaacctgacagaaagaaatgaaaaccaggaggagagcagccaggaggtgcacatgctgtctgtggcccctgtggccagcagcgagaccggcccctgcaccctgggcctggaccggggcctgggagaaaattctgtggaggagccccagatcaaggacagcaaaggagacagcgtgctgaccctgcctgtgcctgagtacacccccaccagcatccctgaggtgcagcaggagaacatcatcaacccccaggacctgactgtgtttgtgtaccagcagctgcagctggtgaagatgccctgggtgtacctgttcctggaggagatcatcctgaagagccgcctcatcatctggatcctgtacctgggccgggacttcaatgccggcctcatcaagatgaccaccttcctgctgcccaagaatgtgcacagcctgtag

SEQ ID NO: 144754 - DNA, 2445 bp, Artificial Sequence
  Description of Artificial Sequence: Synthetic coding sequence
atgttcagaagagcccggctgtctgtgaagcccaacgtgcggcctggggtgggcgcccggggcagcacagccagcaacccccagaggggccgggagagcccccggcccccagaccctgccacagattctgccagcaagccagctgagcccacagatgtgcccaccgtggactttggaggagctgagccccaggagaaggcccccaggagcagcacagagaagacaggaggagacaatgatgtggaggagagcagccgcagcagcagcacagtgtcccagaggaggaagaggatcagcagcaccagcagcctggtgaagagctctgtgtctgtgcccagcgagagccaccccctgagcaccatcaaccaggaggccccccagcccacagccaccagcaccaaggagaagcagccctgcagcgaccgctaccgcatctacaaggcccagaagctgcgggagatgctgaaggaggagctgaggaaggagaagaagcagtggaagaacaagtatgccatcaatgaaagccagaggcccccagacaggagcaagatgaccatgagggacttcatctactacctgcctgacaacaaccccatgaccagcagcctggagcaggagaagaagacagagaagcccagcacccctgtgcagacccgggagcaggagggcaagagcaccccaaatgctgaggacaatgagatggaggaggagacagatgatggccccctgctggtgccccgggtgaaggtggccgaggatggcagcatcatcctggatgaggagagcctgactgtggaggtgctgcggaccaagggcccctgtgtggtggaggagaatgaccccatctttgagcggggcagcaccaccacctacagcagcttcaggaagaactactacagcaagccctggagcaacaaggagacagacatgttcttcctggccatctccatggtgggcacagacttctccatgattggccagctgttcccccaccgggccagaattgagatcaagaacaagttcaagcgggaggagaagaccaacggctggagaattgacaaggccttccaggagaagaggccctttgattttgacttctttgcccacctgctgcagaaggtgctggccgaggaggagaagaggaagcagaagtctgtgaagaaccacagcctgaaggagaagaagagcaccaagcccaggaagaatgtgaaggtgaagaaggtggcctgtgagggcgtgaacaatgaccctgatgagagcatgagcagccgcatcagtgacacagagaggagccagaaggatgcccagacagtggaggaggagagcctgaccctgagccgggaggatgctgagcaggtggccctggaggtggacctgaaccagaagaagagaagaaggaagaagcaggatggagccaatgagctgggcgtgaacaacctgctggagaatgccaccgtgcaggccggccccagcaagggggagaagcacaagaacaagtgccaggccatccggcctgagctgaaggagggagaatgttccaaggagcagatgctgagctgcacccagaacattgatggcatcgtgggctttgccagcacagagaaggtggagaagaggacagaccccatcctgagcctgagcaaccagcaggatgccacctctgtggccacagagagcagcgagagcagcaccagtgacctgcccagctttgaggtgggcatccgggccctgtgtgaggtgaacaatgctgagggcagctgcatcgaggagagaaatgtggacctgaagaacaacagcctggagattgaccagacagaaaatgtgaagcccatgctgcggggccgcttccagaggcccaagcccaacctgagccgggccggcaagaagtctgtgctgagccagggcaagacagaaagtgagagcaagaacagccacagcaagacctctgtggagaagaaccacgtggagaaggacaagatgaacaccctggacatcctgaggatggagaccacagagcgggagaaccctgaggccgagaccgtgtctgtgctgggggagaagaactgcctgcaggagggcagccagctgaaggccctgcggcctgtgcaggtgcggggccgcctgcagaagcccaagcccaatgccggcaaggctgctgagaggaaggagatcctgatcagccaggaggagattggagccaacgtggagaagaatgaaaatgaaagctgtgccgaccgggacaccccccagcacatggaggaccagagcaggaaggactttgaggaggaggatgtgatcctgcagcctgagaagaatgacagcttccagaatgtgcagccagatgagcccaaggtgctgaatgaatgtctgtctgtgcaggagaacaacaaggccaacaagctgaaccaggtgcccatcctgcggacccgcttccagaagccctag

SEQ ID NO: 144755 - DNA, 2541 bp, Artificial Sequence
  Description of Artificial Sequence: Synthetic coding sequence
atgttcagaagagcccggctgtctgtgaagcccaacgtgcggcctggggtgggcgcccggggcagcacagccagcaacccccagaggggccgggagagcccccggcccccagaccctgccacagattctgccagcaagccagctgagcccacagatgtgcccaccgtggactttggaggagctgagccccaggagaaggcccccaggagcagcacagagaagacaggaggagacaatgatgtggaggagagcagccgcagcagcagcacagtgtcccagaggaggaagaggatcagcagcaccagcagcctggtgaagagctctgtgtctgtgcccagcgagagccaccccctgagcaccatcaaccaggaggccccccagcccacagccaccagcaccaaggagaagcagccctgcagcgaccgctaccgcatctacaaggcccagaagctgcgggagatgctgaaggaggagctgaggaaggagaagaagcagtggaagaacaagtatgccatcaatgaaagccagaggcccccagacaggagcaagatgaccatgagggacttcatctactacctgcctgacaacaaccccatgaccagcagcctggagcaggagaagaagacagagaagcccagcacccctgtgcagacccgggagcaggagggcaagagcaccccaaatgctgaggacaatgagatggaggaggagacagatgatggccccctgctggtgccccgggtgaaggtggccgaggatggcagcatcatcctggatgaggagagcctgactgtggaggtgctgcggaccaagggcccctgtgtggtggaggagaatgaccccatctttgagcggggcagcaccaccacctacagcagcttcaggaagaactactacagcaagccctggagcaacaaggagacagacatgttcttcctggccatctccatggtgggcacagacttctccatgattggccagctgttcccccaccgggccagaattgagatcaagaacaagttcaagcgggaggagaagaccaacggctggagaattgacaaggccttccaggagaagaggccctttgattttgacttctttgcccacctgctgcagaaggtgctggccgaggaggagaagaggaagcagaagtctgtgaagaaccacagcctgaaggagaagaagagcaccaagcccaggaagaatgtgaaggtgaagaaggtggcctgtgagggcgtgaacaatgaccctgatgagagcatgagcagccgcatcagtgacacagagaggagccagaaggatgcccagacagtggaggaggagagcctgaccctgagccgggaggatgctgagcaggtggccctggaggtggacctgaaccagaagaagagaagaaggaagaagcaggatggagccaatgagctgggcgtgaacaacctgctggagaatgccaccgtgcaggccggccccagcaagggggagaagcacaagaacaagtgccaggccatccggcctgagctgaaggagggagaatgttccaaggagcagatgctgagctgcacccagaacattgatggcatcgtgggctttgccagcacagagaaggtggagaagaggacagaccccatcctgagcctgagcaaccagcaggatgccacctctgtggccacagagagcagcgagagcagcaccagtgacctgcccagctttgaggtgggcatccgggccctgtgtgaggtgaacaatgctgagggcagctgcatcgaggagagaaatgtggacctgaagaacaacagcctggagattgaccagacagaaaatgtgaagcccatgctgcggggccgcttccagaggcccaagcccaacctgagccgggccggcaagaagtctgtgctgagccagggcaagacagaaagtgagagcaagaacagccacagcaagacctctgtggagaagaaccacgtggagaaggacaagatgaacaccctggacatcctgaggatggagaccacagagcgggagaaccctgaggccgagaccgtgtctgtgctgggggagaagaactgcctgcaggagggcagccagctgaaggccctgcggcctgtgcaggtgcggggccgcctgcagaagcccaagcccaatgccggcaaggctgctgagaggaaggagatcctgatcagccaggaggagattggagccaacgtggagaagaatgaaaatgaaagctgtgccgaccgggacaccccccagcacatggaggaccagagcaggaaggactttgaggaggaggatgtgatcctgcagcctgagaagaatgacagcttccagaatgtgcagccagatgagcccaaggtgctgaatgaatgtctgtctgtgcaggagaacaacaaggccaacaagctgaaccaggtgcccatcctgcggacccgcttccagaagcccaagcccaacatcggccggggcaccggccggcgggagatcagcagcaaggaggaggtgctggagaagatcctgagcctgggcaagtggaggcagcactag

SEQ ID NO: 144756 - DNA, 6399 bp, Artificial Sequence
  Description of Artificial Sequence: Synthetic coding sequence
atgagcagccgcatcagtgacacagagaggagccagaaggatgcccagacagtggaggaggagagcctgaccctgagccgggaggatgctgagcaggtggccctggaggtggacctgaaccagaagaagagaagaaggaagaagcaggatggagccaatgagctgggcgtgaacaacctgctggagaatgccaccgtgcaggccggccccagcaagggggagaagcacaagaacaagtgccaggccatccggcctgagctgaaggagggagaatgttccaaggagcagatgctgagctgcacccagaacattgatggcatcgtgggctttgccagcacagagaaggtggagaagaggacagaccccatcctgagcctgagcaaccagcaggatgccacctctgtggccacagagagcagcgagagcagcaccagtgacctgcccagctttgaggtgggcatccgggccctgtgtgaggtgaacaatgctgagggcagctgcatcgaggagagaaatgtggacctgaagaacaacagcctggagattgaccagacagaaaatgtgaagcccatgctgcggggccgcttccagaggcccaagcccaacctgagccgggccggcaagaagtctgtgctgagccagggcaagacagaaagtgagagcaagaacagccacagcaagacctctgtggagaagaaccacgtggagaaggacaagatgaacaccctggacatcctgaggatggagaccacagagcgggagaaccctgaggccgagaccgtgtctgtgctgggggagaagaactgcctgcaggagggcagccagctgaaggccctgcggcctgtgcaggtgcggggccgcctgcagaagcccaagcccaatgccggcaaggctgctgagaggaaggagatcctgatcagccaggaggagattggagccaacgtggagaagaatgaaaatgaaagctgtgccgaccgggacaccccccagcacatggaggaccagagcaggaaggactttgaggaggaggatgtgatcctgcagcctgagaagaatgacagcttccagaatgtgcagccagatgagcccaaggtgctgaatgaatgtctgtctgtgcaggagaacaacaaggccaacaagctgaaccaggtgcccatcctgcggacccgcttccagaagcccaagcccaacatcggccggggcaccggccggcgggagatcagcagcaaggaggaggtgctggagaagatcctggtgtctggagagatggctgctgccctgcgggagaccgtgcggctggacaccagccccaaggagatggtgcctgctgagatcaacaccaaggagatgcagagcgacctgaaggagactggaagaagagccatcagcccccgggagaagatcctggatgtgattgatgacaccatcgagatggagaccggcctgaaggccatgggccgggagatctgcctgcgggagaagaccccagaggtgattgatgccacagaggagattgacaaggacctggaggaggccggccggcgggagatcagcccccagaagaatggacctgaggaggtgaagcccctgggggaggtggagacagacctgaaggccactggaaatgaaagcagcccccgggagaagaccccagaggtgacagatgccacagaggagattgacaagaacctggaggagactggaagaaggaagatcagcccccgggagaatggacctgaggaggtgaagcctgtggatgagatggagacagacctgaatgccaccggccgggagagcagcccccgggagaagaccccagaggtgattgatgccacagaggagattgacctggaggagacagagcgggaggtgagcccccaggagaatggcctggaggaggtgaagcccctgggggagatggagacagacctgaaggccaccggccgggacagcttcccccggggcaagaccccagaggtgattgatgccatcgaggagattgaaattgacctggaggagacagagcgggagatcagcccccaggagaatggcctggaggaggtgaagcccctgggggagatgcagacagacctgaaggccaccggccgggagatcagcccccgggagaagaccccagaggtgattgatgccacagaggagattgacaaggacctggaggagaccggccggcgggagatcagcccagaagaaaatggacctgaggaggtgaagcctgtggatgagatggagacagacctgaagaccaccggccgggagggcagcagccgggagaagacccgggaggtgattgatgctgctgaggtgattgaaacagacctggaggagacagagcgggagatcagcccccaggagaatggacctgaggaggtgaagcctgtgggcaagatggagacagacctgaaggagatccgggaggagatcagccagcgggagaaggtgctggccgagttcagcgccatccgggagaaggagattgacctgaaggagaccgggaagagggacatccccatcatggagaaggtgtctgggaagatggctgtggtggaggagatggaggccgacctgaaggagaccgggaaggagaacttccgggagcggggcagcgaggagatctgtgtgacagaggagaaggtggccgagctgaagcagacaggcaagacagacatcagcccccgggagaatgagctggaggagaccagcaccagccggcagacagacacccacctgatgcagagcggcagcaatgacttctctgctgtgcccagcctggacatccagaacatcagcagcgaggtgctgtccatgatgcacacccctgtggaggagaagagaaattctgagaaggaggtgagcagccacttcagccacttcaagatcagcagccagacccatgaaagtgacaagacagaggtgcagggcatccagagcccagatgtgcctgagcagttcagtgacatcaacctgagcaagagcctgccccaggagcagaagcccctggagatcaagccagccccctttgtgcgcagccgcttcaagaggcccaagcccaacctggcccgggccgccctgaagcgggagaccacagaaagtgagaagtacatctatgagaagaagtctgagaccaagaagatggagaccatcgtgatgcaggagaacaatgagcagacagacaccctgcccagccagcatgatgaggccagcctgatgatcagccgggagaaggacaccctgggccacagaaatgaggaggccgtcatcctgccctgcacccagacagaaagaaacctgagccccagcaacagctgtgagcccaaggaggagagccagagcgcccctgtgcagaagaatgattctgtggtgtctgtgggcaccaacaacgtgaacaccttccagcaggagatgaaggagagcgtcatccagacagcccggcaggtgcggggccgcctgcagaggccccggcccaacatcaggaagacaggccagaggcagatcgtggacaagggggaggccaagggcatcatcaaggagggccgcaccatcctgcccaaggatgaaacagagaagaaggtgctgactgtgagcaacagccagattgaaacagaaattgaggtgcccagcagcgctgtgcctgagcacaggatgtatgagaaccagagccaggtggtgctggtggagaacctgcacgtgaacaagaccaatgagaccatcagacatgagaacaagccctacgtgcccagcagcgcccagatgaccaggaggaagttccagaaggccaagcccaacctgggccgggcccacagcaagaaggaggagcctgtgctggagaaggtgaccacagaccagagcaaggagggcaagccagaggaccacctgctgcagaagggggccagcaacacccagctgctgctgaaggagaaggccgagctgctgaccagcctggaggtgtctgccaggaaggactgtgtgggcagcaaggagagcgccctggccaagattgatgctgagctggaggaggtgggccccagccggcgggtgggggaggagaccgtgggggacaacagccccagctctgtggtggaggagcagtacctgaacaagctgaccagctgcccccagcccctgaatgagaccagctacagcaagatcgccctggatggcaagaccaccatcagcagcaccagtgaatatgaaagaaacagaggagagcggcgcagccacaagaagttcaagcccaacgtgacccggggccggggcagcaagagggtgcggggcaagaccagcaagaaggagccccgggccagcaaggccatgctggtgaccctgcgggccagccaggaggaggatgatgatgctgatgactttgaaagtgactatgaggaggagagctaccacctggcccctgaggaggtgaacaaggcccctgtgtttgtgcctgtgggcctgcggagccctgagcctgtgtctgcccagatcgaggagaccatggaggagctggagatcaccgtgaatgtgcctgatgtgggctgcatcgctgtggtggagcacgagctgcccaacacagatgtgaccacagaggagatgaagcaggaggagaacctgtctgtgccctttgagatgaccaccagcgagcacatccaggatgagcccggggtgtgcatcatcccccacgtgcacagcaaggacaagagccacatccccagcagcctggacaacgtgaaccacaagatcgtgcatgagtgccaggagctgagcagccctgtgatcaccaccagccctgccagctttgaggagaacaagatcgtgctggaggagcagagcagccgggaggagatcagcctgatggagaaggtgaaggaaaatgccacccccaccaggaacaccatcagcaaggtgaccagcaacctgcgcatccgcagccggctggccaagcccaagcccaacctggagaagaccctgggcaccaaccggctggatgactaccaggaggtgagcagcctgtgtgtgaccaagggagctgagatggagacccagcgggagacagagaagaatgccagcaaggccacagagctggagaacaagaacctgggccctgtgaccacagctgagaacaaggaccagagcaagctggcctgtgtgcacggcatcaagggcaccagcatcagcagcgaggtgaacctgacagaaagaaatgaaaaccaggaggagagcagccaggaggtgcacatgctgtctgtggcccctgtggccagcagcgagaccggcccctgcaccctgggcctggaccggggcctgggagaaaattctgtggaggagccccagatcaaggacagcaaaggagacagcgtgctgaccctgcctgtgcctgagtacacccccaccagcatccctgaggtgcagcaggagaacatcatcaacccccaggacctgactgtgaacctggtggccaacgtgccccaggatggagaagatgagcaggccttcatcctgaccctggtggagatcccagccaatgctgtggaggagttcacagatgccacagcccagttcatgcccaaccccctgctgcctgcccccatcctggtgaagtctgtgaacacagaggagcggggggacatgagcatctgcctgcctgccacctctgtgggccaggatgccatgggcctgagcatcagcggccgggacaacagcaagaagcccccagacaacctggacctggtgtccaggaagcgcttccagtgccgcctggacaagaatgaccacatccccccagccaagaagaggagcctgaccctgagagatgactgccaggagtacaccacagaggtgcacagcaaggagctgaccaacgtgtttgaggagactggagagagccacaagggccaggacatcttcctgaccagcggcagcaccctgaccaccccagagccccagaggcagcaggtggaggccgccttccagagccggggcagccgcagcccagatgcctgcatggacaagaatgtgccccagctgccccaggatgagatgattgtgtctgacaaggaggagaggacagatgctgcccccaagagccagcagatggacagcaggaccagcagcagcaaggccagcctgagccggcccggccggcggcccctgggcttcctgagcctcatctgcagcaagaacagcctggagagtgatgagcccatgcaggtgcacagcaagaagaggctgaagcccctcatccctggcctgaggaagaagctgaagaggagcaaccccttcaatgaaagccaggagaagaaccgggagagcagtgacctgctgcccagccccagcgtcatcaccacccagagcgagaacatcagcagcagcgccacccagagccccttctag

SEQ ID NO: 144757 - DNA, 1392 bp, Artificial Sequence; identical to SEQ ID NO: 144753
  Description of Artificial Sequence: Synthetic coding sequence

SEQ ID NO: 144758 - DNA, 1518 bp, Artificial Sequence
  Description of Artificial Sequence: Synthetic coding sequence
atgggcctggtgagcagcaagaagccagacaaggagaagcccatcaaggagaaggacaagggccagtggagccccctgaaggtgtctgcccaggacaaggatgccccacccctgccccccctggtggtgttcaaccacctgaccccacctcctccagatgagcacctggatgaggacaagcactttgtggtggccctgtatgactacacagccatgaatgaccgggacctgcagatgctgaagggggagaagctgcaggtgctgaagggcactggagactggtggctggcccggagcctggtgacaggccgggagggctacgtgcccagcaactttgtggcccgggtggagagcctggagatggagcgctggttcttccgcagccagggcaggaaggaggccgagcggcagctgctggcccccatcaacaaggccggcagcttcctgatccgggagagcgagaccaacaagggggccttcagcctgtctgtgaaggatgtgaccacccagggcgagctgatcaagcactacaagatccgctgcctggatgaaggaggctactacatcagcccccgcatcaccttccccagcctgcaggccctggtgcagcactacagcaagaagggagatggcctgtgccagaggctgaccctgccctgtgtgcggcctgccccccagaacccctgggcccaggatgagtgggagatcccccggcagagcctgcggctggtgaggaagctgggcagcggccagtttggagaggtgtggatgggctactacaagaacaacatgaaggtggccatcaagaccctgaaggagggcaccatgagccctgaggccttcctgggggaggccaacgtgatgaaggccctgcagcacgagcggctggtgcggctgtatgctgtggtgaccaaggagcccatctacatcgtgacagagtacatggcccggggctgcctgctggacttcctgaagacagatgagggcagccggctgagcctgccccggctgattgacatgtctgcccagattgctgagggcatggcctacattgaaagaatgaacagcatccaccgggacctgcgggccgccaacatcctggtgtctgaggccctgtgctgcaagattgctgactttggcctggcccgcatcattgattctgagtacacagcccaggagggcgccaagttccccatcaagtggacagcccctgaggccatccactttggagtcttcaccatcaaggcagatgtgtggagctttggagtgctgctgatggaggtggtgacctacggccgggtgccctacccaggcatgagcaaccctgaggtgatccggaacctggagcggggctacaggatgcccaggccagacacctgccccccagagctgtacagaggagtgattgctgagtgctggaggagcaggcctgaggagcggcccacctttgagttcctgcagagcgtgctggaggacttctacacagccacagagcggcagtatgagctgcagccctag

SEQ ID NO: 144759 - DNA, 1773 bp, Artificial Sequence
  Description of Artificial Sequence: Synthetic coding sequence
atgggcctggtgagcagcaagaagccagacaaggagaagcccatcaaggagaaggacaagggccagtggagccccctgaaggtgtctgcccaggacaaggatgccccacccctgccccccctggtggtgttcaaccacctgaccccacctcctccagatgagcacctggatgaggacaagcactttgtggtggccctgtatgactacacagccatgaatgaccgggacctgcagatgctgaagggggagaagctgcaggtgctgaagggcactggagactggtggctggcccggagcctggtgacaggccgggagggctacgtgcccagcaactttgtggcccgggtggagagcctggagatggagcgctggttcttccgcagccagggcaggaaggaggccgagcggcagctgctggcccccatcaacaaggccggcagcttcctgatccgggagagcgagaccaacaagggggccttcagcctgtctgtgaaggatgtgaccacccagggcgagctgatcaagcactacaagatccgctgcctggatgaaggaggctactacatcagcccccgcatcaccttccccagcctgcaggccctggtgcagcactacagcaagaagggagatggcctgtgccagaggctgaccctgccctgtgtgcggcctgccccccagaacccctgggcccaggatgagtgggagatcccccggcagagcctgcggctggtgaggaagctgggcagcggccagtttggagaggtgtggatgggctactacaagaacaacatgaaggtggccatcaagaccctgaaggagggcaccatgagccctgaggccttcctgggggaggccaacgtgatgaaggccctgcagcacgagcggctggtgcggctgtatgctgtggtgaccaaggagcccatctacatcgtgacagagtacatggcccggggctgcctgctggacttcctgaagacagatgagggcagccggctgagcctgccccggctgattgacatgtctgcccagattgctgagggcatggcctacattgaaagaatgaacagcatccaccgggacctgcgggccgccaacatcctggtgtctgaggccctgtgctgcaagattgctgactttggcctggcccgcatcattgattctgagtacacagcccaggagggcgccaagttccccatcaagtggacagcccctgaggccatccactttggagtcttcaccatcaaggcagatgtgtggagctttggagtgctgctgatggaggtggtgacctacggccgggtgccctacccaggcatgagcaaccctgaggtgatccggaacctggagcggggctacaggatgcccaggccagacacctgccccccagagctgtacagaggagtgattgctgagtgctggaggagcaggcctgaggagcggcccacctttgactgcaccccaggccgggtgacccggcccctgtgtgccgccagctttgtggagggctgcaacagcgacctggcccggagcagtggagtgctgagccccagcaaggtgttcagaacaggcaagaggctgagcagcagcaaggcccctgtgctgggcacccccagggctggccgggtgcctgccagcgccccctgtgtggaccctgccctgccccgctaccgcagccagacaggcagccggggccggcagcagggccagccccagccccggctgcggagcagcacagctggcctcttctgcaacaaggtgacctctgtgaggtag

SEQ ID NO: 144760 - DNA, 615 bp, Artificial Sequence
  Description of Artificial Sequence: Synthetic coding sequence
atggccacagccagccccagcgtcttcctgctgatggtgaatggccaggtggagagcgcccagtttcctgaatatgatgacctgtactgcaagtactgctttgtgtatggccaggactgggcccccacagctggcctggaggagggcatcagccagatcaccagcaagagccaggatgtgcggcaggccctggtgtggaacttccccattgatgtgaccttcaagagcaccaacccctacggctggccccagatcgtgctgtctgtgtatggcccagatgtgtttggaaatgatgtggtgcggggctatggagctgtgcacgtgcccttcagccctggccgccacaagaggaccatccccatgtttgtgcctgagagcaccagcaagctgcagaagttcacctcctggttcatgggccggcggcctgagtacacagaccccaaggtggtggcccagggcgagggccgggaggtgaccagggtgcgcagccagggctttgtgaccctgctcttcaacgtggtgaccaaggacatgaggaagctgggctatgacaccggccccagcgacacccagggcgtgctgggccccagccccccccagagcttcccccagtag

SEQ ID NO: 144761 - DNA, 462 bp, Artificial Sequence
  Description of Artificial Sequence: Synthetic coding sequence
atggccacagccagccccagcgtcttcctgctgatggtgaatggccaggtggagagcgcccagtttcctgaatatgatgacctgtactgcaagtactgctttgtgtatggccaggactgggcccccacagctggcctggaggagggcatcagccagatcaccagcaagagccaggatgtgcggcaggccctggtgtggaacttccccattgatgtgaccttcaagagcaccaacccctacggctggccccagatcgtgctgtctgtgtatggcccagatgtgtttggaaatgatgtggtgcggggctatggagctgtgcacgtgcccttcagccctggccgccacaagaggaccatccccatgtttgtgcctgagagcaccagcaagctgcagaagttcaccagcctgtgcctggtggccagcagtgacctgcaggccgccccacccacagaggacaagtag

SEQ ID NO: 144762 - DNA, 486 bp, Artificial Sequence
  Description of Artificial Sequence: Synthetic coding sequence
atggccacagccagccccagcgtcttcctgctgatggtgaatggccaggtggagagcgcccagtttcctgaatatgatgacctgtactgcaagtactgctttgtgtatggccaggactgggcccccacagctggcctggaggagggcatcagccagatcaccagcaagagccaggatgtgcggcaggccctggtgtggaacttccccattgatgtgaccttcaagagcaccaacccctacggctggccccagatcgtgctgtctgtgtatggcccagatgtgtttggaaatgatgtggtgcggggctatggagctgtgcacgtgcccttcagccctggccgccacaagaggaccatccccatgtttgtgcctgagagcaccagcaagctgcagaagttcacctcctggttcatgggccggcggcctgagtacacagaccccaaggtggtggcccagggcgagggccgggaggcccagcccggctag

SEQ ID NO: 144763 - DNA, 564 bp, Artificial Sequence
  Description of Artificial Sequence: Synthetic coding sequence
atggccacagccagccccagcgtcttcctgctgatggtgaatggccaggtggagagcgcccagtttcctgaatatgatgacctgtactgcaagtactgctttgtgtatggccaggactgggcccccacagctggcctggaggagggcatcagccagatcaccagcaagagccaggatgtgcggcaggccctggtgtggaacttccccattgatgtgaccttcaagagcaccaacccctacggctggccccagatcgtgctgtctgtgtatggcccagatgtgtttggaaatgatgtggtgcggggctatggagctgtgcacgtgcccttcagccctggccgccacaagaggaccatccccatgtttgtgcctgagagcaccagcaagctgcagaagttcacctcctggttcatgggccggcggcctgagtacacagaccccaaggtggtggcccagggcgagggcagagaagatgaaaatgctgaggccgagatccccaggagcacctgggtgtccctgtgccccagccctgcctggctgatgctgcccttctgcccccagtag

SEQ ID NO: 144764 - DNA, 402 bp, Artificial Sequence
  Description of Artificial Sequence: Synthetic coding sequence
ctgctgatggtgaatggccaggtggagagcgcccagtttcctgaatatgatgacctgtactgcaagtactgctttgtgtatggccaggactgggcccccacagctggcctggaggagggcatcagccagatcaccagcaagagccaggatgtgcggcaggccctggtgtggaacttccccattgatgtgaccttcaagagcaccaacccctacggctggccccagatcgtgctgtctgtgtatggcccagatgtgtttggaaatgatgtggtgcggggctacggggctgtgcacgtgcccttcagccctggccgccacaagaggaccatccccatgtttgtgcctgagagcaccagcaagctgcagaagttcaccaggtctgccagctgcagcacccactag

SEQ ID NO: 144765 - DNA, 615 bp, Artificial Sequence; identical to SEQ ID NO: 144760
  Description of Artificial Sequence: Synthetic coding sequence

SEQ ID NO: 144766 - DNA, 444 bp, Artificial Sequence
  Description of Artificial Sequence: Synthetic coding sequence
atgatgaccagcacagccagcacagccctgtgcacagccaggactggaccaccccagagggtgtggaggcggggcagccacaggagccacccccgggccaagatgtgtgggaagcactggtgtggcaccagccccctgatgagccccctgaaggcccccacccccacagctggccacaggagctgcagcgcctgcatggaccagatgtgcagcggcaccatgtggtttgaggccatgggcccctgcacctgccccagccacctggccggcaccaagggccccagcccctgcctgagccagaacctgcggctgaactgccgcagcctgcaggccggctcctggggcggcggccccagcacccagaccccccgctggtggctgcgggtgaaggccggcaagccacccagcggcctgtctgtgaaggacagctctgtgtccaggtag

SEQ ID NO: 144767 - DNA, 528 bp, Artificial Sequence
  Description of Artificial Sequence: Synthetic coding sequence
atggccgaggtgcacgtgattggccagatcattggagccagcggcttcagcgagagcagcctcttctgcaagtggggcatccacactggagctgcctggaagctgctgtctggagtgcgggagggccagacccaggtggacaccccccagattggagacatggcctactggagccaccccatcgacctgcactttgccaccaagggcctgcagggctggccccggctgcacttccaggtgtggagccaggacagctttggccgctgccagctggccggctacggcttctgccacgtgcccagcagccctggcacccaccagctggcctgccccacctggaggcccctgggctcctggagggagcagctggcccgggcctttgtgggcggcggcccccagctgctgcacggggacaccatctacagcggggctgaccgctaccgcctgcacacagctgctgggggcaccgtgcacctggagatcggcctgctgctgaggaactttgacagatatggagtggagtgctag

SEQ ID NO: 144768 - DNA, 1452 bp, Artificial Sequence
  Description of Artificial Sequence: Synthetic coding sequence
atgacagaggtggagtacacccagctgcagcacatcctgtgcagccacatggaggccgctgctgatggagagctggagacccggctgaacagcgccctgctggccgctgctggccctggagctggagctgggggctttgctgctgggggccagggcggggccgcccctgtgtaccctgtgctgtgccccagcgccctggccgcagatgccccctgcctgggccacatcgacttccaggagctgaggatgatgctgctgtctgaggccggggctgctgagaagaccagcggcggcggagatggagcccgggcccgggcagatggagctgccaaggagggcgctggagctgctgctgctgctgctggcccagatggagcccctgaggcccgggccaagccagctgtgcgggtgcggctggaggaccgcttcaacagcatcccagctgagcccccaccagccccccggggccctgagcccccagagcccggcggggccctgaacaacctggtgaccctcatccgccaccccagcgagctgatgaatgtgcccctgcagcagcagaacaagtgcacagccctggtgaagaacaagacagctgccaccaccacagccctgcagttcacctaccccctcttcaccaccaatgcctgcagcaccagcggcaacagcaacctgagccagacccagagcagcagcaacagctgcagcgtgctggaggccgccaagcaccaggacatcggcctgccccgggccttctccttctgctaccagcaggagattgagagcaccaagcagaccctgggcagcaggaacaaggtgctgcctgagcaggtgtggatcaaggtgggggaggccgccctgtgcaagcaggccctgaagaggaacagaagcaggatgaggcagctggacaccaacgtggagcggcgggccctgggggagatccagaatgtgggggagggcgccacagccacccagggcgcctggcagagcagcgagagcagccaggccaacctgggggagcaggcccagagcggcccccagggcggccgcagccagaggcgggagcggcacaacaggatggagcgggacagaagaagacgcatccgcatctgctgtgatgagctgaacctgctggtgcccttctgcaatgctgagacagacaaggccaccaccctgcagtggaccacagccttcctgaagtacatccaggagcggcacggggacagcctgaagaaggtgctgagcaccaacagccgctacgtgatgctgtggacctgcttcctgaagatgaagtctgctgtggatggcaagaacccccagcacgcctacagaacagccaaccacaagtggctgtgcctgcacgaggcccggagctttgcctttgaggtgtccatctgggcccacttccagctgttccgggtgcgcatccctgagggcttcctgagcatctag

SEQ ID NO: 144769 - DNA, 843 bp, Artificial Sequence
  Description of Artificial Sequence: Synthetic coding sequence
atgggccccaaggacagcgccaagtgcctgcaccggggcccccagcccagccactgggccgctggagatggccccacccaggagcgctgtggccccaggagcctgggcagccctgtgctgggcctggacacctgccgggcctgggaccacgtggatggccagatcctgggccagctgcggcccctgacagaggaggaggaggaggagggcgctggggccaccctgagccggggccctgccttccctggcatgggcagcgaggagctgcggctggccagcttctatgactggcccctgacagctgaggtgcccccagagctgctggccgctgctggcttcttccacacaggccaccaggacaaggtgcgctgcttcttctgctacggcggcctgcagagctggaagagaggagatgacccctggacagagcacgccaagtggttccccagctgccagttcctgctgcggagcaagggccgggactttgtgcacagcgtgcaggagacccacagccagctgctgggctcctgggacccctgggaggagccagaagatgctgcccctgtggcccccagcgtgcctgccagcggctacccagagctgcccaccccaagaagagaggtgcagagcgagagcgcccaggagcccggggccagagatgtggaggcccagctgcggcggctgcaggaggagaggacctgcaaggtgtgcctggacagagctgtgtccatcgtgtttgtgccctgtggccacctggtgtgtgccgagtgtgcccctggcctgcagctgtgccccatctgccgggcccctgtgcgcagccgggtgaggaccttcctgtcctag

SEQ ID NO: 144770 - DNA, 3564 bp, Artificial Sequence
  Description of Artificial Sequence: Synthetic coding sequence
atgaggcccaggggggccgcctttgctgctggccccccaggggacctgcacctgggcacagccatcggctttgctggggccatctggaggagccgcagccctgccatgagcaccctgctggacatcaagagctctgtgctgcggcaggtgcaggtgtgccccagcttcagaagaagaacagagcaggaccccggcagcgccagcgctgacccccaggagcccgccaccggggcctggaagccaggagatggagtggagttctttgcccacatgaggctgatgctgaagaagggggagggccggcagggcctgccctgcctggaggtgcccctgcggagcggcagccctgcccctcctgagcctgtggaccccagcctgggcctgcgggccctggcccctgaggaggtggagatgctgtatgaggaggccctgtacacagtgctgtacagagctggcaccatgggccctgaccaggtggatgatgaggaggccctgctgagctacctgcagcaggtgtttggcaccagcctggaggagcacacagaggccatcgagcgggtgaggaaggccaaggcccccacctacgccctgaaggtgtctgtgatgagggccaagaacctgctggccaaggaccccaacggcttcagtgacccctactgcatgctgggcatcctgcctgccagtgatgccacccgggagccccgggcccagaaggagcagcgcttcggcttcaggaagggcagcaagagaggaggccccctgcctgccaagtgcatccaggtgacagaggtgaagagcagcaccctgaaccctgtgtggaaggagcacttcctgtttgaaattgaagatgtgtccacagaccagctgcacctggacatctgggaccatgatgatgatgtgtccctggtggaggcctgcaggaagctgaatgaggtgattggcctgaagggcatgggccgctacttcaagcagatcgtgaagagcgcccgggccaacggcacagctggccccacagaggaccacacagatgacttcctgggctgcctgaacatccctgtgcgggaggtgcctgtggccggcgtggaccgctggttcaagctggagcccaggagcagcgccagccgggtgcagggccactgccacctggtgctgaagctgatcaccacccagagggacacagccatgagccagaggggccgcagcggcttcctgagccacctgctgctgctgagccacctgctgcggctggagcacagcgctgaggagcccaacagcagctcctggagaggagagctgagcaccccagctgccaccatcctgtgcctgcatggagcccagagcaacctgagccccctgcagctggccgtgctgcactggcaggtgagcagccgccaccaccagacctgcaccctggactacagctacctgctgggcctgctggaggacatgcaggcccactgggaggaggcccccagcctgccccaggagcaggaggagagcctggccgacagcctgagcgccttcagcgagtttggcctgcagctgctgcggcagctgcgggactacttccctgccaccaacagcacagctgtgcaccggctggagctgctgctgaagtgcctgggcaagctgcagctgttccagcccagctttgagatctgcccctttgagagcgagctgaacatggacattgctgctgccctgaagaggggcaaccgggagtggtatgaccgcatcctgaatgacaagagcccccgggagcagcccggcccccagaggctgcccggcctggtggtgctggctgatgctgtgtatgatgacctgcagttctgctacagcgtgtatgccagcctcttccacagcatcctgaatgtggatgtgttcaccctgaccttccggcagctggagcggctggtggccgaggaggcctgggtgctgacagaggagctgagccccaagatgaccctggaggtggccagcggcctgtttgagctgtacctgaccctggccgacctgcagcgcttctgggacagcatccctggccgggacagccgcagcctggccctggccggcatccacgcccccttcctgcctgctgtgaagctgtggttccaggtgctgcgggaccaggccaagtggaggctgcagggcgctgtggacatggacaccctggagcctgtggatgccagcagccgccacagcagcagcgctgccacagctggcctgtgcctgagccacatccaggagctgtgggtgcggctggcctggccagaccctgcccaggcccagggcctgggcacccagctgggccaggatgtgtgtgaggccaccctcttctacacagagctgctgaggaagaaggtggacacccagcccggggctgctggggaggccgtgtctgaggccctgtgtgtggtgctgaacaacgtggagctggtgaggaaggctgctggccaggccctgaagggcctggcctggccagagggcgccactggacctgagggcgtgctgccccggcccctgctgagctgcacccaggccctggatgatgacctgcagcgggaggcccacacagtgacagcccacctgaccagcaagatggtgggggacatcagaaaatatgtgcagcacatcagcctgagcccagacagcatccagaatgatgaggccgtggcccccctgatgaagtacctggatgagaagctggccctgctgaatgccagcctggtgaagggcaacctgagccgggtgctggaggccctgtgggagctgctgctgcaggccatcctgcaggccctgggcgccaacagagatgtgtctgctgacttctacagccgcttccacttcaccctggaggccctggtgtccttcttccacgccgagggccagggcctgcccctggagagcctgagagatggcagctacaagaggctgaaggaggagctgcggctgcacaagtgcagcaccagagaatgtattgagcagttctacctggacaagctgaagcagaggaccctggagcagaacagatttggccgcctgtctgtgcgctgccactatgaggccgctgagcagaggctggccgtggaggtgctgcacgccgctgacctgctgcccctggatgccaacggcctgagtgacccctttgtgattgtggagctgggccccccccacctgttccccctggtgcgcagccagaggacccaggtgaagaccaggaccctgcaccctgtgtatgatgagctgttctacttctctgtgcctgctgaggcctgcagaagaagagctgcctgtgtgctcttcaccgtgatggaccatgactggctgagcaccaatgactttgctggggaggccgccctgggcctgggcggcgtgactggagtggcccggccccaggtgggcggcggggcccgggccggccagcctgtgaccctgcacctgtgccggccccgggcccaggtgcgcagcgccctgcggcggctggagggccgcaccagcaaggaggcccaggagtttgtgaagaagctgaaggagctggagaagtgcatggaggccgacccctag

SEQ ID NO: 144771 - DNA, 3510 bp, Artificial Sequence
  Description of Artificial Sequence: Synthetic coding sequence
atgagcaccctgctggacatcaagagctctgtgctgcggcaggtgcaggtgtgccccagcttcagaagaagaacagagcaggaccccggcagcgccagcgctgacccccaggagcccgccactggagcctggaagccaggagatggagtggagttctttgcccacatgaggctgatgctgaagaagggggagggccggcagggcctgccctgcctggaggcctggggcagcccctgccggcagagcccccaccctggcccccacacccaggtgcccctgcggagcggcagccctgcccctcctgagcctgtggaccccagcctgggcctgcgggccctggcccctgaggaggtggagatgctgtatgaggaggccctgtacacagtgctgtacagagctggcaccatgggccctgaccaggtggatgatgaggaggccctgctgagctacctgcagcaggtgtttggcaccagcctggaggagcacacagaggccatcgagcgggtgaggaaggccaaggcccccacctacgccctgaaggtgtctgtgatgagggccaagaacctgctggccaaggaccccaacggcttcagtgacccctactgcatgctgggcatcctgcctgccagtgatgccacccgggagccccgggcccagaaggagcagcgcttcggcttcaggaagggcagcaagagaggaggccccctgcctgccaagtgcatccaggtgacagaggtgaagagcagcaccctgaaccctgtgtggaaggagcacttcctgtttgaaattgaagatgtgtccacagaccagctgcacctggacatctgggaccatgatgatgatgtgtccctggtggaggcctgcaggaagctgaatgaggtgattggcctgaagggcatgggccgctacttcaagcagatcgtgaagagcgcccgggccaacggcacagctggccccacagaggaccacacagatgacttcctgggctgcctgaacatccctgtgcgggaggtgcctgtggccggcgtggaccgctggttcaagctggagcccaggagcagcgccagccgggtgcagggccactgccacctggtgctgaagctgatcaccacccagagggacacagccatgagccagaggggccgcagcggcttcctgagccacctgctgctgctgagccacctgctgcggctggagcacagcgctgaggagcccaacagcagctcctggagaggagagctgagcaccccagctgccaccatcctgtgcctgcatggagcccagagcaacctgagccccctgcagctggccgtgctgcactggcaggtgagcagccgccaccaccagacctgcaccctggactacagctacctgctgggcctgctggaggacatgcaggcccactgggaggaggcccccagcctgccccaggagcaggaggagagcctggccgacagcctgagcgccttcagcgagtttggcctgcagctgctgcggcagctgcgggactacttccctgccaccaacagcacagctgtgcaccggctggagctgctgctgaagtgcctgggcaagctgcagctgttccagcccagctttgagatctgcccctttgagagcgagctgaacatggacattgctgctgccctgaagaggggcaaccgggagtggtatgaccgcatcctgaatgacaagagcccccgggagcagcccggcccccagaggctgcccggcctggtggtgctggctgatgctgtgtatgatgacctgcagttctgctacagcgtgtatgccagcctcttccacagcatcctgaatgtggatgtgttcaccctgaccttccggcagctggagcggctggtggccgaggaggcctgggtgctgacagaggagctgagccccaagatgaccctggaggtggccagcggcctgtttgagctgtacctgaccctggccgacctgcagcgcttctgggacagcatccctggccgggacagccgcagcctggccctggccggcatccacgcccccttcctgcctgctgtgaagctgtggttccaggtgctgcgggaccaggccaagtggaggctgcagggcgctgtggacatggacaccctggagcctgtggatgccagcagccgccacagcagcagcgctgccacagctggcctgtgcctgagccacatccaggagctgtgggtgcggctggcctggccagaccctgcccaggcccagggcctgggcacccagctgggccaggatgtgtgtgaggccaccctcttctacacagagctgctgaggaagaaggtggacacccagcccggggctgctggggaggccgtgtctgaggccctgtgtgtggtgctgaacaacgtggagctggtgaggaaggctgctggccaggccctgaagggcctggcctggccagagggcgccactggacctgagggcgtgctgccccggcccctgctgagctgcacccaggccctggatgatgacctgcagcgggaggcccacacagtgacagcccacctgaccagcaagatggtgggggacatcagaaaatatgtgcagcacatcagcctgagcccagacagcatccagaatgatgaggccgtggcccccctgatgaagtacctggatgagaagctggccctgctgaatgccagcctggtgaagggcaacctgagccgggtgctggaggccctgtgggagctgctgctgcaggccatcctgcaggccctgggcgccaacagagatgtgtctgctgacttctacagccgcttccacttcaccctggaggccctggtgtccttcttccacgccgagggccagggcctgcccctggagagcctgagagatggcagctacaagaggctgaaggaggagctgcggctgcacaagtgcagcaccagagaatgtattgagcagttctacctggacaagctgaagcagaggaccctggagcagaacagatttggccgcctgtctgtgcgctgccactatgaggccgctgagcagaggctggccgtggaggtgctgcacgccgctgacctgctgcccctggatgccaacggcctgagtgacccctttgtgattgtggagctgggccccccccacctgttccccctggtgcgcagccagaggacccaggtgaagaccaggaccctgcaccctgtgtatgatgagctgttctacttctctgtgcctgctgaggcctgcagaagaagagctgcctgtgtgctcttcaccgtgatggaccatgactggctgagcaccaatgactttgctggggaggccgccctgggcctgggcggcgtgactggagtggcccggccccaggtgggcggcggggcccgggccggccagcctgtgaccctgcacctgtgccggccccgggcccaggtgcgcagcgccctgcggcggctggagggccgcaccagcaaggaggcccaggagtttgtgaagaagctgaaggagctggagaagtgcatggaggccgacccctag

SEQ ID NO: 144772 - DNA, 3510 bp, Artificial Sequence; identical to SEQ ID NO: 144771
  Description of Artificial Sequence: Synthetic coding sequence

SEQ ID NO: 144773 - DNA, 3351 bp, Artificial Sequence
  Description of Artificial Sequence: Synthetic coding sequence
atgagcaccctgctggacatcaagagctctgtgctgcggcaggtgcaggtgtgccccagcttcagaagaagaacagagcaggaccccggcagcgccagcgctgacccccaggagcccgccactggagcctggaagccaggagatggagtggagttctttgcccacatgaggctgatgctgaagaagggggagggccggcagggcctgccctgcctggaggtgcccctgcggagcggcagccctgcccctcctgagcctgtggaccccagcctgggcctgcgggccctggcccctgaggaggtggagatgctgtatgaggaggccctgtacacagtgctgtaccgggccggcaccatgggccctgaccaggtggatgatgaggaggccctgctgagctacctgcagcaggtgtttggcaccagcctggaggagcacacagaggccatcgagcgggtgaggaaggccaaggcccccacctacgccctgaaggtgtctgtgatgagggccaagaacctgctggccaaggaccccaacggcttcagtgacccctactgcatgctgggcatcctgcctgccagtgatgccacccgggagccccgggcccagaaggagcagagatttggcttcaggaagggcagcaagaggggcggccccctgcctgccaagtgcatccaggtgacagaggtgaagagcagcaccctgaaccctgtgtggaaggagcacttcctgtttgaaattgaagatgtgtccacagaccagctgcacctggacatctgggaccatgatgatgatgtgtccctggtggaggcctgcaggaagctgaatgaagtcatcggcctgaagggcatgggccgctacttcaagcagatcgtgaagagcgcccgggccaatggaacagctggccccacagaggaccacacagatgacttcctgggctgcctgaacatccctgtgagaagagacacagccatgagccagaggggccgcagcggcttcctgagccacctgctgctgctgagccacctgctgcggctggagcacagcgctgaggagcccaacagcagctcctggagaggagagctgagcaccccagctgccaccatcctgtgcctgcacggggcccagagcaacctgagccccctgcagctggccgtgctgcactggcaggtgagcagccgccaccaccagacctgcaccctggactacagctacctgctgggcctgctggaggacatgcaggcccactgggaggaggcccccagcctgccccaggagcaggaggagagcctggccgacagcctgagcgccttcagcgagtttggcctgcagctgctgcggcagctgcgggactacttccctgccaccaacagcacagctgtgcaccggctggagctgctgctgaagtgcctgggcaagctgcagctgttccagcccagctttgagatctgcccctttgaaagtgagctgaacatggacattgctgctgccctgaagaggggcaaccgggagtggtatgaccgcatcctgaatgacaagagcccccgggagcagcccggcccccagaggctgcccggcctggtggtgctggctgatgctgtgtatgatgacctgcagttctgctacagcgtgtatgccagcctcttccacagcatcctgaatgtggatgtgttcaccctgaccttccggcagctggagcggctggtggccgaggaggcctgggtgctgacagaggagctgagccccaagatgaccctggaggtggccagcggcctgtttgagctgtacctgaccctggccgacctgcagcgcttctgggacagcatccctggccgggacagccgcagcctggccctggccggcatccacgcccccttcctgcctgctgtgaagctgtggttccaggtgctgcgggaccaggccaagtggaggctgcagggcgctgtggacatggacaccctggagcctgtggatgccagcagccgccacagcagcagcgctgccacagctggcctgtgcctgagccacatccaggagctgtgggtgcggctggcctggccagaccctgcccaggcccagggcctgggcacccagctgggccaggatgtgtgtgaggccaccctcttctacacagagctgctgaggaagaaggtggacacccagcctggagctgctggggaggccgtgtctgaggccctgtgtgtggtgctgaacaacgtggagctggtgaggaaggccgccggccaggccctgaagggcctggcctggccagagggcgccaccggccctgagggcgtgctgccccggcccctgctgagctgcacccaggccctggatgatgacctgcagcgggaggcccacacagtgacagcccacctgaccagcaagatggtgggggacatcagaaaatatgtgcagcacatcagcctgagcccagacagcatccagaatgatgaagctgtggcccccctgatgaagtacctggatgagaagctggccctgctgaatgccagcctggtgaagggcaacctgagccgggtgctggaggccctgtgggagctgctgctgcaggccatcctgcaggccctgggcgccaacagagatgtgtctgctgacttctacagccgcttccacttcaccctggaggccctggtgtccttcttccacgccgagggccagggcctgcccctggagagcctgagagatggcagctacaagaggctgaaggaggagctgcggctgcacaagtgcagcacccgggagtgcatcgagcagttctacctggacaagctgaagcagaggaccctggagcagaaccgcttcggccgcctgtctgtgcgctgccactatgaagctgctgagcagaggctggccgtggaggtgctgcatgctgctgacctgctgcccctggatgccaacggcctgagtgaccccttcgtcatcgtggagctgggccccccccacctgttccccctggtgcgcagccagaggacccaggtgaagaccaggaccctgcaccctgtgtatgatgagctgttctacttctctgtgcctgctgaggcctgcagaagaagagctgcctgtgtgctcttcaccgtgatggaccatgactggctgagcaccaatgactttgctggggaggccgccctgggcctgggcggcgtgactggagtggcccggccccaggtgggcggcggggcccgggccggccagcctgtgaccctgcacctgtgccggccccgggcccaggtgcgcagcgccctgcggcggctggagggccgcaccagcaaggaggcccaggagtttgtgaagaagctgaaggagctggagaagtgcatggaggccgacccctag

SEQ ID NO: 144774 - DNA, 3459 bp, Artificial Sequence
  Description of Artificial Sequence: Synthetic coding sequence
atgagcaccctgctggacatcaagagctctgtgctgcggcaggtgcaggtgtgccccagcttcagaagaagaacagagcaggaccccggcagcgccagcgctgacccccaggagcccgccactggagcctggaagccaggagatggagtggagttctttgcccacatgaggctgatgctgaagaagggggagggccggcagggcctgccctgcctggaggtgcccctgcggagcggcagccctgcccctcctgagcctgtggaccccagcctgggcctgcgggccctggcccctgaggaggtggagatgctgtatgaggaggccctgtacacagtgctgtaccgggccggcaccatgggccctgaccaggtggatgatgaggaggccctgctgagctacctgcagcaggtgtttggcaccagcctggaggagcacacagaggccatcgagcgggtgaggaaggccaaggcccccacctacgccctgaaggtgtctgtgatgagggccaagaacctgctggccaaggaccccaacggcttcagtgacccctactgcatgctgggcatcctgcctgccagtgatgccacccgggagccccgggcccagaaggagcagagatttggcttcaggaagggcagcaagaggggcggccccctgcctgccaagtgcatccaggtgacagaggtgaagagcagcaccctgaaccctgtgtggaaggagcacttcctgtttgaaattgaagatgtgtccacagaccagctgcacctggacatctgggaccatgatgatgatgtgtccctggtggaggcctgcaggaagctgaatgaagtcatcggcctgaagggcatgggccgctacttcaagcagatcgtgaagagcgcccgggccaatggaacagctggccccacagaggaccacacagatgacttcctgggctgcctgaacatccctgtgcgggaggtgcctgtggccggcgtggaccgctggttcaagctggagcccaggagcagcgccagccgggtgcagggccactgccacctggtgctgaagctgatcaccacccagagggacacagccatgagccagaggggccgcagcggcttcctgagccacctgctgctgctgagccacctgctgcggctggagcacagcgctgaggagcccaacagcagctcctggagaggagagctgagcaccccagctgccaccatcctgtgcctgcacggggcccagagcaacctgagccccctgcagctggccgtgctgcactggcaggtgagcagccgccaccaccagacctgcaccctggactacagctacctgctgggcctgctggaggacatgcaggcccactgggaggaggcccccagcctgccccaggagcaggaggagagcctggccgacagcctgagcgccttcagcgagtttggcctgcagctgctgcggcagctgcgggactacttccctgccaccaacagcacagctgtgcaccggctggagctgctgctgaagtgcctgggcaagctgcagctgttccagcccagctttgagatctgcccctttgaaagtgagctgaacatggacattgctgctgccctgaagaggggcaaccgggagtggtatgaccgcatcctgaatgacaagagcccccgggagcagcccggcccccagaggctgcccggcctggtggtgctggctgatgctgtgtatgatgacctgcagttctgctacagcgtgtatgccagcctcttccacagcatcctgaatgtggatgtgttcaccctgaccttccggcagctggagcggctggtggccgaggaggcctgggtgctgacagaggagctgagccccaagatgaccctggaggtggccagcggcctgtttgagctgtacctgaccctggccgacctgcagcgcttctgggacagcatccctggccgggacagccgcagcctggccctggccggcatccacgcccccttcctgcctgctgtgaagctgtggttccaggtgctgcgggaccaggccaagtggaggctgcagggcgctgtggacatggacaccctggagcctgtggatgccagcagccgccacagcagcagcgctgccacagctggcctgtgcctgagccacatccaggagctgtgggtgcggctggcctggccagaccctgcccaggcccagggcctgggcacccagctgggccaggatgtgtgtgaggccaccctcttctacacagagctgctgaggaagaaggtggacacccagcctggagctgctggggaggccgtgtctgaggccctgtgtgtggtgctgaacaacgtggagctggtgaggaaggccgccggccaggccctgaagggcctggcctggccagagggcgccaccggccctgagggcgtgctgccccggcccctgctgagctgcacccaggccctggatgatgacctgcagcgggaggcccacacagtgacagcccacctgaccagcaagatggtgggggacatcagaaaatatgtgcagcacatcagcctgagcccagacagcatccagaatgatgaagctgtggcccccctgatgaagtacctggatgagaagctggccctgctgaatgccagcctggtgaagggcaacctgagccgggtgctggaggccctgtgggagctgctgctgcaggccatcctgcaggccctgggcgccaacagagatgtgtctgctgacttctacagccgcttccacttcaccctggaggccctggtgtccttcttccacgccgagggccagggcctgcccctggagagcctgagagatggcagctacaagaggctgaaggaggagctgcggctgcacaagtgcagcacccgggagtgcatcgagcagttctacctggacaagctgaagcagaggaccctggagcagaaccgcttcggccgcctgtctgtgcgctgccactatgaagctgctgagcagaggctggccgtggaggtgctgcatgctgctgacctgctgcccctggatgccaacggcctgagtgaccccttcgtcatcgtggagctgggccccccccacctgttccccctggtgcgcagccagaggacccaggtgaagaccaggaccctgcaccctgtgtatgatgagctgttctacttctctgtgcctgctgaggcctgcagaagaagagctgcctgtgtgctcttcaccgtgatggaccatgactggctgagcaccaatgactttgctggggaggccgccctgggcctgggcggcgtgactggagtggcccggccccaggtgggcggcggggcccgggccggccagcctgtgaccctgcacctgtgccggccccgggcccaggtgcgcagcgccctgcggcggctggagggccgcaccagcaaggaggcccaggagtttgtgaagaagctgaaggagctggagaagtgcatggaggccgacccctag

SEQ ID NO: 144775 - DNA, 537 bp, Artificial Sequence
  Description of Artificial Sequence: Synthetic coding sequence
atgagccagaggggccgcagcggcttcctgagccacctgctgctgctgagccacctgctgcggctggagcacagcgctgaggagcccaacagcagctcctggagaggagagctgagcaccccagctgccaccatcctgtgcctgcatggagcccagagcaacctgagccccctgcagctggccgtgctgcactggcaggtgagcagccgccaccaccagacctgcaccctggactacagctacctgctgggcctgctggaggacatgcaggcccactgggaggaggcccccagcctgccccaggagcaggaggagagcctggccgacagcctgagcgccttcagcgagtttggcctgcagctgctgcggcagctgcgggactacttccctgccaccaacagcacagctgtgcaccggctggagctgctgctgaagtgcctgggcaagctgcagctgttccagcccagctttgagatctgcccccgggtgggcgctgagcacggccactgctgcggccctgaggagcggcagccctag

SEQ ID NO: 144776 - DNA, 1782 bp, Artificial Sequence
  Description of Artificial Sequence: Synthetic coding sequence
atggctgctgccagcagcagtgacagtgatgcctgtggggctgagagcaatgaggccaacagcaagtggctggatgcccactatgaccccatggccaacatccacaccttcagcgcctgcctggccctggccgacctgcatggagatggagagtacaagctggtggtgggggacctgggccctgggggccagcagccccggctgaaggtgctgaagggccccctggtgatgacagagagccccctgcctgccctgcctgctgctgctgccaccttcctgatggagcagcacgagcccaggaccccagccctggccctggccagcggcccctgtgtgtatgtgtacaagaacctgcggccctacttcaagttcagcctgccccagctgccccccaaccccctggagcaggacctgtggaaccaggccaaggaggacagaattgaccccctgaccctgaaggagatgctggagagcatccgggagacagctgaggagcccctgagcatccagagcctgcgcttcctgcagctggagctgtctgagatggaggcctttgtgaaccagcacaagagcaacagcatcaagaggcagaccgtcatcaccaccatgaccaccctgaagaagaacctggctgatgaagatgctgtgtcctgcctggtgctgggcacagagaacaaggagctgctggtgctggaccctgaggccttcaccatcctggccaagatgagcctgcccagcgtgcctgtgttcctggaggtgtctggccagtttgatgtggagttccggctggccgccgcctgcagaaatggaaacatctacatcctgcggcgggacagcaagcaccccaagtactgcatcgagctgagcgcccagcctgtgggcctcatccgggtgcacaaggtgctggtggtgggcagcacccaggacagcctgcacggcttcacccacaagggcaagaagctgtggacagtgcagatgcctgctgccatcctgaccatgaacctgctggagcagcacagccggggcctgcaggccgtgatggccggcctggccaacggggaggtgcgcatctacagagacaaggccctgctgaatgtcatccacaccccagatgctgtgaccagcctgtgcttcggccgctatggccgggaggacaacaccctcatcatgaccacccggggcggcggcctcatcatcaagatcctgaagaggacagctgtgtttgtggagggcggcagcgaggtgggccccccaccagcccaggccatgaagctgaatgtgcccaggaagacccggctgtatgtggaccagaccctgcgggagcgggaggccggcacagccatgcaccgggccttccagacagacctgtacctgctgcggctgcgggccgcccgggcctacctgcaggccctggagagcagcctgagccccctgagcaccacagcccgggagcccctgaagctgcatgctgtggtgcagggcctgggccccaccttcaagctgaccctgcacctgcagaacaccagcaccaccaggcctgtgctgggcctgctggtgtgcttcctgtacaatgaggccctgtacagcctgccccgggccttcttcaaggtgcccctgctggtgcccggcctgaactaccccctggagacctttgtggagagcctgagcaacaagggcatcagtgacatcatcaaggtgctggtgctgcgggagggccagagcgcccccctgctgagcgcccacgtgaacatgcctggcagcgagggcctggccgccgcctag

SEQ ID NO: 144777 - DNA, 498 bp, Artificial Sequence
  Description of Artificial Sequence: Synthetic coding sequence
atgagccctggcccccagctgtggcacctgctgcaggccctggtgtccatgtgcatccgcatcagtgaccccaccagcagcagcgcctgccccaactgcctgcagatcctgtggaacaagaccttcggcacccggcccaagcgggagacagctgaggagcccctgagcatccagagcctgcgcttcctgcagctggagctgtctgagatggaggcctttgtgaaccagcacaagagcaacagcatcaagaggcagaccgtcatcaccaccatgaccaccctgaagaagaacctggctgatgaagatgctgtgtcctgcctggtgctgggcacagagaacaaggagctgctggtgctggaccctgaggccttcaccatcctggccaagatgagcctgcccagcgtgcctgtgttcctggaggtgtctggccagtttgatgtggagttccggctggccgccgcctgcagaaatggaaacatctacatcctgcggaggtag

SEQ ID NO: 144778 - DNA, 2172 bp, Artificial Sequence
  Description of Artificial Sequence: Synthetic coding sequence
atgctgagctccatggctgctgctggctctgtgaaggccgccctgcaggtggccgaggtgctggaggccatcgtgtcctgctgcgtgggccctgagggccggcaggtgctgtgcaccaagcccaccggggaggtgctgctgagcagaaatggaggccgcctgctggaggccctgcacctggagcaccccatcgccaggatgattgtggactgtgtgagcagccacctgaagaagacaggagatggagccaagaccttcatcatcttcctgtgccacctgctgcggggcctgcacgccatcacagaccgggagaaggaccccctgatgtgtgagaacatccagacccacggccgccactggaagaactgcagccgctggaagttcatcagccaggccctgctgaccttccagacccagatcctggatggcatcatggaccagtacctgagccgccacttcctgagcatcttcagcagcgccaaggagaggaccctgtgccgcagcagcctggagctgctgctggaggcctacttctgtggccgggtgggcaggaacaaccacaagttcatcagccagctgatgtgtgactacttcttcaagtgcatgacctgcaagagcggcatcggcgtgtttgagctggtggatgaccactttgtggagctgaatgtgggcgtgacaggcctgcctgtgtctgacagccgcatcatcgccggcctggtgctgcagaaggacttctctgtgtacagaccagcagatggagacatgaggatggtgattgtgacagagaccatccagcccctcttcagcaccagcggcagcgagttcatcctgaacagcgaggcccagttccagaccagccagttctggatcatggagaagaccaaggccatcatgaagcacctgcacagccagaatgtgaagctgctgatcagctctgtgaagcagcctgacctggtgtcctactatgccggcgtgaatggcatctctgtggtggagtgcctgagcagcgaggaggtgtccctcatccgccgcatcatcggcctgagcccctttgtgcccccccaggccttcagccagtgtgagatccccaacacagccctggtgaagttctgcaagcccctcatcctgcggagcaagagatatgtgcacctgggcctcatcagcacctgtgccttcatcccccacagcatcgtgctgtgtggccctgtgcacggcctgattgagcagcatgaagatgccctgcatggagccctgaagatgctgcggcagctgttcaaggacctggacctgaactacatgacccagaccaatgaccagaatggcaccagcagcctcttcatctacaagaacagcggggagagctaccaggccccagaccctggaaatggcagcatccagaggccctaccaggacacagtggccgagaacaaggatgccctggagaagacccagacctacctgaaggtgcacagcaacctggtgatcccagatgtggagctggagacctacatcccctacagcacccccaccctgacccccacagacaccttccagacagtggagaccctgacctgcctgagcctggagaggaaccggctgacagactactatgagcccctgctgaagaacaacagcacagcctacagcacccggggcaacagaattgagatctcctatgagaacctgcaggtgaccaacatcaccaggaagggctccatgctgcctgtgtcctgcaagctgcccaacatgggcaccagccagagctacctgagcagctccatgcctgctggctgtgtgctgcctgtgggcggcaactttgagatcctgctgcactactacctgctgaactatgccaagaagtgccaccagagcgaggagaccatggtgtccatgatcatcgccaatgccctgctgggcatccccaaggtgctgtacaagagcaagacaggcaagtacagcttcccccacacctacatccgggctgtgcacgccctgcagaccaaccagcccctggtgagcagccagacaggcctggagagcgtgatgggcaagtaccagctgctgacctctgtgctgcagtgcctgaccaagatcctgaccatcgacatggtgatcaccgtgaagaggcacccccagaaggtgcacaaccaggacagtgaagatgagctgtag

SEQ ID NO: 144779 - DNA, 2133 bp, Artificial Sequence
  Description of Artificial Sequence: Synthetic coding sequence
atggtgatggcctgccgggtggtgaacaagagaagacacatgggcctgcagcagctgagcagctttgctgagactggaagaaccttcctgggccccctgaagagcagcaagttcatcattgatgaagaatgtcatgaatctgtgctgatcagcagcacagtgcggctgctggagagcctggacctgaccagcgctgtgggccagctgctgaatgaagctgtgcaggcccagaacaacacctacagaacaggcatcagcaccctgctcttcctggtgggcgcctggagcagcgctgtggaggagtgcctgcacctgggcgtgcccatcagcatcatcgtgtctgtgatgtctgagggcctgaacttctgcagcgaggaggtggtgtccctgcacgtgcctgtgcacaacatctttgactgcatggacagcaccaagaccttcagccagctggagaccttctctgtgtccctgtgccccttcctgcaggtgcccagcgacacagacctgattgaggagctgcacggcctgaaggatgtggccagccagaccctgaccatcagcaacctgagcggccggcccctgaagagctatgagctgttcaagccccagaccaaggtggaggccgacaacaacaccagcaggaccctgaagaacagcctgctggccgacacctgctgccggcagagcatcctgatccacagccgccacttcaacagaacagacaacacagaaggagtgtccaagccagatggcttccaggagcacgtgacagccacccacaagacctaccgctgcaatgacctggtggagctggccgtgggcctgagccatggagaccacagctccatgaagctggtggaggaggccgtgcagctgcagtaccagaatgcctgtgtgcagcagggcaactgcaccaagcccttcatgtttgacatcagccgcatcttcacctgctgcctgcccggcctgcctgagaccagcagctgtgtgtgccccggctacatcaccgtggtgtctgtgagcaacaaccctgtgatcaaggagctgcagaaccagcctgtgcgcatcgtgctgattgaaggagacctgacagagaactaccgccacctgggcttcaacaagagcgccaacatcaagacagtgctggacagcatgaggctgcaggaggacagcagcgaggagctgtgggccaaccacgtgctgcaggtgctgatccagttcaaggtgaacctggtgctggtgcagggcaatgtgtctgagcggctgattgagaagtgcatcaacagcaagaggctggtgattggctctgtgaatggatctgtgatgcaggcctttgctgaggccgccggggctgtgcaggtggcctacatcacccaggtgaatgaagactgtgtgggagatggagtgtgtgtgaccttctggaggagcagccccctggatgtggtggacaggaacaaccgcatcgccatcctgctgaagacagagggcatcaacctggtgacagctgtgctgaccaaccctgtgacagcccagatgcagatcaaggaggaccgcttctggacctgtgcctaccgcctgtactatgccctgaaggaggagaaggtgttcctgggcggcggcgctgtggagttcctgtgcctgagctgcctgcacatcctggccgagcagagcctgaagaaggaaaatcatgcctgcagcggctggctgcacaacaccagctcctggctggccagcagcctggccatctaccggcccaccgtgctgaagttcctggccaacggctggcagaagtacctgagcaccctgctgtacaacacagccaactacagcagcgagtttgaggccagcacctacatccagcaccacctgcagaatgccacagattctggcagccccagcagctacatcctgaatgagtacagcaagctgaacagccgcatcttcaacagcgacatcagcaacaagctggagcagatcccccgggtgtatgatgtggtgacccccaagattgaggcctggaggcgggccctggacctggtgctgctggtgctgcagacagacagcgagatcatcaccggccacggccacacccagatcaacagccaggagctgaccggcttcctgttcctgtag

SEQ ID NO: 144780 - DNA, 576 bp, Artificial Sequence
  Description of Artificial Sequence: Synthetic coding sequence
atggtgatggcctgccgggtggtgaacaagagaagacacatgggcctgcagcagctgagcagctttgctgagactggaagaaccttcctgggccccctgaagagcagcaagttcatcattgatgaagaatgtcatgaatctgtgctgatcagcagcacagtgcggctgctggagagcctggacctgaccagcgctgtgggccagctgctgaatgaagctgtgcaggcccagaacaacacctacagaacaggcatcagcaccctgctcttcctggtgggcgcctggagcagcgctgtggaggagtgcctgcacctgggcgtgcccatcagcatcatcgtgtctgtgatgtctgagggcctgaacttctgcagcgaggaggtggtgtccctgcacgtgcctgtgcacaacatctttgactgcatggacagcaccaagaccttcagccagctggagaccttctctgtgtccctgtgccccttcctgcaggtgcccagcgacacagacctgattgaggagctgcacggcctgaaggatgtggccagccagaccctgaccatcagcaacctgagcggctag

SEQ ID NO: 144781 - DNA, 2133 bp, Artificial Sequence; identical to SEQ ID NO: 144779
  Description of Artificial Sequence: Synthetic coding sequence

SEQ ID NO: 144782 - DNA, 2166 bp, Artificial Sequence
  Description of Artificial Sequence: Synthetic coding sequence
atgctgctgcccgtcttcaccctgaagctgcggcacaagatcagccccaggatggtggccatcggccgctatgatggcacccacccctgcctggccgccgccacccagacaggcaaggtgttcatccacaacccccacaccaggaaccagcacgtgtctgccagcagggtcttccagagccccctggagagtgatgtgtccctgctgagcatcaaccaggccgtgtcctgcctgacagctggggtgctgaaccctgagctgggctatgatgccctgctggtgggcacccagaccaacctgctggcctatgatgtgtacaacaacagcgacctcttctaccgggaggtggctgatggagccaatgccatcgtgctgggcaccctgggggacatcagcagccccctggccatcatcggcggcaactgtgccctgcagggcttcaaccacgagggcagtgacctcttctggacagtgactggagacaacgtgaacagcctggccctgtgtgactttgatggagatggcaagaaggagctgctggtgggcagcgaggactttgacatccgggtcttcaaggaggatgagatcgtggccgagatgacagaaacagaaattgtgaccagcctgtgccccatgtatggcagcagatttggctacgccctgagcaatggaacagtgggcgtgtatgacaagaccagccgctactggaggatcaagagcaagaaccacgccatgagcatccacgcctttgacctgaacagtgatggagtgaatgagctgatcaccggctggagcaatggcaaggtggatgcccggagtgacagaactggagaggtgatcttcaaggacaacttcagcagcgccatcgccggcgtggtggagggggactacaggatggatggccacatccagctgatctgctgcagcgtggatggagagatccggggctacctgcctggaacagctgagatgaggggcaacctgatggacaccagcgctgagcaggacctgatccgggagctgagccagaagaagcagaacctgctgctggagctgagaaattatgaagaaaatgccaaggccgagctggccagccccctgaatgaagcagatggccaccggggcatcatcccagccaacacccggctgcacaccaccctgtctgtgtccctgggcaatgagacccagacagcccacacagagctgcgcatcagcaccagcaatgacaccatcatccgggctgtgctgatctttgctgagggcatcttcaccggggagagccacgtggtgcaccccagcatccacaacctgagcagcagcatctgcatccccatcgtgccccccaaggatgtgcctgtggacctgcacctgaaggcctttgtgggctaccgcagcagcacccagttccacgtgtttgagagcacccggcagctgccccgcttctccatgtatgccctgaccagcctggaccctgccagcgagcccatctcctatgtgaacttcaccatcgccgagcgggcccagagggtggtggtgtggctgggccagaacttcctgctgcctgaggacacccacatccagaatgcccccttccaggtgtgcttcaccagcctgagaaatggaggccacctgcacatcaagatcaagctgtctggagagatcaccatcaacacagatgacatcgacctggccggggacatcatccagagcatggccagcttctttgccatcgaggacctgcaggtggaggccgacttccctgtgtactttgaggagctgaggaaggtgctggtgaaggtggatgagtaccacagcgtgcaccagaagctgtctgctgacatggctgaccacagcaacctgatccgcagcctgctggtgggcgcagaagatgcccggctgatgagggacatgaagaccatgaagagccgctacatggagctgtatgacctgaacagagacctgctgaatggctacaagatccgctgcaacaaccacacagagctgctgggcaacctgaaggctgtgaaccaggccatccagagagctggccgcctgcgggtgggcaagcccaagaaccaggtgatcacagcctgcagagatgccatccgcagcaacaacatcaacaccctcttcaagatcatgagggtgggcacagccagcagctag

SEQ ID NO: 144783 - DNA, 1560 bp, Artificial Sequence
  Description of Artificial Sequence: Synthetic coding sequence
atggccgaggagcgggtggccaccaggacccagtttcctgtgtccacagagagccagaagccccggcagaagaaggcccctgagttccccatcctggagaagcagaactggctgatccacctgcactacatcaggaaggactatgaggcctgcaaggctgtgatcaaggagcagctgcaggagacccagggcctgtgtgaatatgccatctacgtgcaggccctgatcttccggctggagggcaacatccaggagagcctggagctgttccagacctgtgctgtgctgagcccccagagcgctgacaacctgaagcaggtggcccggagcctcttcctgctgggcaagcacaaggccgccatcgaggtgtacaatgaagctgccaagctgaaccagaaggactgggagatcagccacaacctgggcgtgtgctacatctacctgaagcagttcaacaaggcccaggaccagctgcacaatgccctgaacctgaacagacatgacctgacctacatcatgctgggcaagatccacctgctggagggggacctggacaaggccatcgaggtgtacaagaaggctgtggagttcagccctgagaacacagagctgctgaccaccctgggcctgctgtacctgcagctgggcatctaccagaaggcctttgagcacctgggcaatgccctgacctatgaccccaccaactacaaggccatcctggccgccggctccatgatgcagacccatggagactttgatgtggccctgaccaagtacagagtggtggcctgtgctgtgcctgagagcccccccctgtggaacaacatcggcatgtgcttcttcggcaagaagaagtatgtggccgccatcagctgcctgaagagggccaactacctggccccctttgactggaagatcctgtacaacctgggcctggtgcacctgaccatgcagcagtatgccagcgccttccacttcctgtctgctgccatcaacttccagcccaagatgggagagctgtacatgctgctggccgtggccctgaccaacctggaggacattgaaaatgccaagagggcctatgcagaggccgtgcacctggacaagtgcaaccccctggtgaacctgaactatgctgtgctgctgtacaaccagggcgagaagaagaatgccctggcccagtaccaggagatggagaagaaggtgtccctgctgaaggacaacagcagcctggagtttgattctgagatggtggagatggcccagaagctgggcgccgccctgcaggtgggggaggccctggtgtggaccaagcctgtgaaggaccccaagagcaagcaccagaccaccagcaccagcaagccagccagcttccagcagcccctgggcagcaaccaggccctgggccaggccatgagcagcgctgctgcctaccgcaccctgcccagcggggccggcggcaccagccagttcaccaagccacccagcctgcccctggagcctgagcctgctgtggagagcagccccacagagaccagcgagcagatccgggagaagtag

SEQ ID NO: 144784 - DNA, 1584 bp, Artificial Sequence
  Description of Artificial Sequence: Synthetic coding sequence
atggccctgactgtggtgcccagcttctctgtgtctggagtgtggaagaggacccagtttcctgtgtccacagagagccagaagccccggcagaagaaggcccctgagttccccatcctggagaagcagaactggctgatccacctgcactacatcaggaaggactatgaggcctgcaaggctgtgatcaaggagcagctgcaggagacccagggcctgtgtgaatatgccatctacgtgcaggccctgatcttccggctggagggcaacatccaggagagcctggagctgttccagacctgtgctgtgctgagcccccagagcgctgacaacctgaagcaggtggcccggagcctcttcctgctgggcaagcacaaggccgccatcgaggtgtacaatgaagctgccaagctgaaccagaaggactgggagatcagccacaacctgggcgtgtgctacatctacctgaagcagttcaacaaggcccaggaccagctgcacaatgccctgaacctgaacagacatgacctgacctacatcatgctgggcaagatccacctgctggagggggacctggacaaggccatcgaggtgtacaagaaggctgtggagttcagccctgagaacacagagctgctgaccaccctgggcctgctgtacctgcagctgggcatctaccagaaggcctttgagcacctgggcaatgccctgacctatgaccccaccaactacaaggccatcctggccgccggctccatgatgcagacccatggagactttgatgtggccctgaccaagtacagagtggtggcctgtgctgtgcctgagagcccccccctgtggaacaacatcggcatgtgcttcttcggcaagaagaagtatgtggccgccatcagctgcctgaagagggccaactacctggccccctttgactggaagatcctgtacaacctgggcctggtgcacctgaccatgcagcagtatgccagcgccttccacttcctgtctgctgccatcaacttccagcccaagatgggagagctgtacatgctgctggccgtggccctgaccaacctggaggacattgaaaatgccaagagggcctatgcagaggccgtgcacctggacaagtgcaaccccctggtgaacctgaactatgctgtgctgctgtacaaccagggcgagaagaagaatgccctggcccagtaccaggagatggagaagaaggtgtccctgctgaaggacaacagcagcctggagtttgattctgagatggtggagatggcccagaagctgggcgccgccctgcaggtgggggaggccctggtgtggaccaagcctgtgaaggaccccaagagcaagcaccagaccaccagcaccagcaagccagccagcttccagcagcccctgggcagcaaccaggccctgggccaggccatgagcagcgctgctgcctaccgcaccctgcccagcggggccggcggcaccagccagttcaccaagccacccagcctgcccctggagcctgagcctgctgtggagagcagccccacagagaccagcgagcagatccgggagaagtag

SEQ ID NO: 144785 - DNA, 1524 bp, Artificial Sequence
  Description of Artificial Sequence: Synthetic coding sequence
atgatctggaacaccaggaacagcacctacatcttcaccgcccctgagttccccatcctggagaagcagaactggctgatccacctgcactacatcaggaaggactatgaggcctgcaaggctgtgatcaaggagcagctgcaggagacccagggcctgtgtgaatatgccatctacgtgcaggccctgatcttccggctggagggcaacatccaggagagcctggagctgttccagacctgtgctgtgctgagcccccagagcgctgacaacctgaagcaggtggcccggagcctcttcctgctgggcaagcacaaggccgccatcgaggtgtacaatgaagctgccaagctgaaccagaaggactgggagatcagccacaacctgggcgtgtgctacatctacctgaagcagttcaacaaggcccaggaccagctgcacaatgccctgaacctgaacagacatgacctgacctacatcatgctgggcaagatccacctgctggagggggacctggacaaggccatcgaggtgtacaagaaggctgtggagttcagccctgagaacacagagctgctgaccaccctgggcctgctgtacctgcagctgggcatctaccagaaggcctttgagcacctgggcaatgccctgacctatgaccccaccaactacaaggccatcctggccgccggctccatgatgcagacccatggagactttgatgtggccctgaccaagtacagagtggtggcctgtgctgtgcctgagagcccccccctgtggaacaacatcggcatgtgcttcttcggcaagaagaagtatgtggccgccatcagctgcctgaagagggccaactacctggccccctttgactggaagatcctgtacaacctgggcctggtgcacctgaccatgcagcagtatgccagcgccttccacttcctgtctgctgccatcaacttccagcccaagatgggagagctgtacatgctgctggccgtggccctgaccaacctggaggacattgaaaatgccaagagggcctatgcagaggccgtgcacctggacaagtgcaaccccctggtgaacctgaactatgctgtgctgctgtacaaccagggcgagaagaagaatgccctggcccagtaccaggagatggagaagaaggtgtccctgctgaaggacaacagcagcctggagtttgattctgagatggtggagatggcccagaagctgggcgccgccctgcaggtgggggaggccctggtgtggaccaagcctgtgaaggaccccaagagcaagcaccagaccaccagcaccagcaagccagccagcttccagcagcccctgggcagcaaccaggccctgggccaggccatgagcagcgctgctgcctaccgcaccctgcccagcggggccggcggcaccagccagttcaccaagccacccagcctgcccctggagcctgagcctgctgtggagagcagccccacagagaccagcgagcagatccgggagaagtag

SEQ ID NO: 144786 - DNA, 1044 bp, Artificial Sequence
  Description of Artificial Sequence: Synthetic coding sequence
atgctgggcaagatccacctgctggagggggacctggacaaggccatcgaggtgtacaagaaggctgtggagttcagccctgagaacacagagctgctgaccaccctgggcctgctgtacctgcagctgggcatctaccagaaggcctttgagcacctgggcaatgccctgacctatgaccccaccaactacaaggccatcctggccgccggctccatgatgcagacccatggagactttgatgtggccctgaccaagtacagagtggtggcctgtgctgtgcctgagagcccccccctgtggaacaacatcggcatgtgcttcttcggcaagaagaagtatgtggccgccatcagctgcctgaagagggccaactacctggccccctttgactggaagatcctgtacaacctgggcctggtgcacctgaccatgcagcagtatgccagcgccttccacttcctgtctgctgccatcaacttccagcccaagatgggagagctgtacatgctgctggccgtggccctgaccaacctggaggacattgaaaatgccaagagggcctatgcagaggccgtgcacctggacaagtgcaaccccctggtgaacctgaactatgctgtgctgctgtacaaccagggcgagaagaagaatgccctggcccagtaccaggagatggagaagaaggtgtccctgctgaaggacaacagcagcctggagtttgattctgagatggtggagatggcccagaagctgggcgccgccctgcaggtgggggaggccctggtgtggaccaagcctgtgaaggaccccaagagcaagcaccagaccaccagcaccagcaagccagccagcttccagcagcccctgggcagcaaccaggccctgggccaggccatgagcagcgctgctgcctaccgcaccctgcccagcggggccggcggcaccagccagttcaccaagccacccagcctgcccctggagcctgagcctgctgtggagagcagccccacagagaccagcgagcagatccgggagaagtag

SEQ ID NO: 144787 - DNA, 1026 bp, Artificial Sequence
  Description of Artificial Sequence: Synthetic coding sequence
atgtctgtgctggatgccctgtgggaggacagagatgtgcgctttgacctgagcgcccagcagatgaagaccaggcctggagaggtgctgattgactgcctggacagcattgaggacaccaagggcaacaacggggaccggggccgcctgctggtgaccaacctgcgcatcctgtggcacagcctggccctgagccgggtgaatgtgtctgtgggctacaactgcatcctgaacatcaccaccaggacagccaacagcaagctgcggggccagacagaggccctgtacatcctgaccaagtgcaacagcaccaggtttgagttcatcttcaccaacctggtgcccggcagccccaggctcttcacctctgtgatggctgtgcaccgggcctatgagaccagcaagatgtacagagacttcaagctgcggagcgccctgatccagaacaagcagctgcggctgctgccccaggagcacgtgtatgacaagatcaatggagtgtggaacctgagcagtgaccagggcaacctgggcaccttcttcatcaccaacgtgagaattgtgtggcacgccaacatgaatgacagcttcaacgtgtccatcccctacctgcagatccgcagcatcaagatccgggacagcaagtttggcctggccctggtgattgagagcagccagcagagcggcggctacgtgctgggcttcaagattgatcctgtggagaagctgcaggagagcgtgaaggagatcaacagcctgcacaaggtgtacagcgccagccccatctttggagtggactatgagatggaggagaagccccagcccctggaggccctgactgtggagcagatccaggatgatgtggagattgacagtgatggccacacagatgcctttgtggcctactttgctgatggcaacaagcagcaggaccgggagcccgtcttcagcgaggagctgggcctggccatcgagaagctgaaggatggcttcaccctgcagggcctgtgggaggtgatgtcctag

SEQ ID NO: 144788 - DNA, 963 bp, Artificial Sequence
  Description of Artificial Sequence: Synthetic coding sequence
atgtctgtgctggatgccctgtgggaggacagagatgtgcgctttgacctgagcgcccagcagatgaagaccaggcctggagaggtgctgattgactgcctggacagcattgaggacaccaagggcaacaacggggaccggggccgcctgctggtgaccaacctgcgcatcctgtggcacagcctggccctgagccgggtgaatgtgtctgtgggctacaactgcatcctgaacatcaccaccaggacagccaacagcaagctgcggggccagacagaggccctgtacatcctgaccaagtgcaacagcaccaggtttgagttcatcttcaccaacctggtgcccggcagccccaggctcttcacctctgtgatggctgtgcaccgggcctatgagaccagcaagatgtacagagacttcaagctgcggagcgccctgatccagaacaagcagctgcggctgctgccccaggagcacgtgtatgacaagatcaatggagtgtggaacctgagcagtgaccagggcaacctgggcaccttcttcatcaccaacgtgagaattgtgtggcacgccaacatgaatgacagcttcaacgtgtccatcccctacctgcagatcagcggcggctacgtgctgggcttcaagattgatcctgtggagaagctgcaggagagcgtgaaggagatcaacagcctgcacaaggtgtacagcgccagccccatcttcggcgtggactatgagatggaggagaagccccagcccctggaggccctgactgtggagcagatccaggatgatgtggagattgacagtgatggccacacagatgcctttgtggcctactttgctgatggcaacaagcagcaggaccgggagcctgtgttcagcgaggagctgggcctggccatcgagaagctgaaggatggcttcaccctgcagggcctgtgggaggtgatgtcctag

SEQ ID NO: 144789 - DNA, 1635 bp, Artificial Sequence
  Description of Artificial Sequence: Synthetic coding sequence
atgtctgtgctggatgccctgtgggaggacagagatgtgcgctttgacctgagcgcccagcagatgaagaccaggcctggagaggtgctgattgactgcctggacagcattgaggacaccaagggcaacaacggggaccggggccgcctgctggtgaccaacctgcgcatcctgtggcacagcctggccctgagccgggtgaatgtgtctgtgggctacaactgcatcctgaacatcaccaccaggacagccaacagcaagctgcggggccagacagaggccctgtacatcctgaccaagtgcaacagcaccaggtttgagttcatcttcaccaacctggtgcccggcagccccaggctcttcacctctgtgatggctgtgcaccgggcctatgagaccagcaagatgtacagagacttcaagctgcggagcgccctgatccagaacaagcagctgcggctgctgccccaggagcacgtgtatgacaagatcaatggagtgtggaacctgagcagtgaccagggcaacctgggcaccttcttcatcaccaacgtgagaattgtgtggcacgccaacatgaatgacagcttcaacgtgtccatcccctacctgcagatccgcagcatcaagatccgggacagcaagtttggcctggccctggtgattgagagcagccagcagagcggcggctacgtgctgggcttcaagattgatcctgtggagaagctgcaggagagcgtgaaggagatcaacagcctgcacaaggtgtacagcgccagccccatctttggagtggactatgagatggaggagaagccccagcccctggaggccctgactgtggagcagatccaggatgatgtggagattgacagtgatggccacacagatgcctttgtggcctactttgctgatggcaacaagctggacagcatcgccagcgagtgggtgggcctgccccccctgcccagcgcccgctgcctgtttggcctgggggaggtggatgacaagatctacgtggtggccggcaaggacctgcagacagaggccagcctggacagcgtgctgtgctatgaccctgtggccgccaagtggaatgaggtgaagaagctgcccatcaaggtgtatggccacaacgtcatcagccacaagggcatgatctactgcctgggcggcaagacagatgacaagaagtgcaccaacagagtcttcatcttcaaccccaagaagggggactggaaggacctggcccccatgaagatccccaggtccatgtttggagtggccgtgcacaagggcaagatcgtgattgctgggggcgtgacagaagatggcctgagcgcctctgtggaggcctttgacctgaccaccaacaagtgggatgtgatgacagagttcccccaggagaggagcagcatcagcctggtgtccctggccggcagcctgtatgccatcggcggctttgccatgatccagctggagagcaaggagtttgcccccacagaggtgaatgacatctggaagtatgaagatgacaagaaggagtgggccggcatgctgaaggagatccgctatgccagcggggccagctgcctggccacccggctgaacctcttcaagctgagcaagctgtag

SEQ ID NO: 144790 - DNA, 2148 bp, Artificial Sequence
  Description of Artificial Sequence: Synthetic coding sequence
atggacctgatcctgaacaggatggactacctgcaggtgggcgtgaccagccagaagaccatgaagctgatcccagccagccgccaccgggccacccagaaggtggtgattggagaccatgatggagtggtgatgtgcttcggcatgaagaagggggaggccgctgctgtgttcaagaccctgcccggccccaagatcgcccggctggagctgggcggcgtcatcaacaccccccaggagaagatcttcatcgccgccgccagcgagatccggggcttcaccaagaggggcaagcagttcctgagctttgagaccaacctgacagagagcatcaaggccatgcacatcagcggcagtgacctcttcctgagcgccagctacatctacaaccactactgtgactgcaaggaccagcactactacctgagcggggacaagatcaatgatgtgatctgcctgcctgtggagcggctgagccgcatcacccctgtgctggcctgccaggacagagtgctgcgggtgctgcagggcagtgatgtgatgtatgctgtggaggtgcccggccccccaacagtgctggccctgcacaatggaaatggaggagacagcggggaggacctgctgtttggcaccagtgatggcaagctggccctgatccagatcaccaccagcaagcctgtgaggaagtgggagatccagaatgagaagaagagaggaggcatcctgtgcatcgacagctttgatattgtgggagatggagtgaaggacctgctggtgggcagagatgatggcatggtggaggtgtacagctttgacaatgccaatgaacctgtgctgcgctttgaccagatgctgtctgagagcgtgaccagcatccagggcggctgtgtgggcaaggacagctatgatgaaattgtggtgtccacctacagcggctgggtgacaggcctgaccacagagcccatccacaaggagagcggccctggagaggagctgaagatcaaccaggagatgcagaacaagatcagcagcctgagaaatgagctggagcacctgcagtacaaggtgctgcaggagcgggagaactaccagcagagcagccagagcagcaaggccaagtctgctgtgcccagctttggcatcaatgacaagttcaccctgaacaaggatgatgccagctacagcctcatcctggaggtgcagacagccatcgacaacgtgctgatccagagtgatgtgcccatcgacctgctggatgtggacaagaacagcgctgtggtgtccttcagcagctgtgacagcgagagcaatgacaacttcctgctggccacctaccgctgccaggccgacaccacccggctggagctgaagatccgcagcattgagggccagtatggcaccctgcaggcctacgtgaccccccgcatccagcccaagacctgccaggtgcggcagtaccacatcaagcccctgagcctgcaccagaggacccacttcatcgaccatgaccggcccatgaacaccctgaccctgaccggccagttctcctttgctgaggtgcacagctgggtggtgttctgcctgcctgaggtgcctgagaagcccccagctggagaatgtgtgaccttctacttccagaacaccttcctggacacccagctggagagcacctacaggaagggggagggcgtcttcaagagtgacaacatcagcaccatcagcatcctgaaggatgtgctgagcaaggaggccaccaagaggaagatcaacctgaacatctcctatgagatcaatgaggtgtctgtgaagcacaccctgaagctgatccaccccaagctggagtaccagctgctgctggccaagaaggtgcagctgattgatgccctgaaggagctgcagatccacgagggcaacaccaacttcctgatccctgagtaccactgcatcctggaggaggccgaccacctgcaggaggagtacaagaagcagcctgcccacctggagcggctgtatggcatgatcacagacctcttcatcgacaagttcaagttcaagggcaccaacgtgaagaccaaggtgcccctgctgctggagatcctggacagctatgaccagaatgccctgatctccttctttgatgctgcctag

SEQ ID NO: 144791 - DNA, 2019 bp, Artificial Sequence
  Description of Artificial Sequence: Synthetic coding sequence
atggacctgatcctgaacaggatggactacctgcaggtgggcgtgaccagccagaagaccatgaagctgatcccagccagccgccaccgggccacccagaaggtggtgattggagaccatgatggagtggtgatgtgcttcggcatgaagaagggggaggccgctgctgtgttcaagaccctgcccggccccaagatcgcccggctggagctgggcggcgtcatcaacaccccccaggagaagatcttcatcgccgccgccagcgagatccggggcttcaccaagaggggcaagcagttcctgagctttgagaccaacctgacagagagcatcaaggccatgcacatcagcggcagtgacctcttcctgagcgccagctacatctacaaccactactgtgactgcaaggaccagcactactacctgagcggggacaagatcaatgatgtgatctgcctgcctgtggagcggctgagccgcatcacccctgtgctggcctgccaggacagagtgctgcgggtgctgcagggcagtgatgtgatgtatgctgtggaggtgcccggccccccaacagtgctggccctgcacaatggaaatggaggagacagcggggaggacctgctgtttggcaccagtgatggcaagctggccctgatccagatcaccaccagcaagcctgtgaggaagtgggagatccagaatgagaagaagagaggaggcatcctgtgcatcgacagctttgatattgtgggagatggagtgaaggacctgctggtgggcagagatgatggcatggtggaggtgtacagctttgacaatgccaatgaacctgtgctgcgctttgaccagatgctgtctgagagcgtgaccagcatccagggcggctgtgtgggcaaggacagctatgatgaaattgtggtgtccacctacagcggctgggtgacaggcctgaccacagagcccatccacaaggagagcggccctggagaggagctgaagatcaaccaggagatgcagaacaagatcagcagcctgagaaatgagctggagcacctgcagtacaaggtgctgcaggagcgggagaactaccagcagagcagccagagcagcaaggccaagtctgctgtgcccagctttggcatcaatgacaagttcaccctgaacaaggatgatgccagctacagcctcatcctggaggtgcagacagccatcgacaacgtgctgatccagagtgatgtgcccatcgacctgctggatgtggacaagaacagcgctgtggtgtccttcagcagctgtgacagcgagagcaatgacaacttcctgctggccacctaccgctgccaggccgacaccacccggctggagctgaagatccgcagcattgagggccagtatggcaccctgcaggcctacgtgaccccccgcatccagcccaagacctgccaggtgcggcagtaccacatcaagcccctgagcctgcaccagaggacccacttcatcgaccatgaccggcccatgaacaccctgaccctgaccggccagttctcctttgctgaggtgcacagctgggtggtgttctgcctgcctgaggtgcctgagaagcccccagctggagaatgtgtgaccttctacttccagaacaccttcctggacacccagctggagagcacctacaggaagggggagggcgtcttcaagagtgacaacatcagcaccatcagcatcctgaaggatgtgctgagcaaggaggccaccaagaggaagatcaacctgaacatctcctatgagatcaatgaggtgtctgtgaagcacaccctgaagctgatccaccccaagctggagtaccagctgctgctggccaagaaggtgcagctgattgatgccctgaaggagctgcagatccacgagggcaacaccaacttcctgatccctgagtaccactgcatcctggaggaggccgaccacctgcaggaggagtacaagaagcagcctgcccacctggagcggctgtatggatag

SEQ ID NO: 144792 - DNA, 417 bp, Artificial Sequence
  Description of Artificial Sequence: Synthetic coding sequence
gatgtgctgagcaaggaggccaccaagaggaagatcaacctgaacatctcctatgagatcaatgaggtgtctgtgaagcacaccctgaagctgatccaccccaagctggagtaccagctgctgctggccaagaaggtgcagctgattgatgccctgaaggagctgcagatccacgagggcaacaccaacttcctgatccctgagtaccactgcatcctggaggaggccgaccacctgcaggaggagtacaagaagcagcctgcccacctggagcggctgtatggcatgatcacagacctcttcatcgacaagttcaagttcaagggcaccaacgtgaagaccaaggtgcccctgctgctggagatcctggacagctatgaccagaatgccctgatctccttctttgatgctgcctag

SEQ ID NO: 144793 - DNA, 2664 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgaccccagacctgaccaggacagtgtccttctctgtgtacctgaagaggagctacacccccagcgagctggagggcaatgctgtggtgtcctacagccggcccacagacaggaacccagatggcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgagctgatcctgcggctgcaggagtactttgagaagcagggcgtgaaggactttgcctgcagcttcagcggcagcatccccctgcaggagtactttgagctgattgaccaccactttgagctgcgcatcaacggggagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaaaggaggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgaggtgagccccctgcagggcgtgtctgagtag

SEQ ID NO: 144794 - DNA, 2544 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgagcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgagctgatcctgcggctgcaggagtactttgagaagcagggcgtgaaggactttgcctgcagcttcagcggcagcatccccctgcaggagtactttgagctgattgaccaccactttgagctgcgcatcaacggggagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaaaggaggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgaggtgagccccctgcagggcgtgtctgagtag

SEQ ID NO: 144795 - DNA, 2559 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgagcctgaatgtgctgggcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgaactcatcctgcggctgcaggagtactttgagaagcagggcgtgaaggactttgcctgcagcttcagcggcagcatccccctgcaggagtactttgagctgattgaccaccactttgagctgcgcatcaatggagagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaagggcggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgaggtgagccccctgcagggcgtgtctgagtag

SEQ ID NO: 144796 - DNA, 2649 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgaccccagacctgaccaggacagtgtccttctctgtgtacctgaagaggagctacacccccagcgagctggagggcaatgctgtggtgtcctacagccggcccaccggcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgaactcatcctgcggctgcaggagtactttgagaagcagggcgtgaaggactttgcctgcagcttcagcggcagcatccccctgcaggagtactttgagctgattgaccaccactttgagctgcgcatcaatggagagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaagggcggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgaggtgagccccctgcagggcgtgtctgagtag

SEQ ID NO: 144797 - DNA, 1446 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgaacttccccagctag

SEQ ID NO: 144798 - DNA, 2559 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgaacagaaatccagatggcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgaactcatcctgcggctgcaggagtactttgagaagcagggcgtgaaggactttgcctgcagcttcagcggcagcatccccctgcaggagtactttgagctgattgaccaccactttgagctgcgcatcaatggagagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaagggcggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgaggtgagccccctgcagggcgtgtctgagtag

SEQ ID NO: 144799 - DNA, 2664 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgaccccagacctgaccaggacagtgtccttctctgtgtacctgaagaggagctacacccccagcgagctggagggcaatgctgtggtgtcctacagccggcccaccgtgcagaacagcctgggcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgagctgatcctgcggctgcaggagtactttgagaagcagggcgtgaaggactttgcctgcagcttcagcggcagcatccccctgcaggagtactttgagctgattgaccaccactttgagctgcgcatcaacggggagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaaaggaggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgaggtgagccccctgcagggcgtgtctgagtag

SEQ ID NO: 144800 - DNA, 933 bp, Artificial Sequence
  Description of Artificial Sequence: Synthetic coding sequence
atgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgctgcacagcaggaagctgtgtgtgtacagcgtgtctggcaccctgggcaatgtggagcacggcaaccagtgccagatgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacatcggggagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctcatcggcaaccacaacaacatgctgcacatctaccaggatgtgaccctgaagtgggccacccagctgccccacatccctgtggccgtgcgggtgggctgcctgcagttcagcctgtggaagcacctgctgcccaggagcagcaccctggagaagtag

SEQ ID NO: 144801 - DNA, 294 bp, Artificial Sequence
  Description of Artificial Sequence: Synthetic coding sequence
atgagcctcttcaaggcccgggactggtggagcaccatcctgggggacaaggaggagtttgaccagggctgcctgtgcctggccaacgtggacaacagcggaaatggccaggacaagatcatcgtgggcagcttcatgggctacctgcgcatcttcagcccccacccagccaagacaggagatggagcccaggccgaggacctgctgctggaggtggacctgcgggaccctgtgctgcaggtggaggtgggcaagtttgtgtctggaacagagatgctgcacctggccgtgtag

SEQ ID NO: 144802 - DNA, 1365 bp, Artificial Sequence
  Description of Artificial Sequence: Synthetic coding sequence
tgagacctggtgcccagcgtgacagtgaaggtgaccctgcagaacagagtcatcctgcagaaggccaagctgtctgtgtatgtgcagccccccctggagctgacctgtgaccagttcacctttgagttcatgaccccagacctgaccaggacagtgtccttctctgtgtacctgaagaggagctacaccccatctgagctggagggcaatgctgtggtgtcctacagccggcccacagacagaaatccagatggcatccccagggtcatccagtgcaagttccggctgcccctgaagctgatctgcctgcccggccagcccagcaagacagccagccacaagatcaccatcgacaccaacaagagccctgtgtccctgctgagcctcttccctggctttgccagccagagtgatgatgaccaggtgaatgtgatgggcttccacttcctgggcggggcccgcatcaccgtgctggccagcaagaccagccagcgctaccgcatccagagcgagcagtttgaggacctgtggctgatcaccaatgaactcatcctgcggctgcaggagtactttgagaagcagggcgtgaaggactttgcctgcagcttcagcggcagcatccccctgcaggagtactttgagctgattgaccaccactttgagctgcgcatcaatggagagaagctggaggagctgctgtctgaaagagctgtgcagttccgggccatccagaggcggctgctggcccgcttcaaggacaagaccccagcccccctgcagcacctggacaccctgctggatggcacctacaagcaggtgattgccctggctgatgctgtggaggagaaccagggcaacctcttccagagcttcacccggctgaagagcgccacccacctggtgatcctgctgattgccctgtggcagaagctgtctgctgaccaggtggccatcctggaggccgccttcctgcccctgcaggaggacacccaggagctgggctgggaggagaccgtggatgctgccatcagccacctgctgaagacctgcctgagcaagagcagcaaggagcaggccctgaacctgaacagccagctgaacatccccaaggacaccagccagctgaagaagcacatcaccctgctgtgtgaccggctgagcaagggcggccgcctgtgcctgagcacagatgctgctgccccccagaccatggtgatgcctgggggctgcaccaccatccctgagagtgacctggaggagaggtctgtggagcaggacagcacagagctgttcaccaaccaccgccacctgacagctgagacccccaggcctgggaagaggctggatggcctgcacaagaggtag

SEQ ID NO: 144803 - DNA, 1227 bp, Artificial Sequence
  Description of Artificial Sequence: Synthetic coding sequence
atgaagctgatgtatgagcacaacctgcagaggacagcctgcaacatgacctacggcagctttggaggagtgaagggccgggacctgatctgcatccagagcatggatggcatgctgatggtgtttgagcaggagagctatgccttcggccgcttcctgcccggcttcctgctgcccggccccctggcctacagcagcaggacagacagcttcctgactgtgagcagctgccagcaggtggagagctacaagtaccaggtgctggcctttgccacagatgctgacaagaggcaggagacagagcagcagaagctgggcagcggcaagaggctggtggtggactggaccctgaacattggagagcaggccctggacatctgcatcgtgtccttcaaccagagcgccagctctgtgtttgtgctgggggagaggaacttcttctgcctgaaggacaatggccagatccgcttcatgaagaagctggactggagccccagctgcttcctgccctactgcagcgtgtctgagggcaccatcaacaccctgattggcaaccacaacaacatgctgcacatctaccaggatgtgaccctgaagtgggccacccagctgccccacatccctgtggccgtgcgggtgggctgcctgcatgacctgaagggcgtgattgtgaccctgagtgatgatggccacctgcagtgcagctacctgggcacagaccccagcctcttccaggcccccaacgtgcagagccgggagctgaactatgatgagctggatgtggagatgaaggagctgcagaagatcatcaaggatgtgaacaagagccagggcgtgtggcccatgacagagcgggaggatgacctgaatgtgtctgtggtggtgagccccaactttgattctgtgtcccaggccacagatgtggaggtgggcacagacctggtgcccagcgtgacagtgaaggtgaccctgcagaacagagtcatcctgcagaaggccaagctgtctgtgtatgtgcagccccccctggagctgacctgtgaccagttcacctttgagttcatgaccccagacctgaccaggacagtgtccttctctgtgtacctgaagaggagcatccaccaccagaactggaaggagatgctgctcttcctgatcccagaccagcagatcgagatcctgatggccttccgggagctgagcaatgtgaacctggacttcccctag

SEQ ID NO: 144804 - DNA, 984 bp, Artificial Sequence
  Description of Artificial Sequence: Synthetic coding sequence
atggagggcagcaatggatttggaattgacagcatcctgagccacagagctggcagccctgccctgcccaagggggaccccctgctgggggactgccgcagccccctggagctgagccccaggtctgagagcagcagtgactgcagcagccctgccagccctggccgggactgcctggagaccggcacccccaggcctgggggcgccagcggccctggcctggacagccacctgcagcccggccagctgagcgccccagcccagagcaggacagtgaccagcagcttcctgatccgggacatcctggccgactgcaagcccctggccgcctgtgccccctacagcagcagcggccagcctgctgcccctgagcccggcggccgcctggccgccaaggctgctgaggacttccgggacaagctggacaagagcggcagcaatgccagcagtgacagcgagtacaaggtgaaggaggagggggaccgggagatcagcagcagccgggacagcccccctgtgcggctgaagaagcccaggaaggccaggacagccttcacagaccaccagctggcccagctggagaggagctttgagcggcagaagtacctgtctgtgcaggacaggatggagctggccgccagcctgaacctgacagacacccaggtgaagacctggtaccagaacagaaggaccaagtggaagaggcagacagctgtgggcctggagctgctggccgaggccggcaactacagcgccctgcagaggatgttccccagcccctacttctacccccagagcctggtgagcaacctggaccctggagctgccctgtacctgtaccggggccccagcgcccctcctccagccctgcagaggcccctggtgccccgcatcctgattcatggcctgcagggcgccagcgagcccccaccacccctgccccccctggccggcgtgctgcccagggctgcccagcccaggtag

SEQ ID NO: 144805 - DNA, 984 bp, Artificial Sequence; identical to SEQ ID NO: 144804
  Description of Artificial Sequence: Synthetic coding sequence

SEQ ID NO: 144806 - DNA, 270 bp, Artificial Sequence
  Description of Artificial Sequence: Synthetic coding sequence
atgaccaccagccagaagcaccgggactttgtggccgagcccatgggagagaagcctgtgggcagcctggccggcatcggggaggtgctgggcaagaagctggaggagcggggctttgacaaggcctacgtggtgctgggccagttcctggtgctgaagaaggatgaggacctcttccgggagtggctgaaggacacctgtggggccaatgccaagcagagccgggactgcttcggctgcctgcgggagtggtgtgatgccttcctgtag

SEQ ID NO: 144807 - DNA, 270 bp, Artificial Sequence; identical to SEQ ID NO: 144806
  Description of Artificial Sequence: Synthetic coding sequence

SEQ ID NO: 144808 - DNA, 270 bp, Artificial Sequence; identical to SEQ ID NO: 144806
  Description of Artificial Sequence: Synthetic coding sequence

SEQ ID NO: 144809 - DNA, 87 bp, Artificial Sequence
  Description of Artificial Sequence: Synthetic coding sequence
atgaccaccagccagaagcaccgggactttgtggccgagcccatgggagagaagcctgtgggcagcctggccggcatcggggagtag

SEQ ID NO: 144810 - DNA, 270 bp, Artificial Sequence; identical to SEQ ID NO: 144806
  Description of Artificial Sequence: Synthetic coding sequence

SEQ ID NO: 144811 - DNA, 963 bp, Artificial Sequence
  Description of Artificial Sequence: Synthetic coding sequence
atggctgatgagaagaccttcagaattggcttcatcgtgctgggcctcttcctgctggccctgggcaccttcctgatgagccatgaccggccccaggtgtatggcaccttctacgccatgggctctgtgatggtgattggaggcatcatctggagcatgtgccagtgctaccccaagatcacctttgtgcctgctgacagcgacttccagggcatcctgagccccaaggccatgggcctgctggagaatggcctggccgctgagatgaagagccccagcccccagcccccctacgtgcggctgtgggaggaggccgcctatgaccagagcctgcctgacttcagccacatccagatgaaggtgatgagctacagcgaggaccacaggagcctgctggcccctgagatgggccagcccaagctgggcaccagtgatggaggagagggcggccctggagatgtgcaggcctggatggaggccgctgtggtgatccacaagggcagtgatgaaagtgaaggagagcggcggctgacccagagctggccaggccccctggcctgcccccagggccctgcccccctggccagcttccaggatgacctggacatggacagcagcgagggcagcagccccaatgccagcccccatgaccgggaggaggcctgcagcccccagcaggagccccagggctgccgctgccccctggaccgcttccaggactttgccctgattgatgcccccaccctggaggatgagccccaggagggccagcagtgggagatcgccctgcccaacaactggcagcgctaccccaggaccaaggtggaggagaaggaggccagtgacacaggaggagaggagcctgagaaggaggaggaggacctgtactacggcctgcctgatggagctggggacctgctgcctgacaaggagctgggctttgagccagacacccagggctag

SEQ ID NO: 144812 - DNA, 765 bp, Artificial Sequence
  Description of Artificial Sequence: Synthetic coding sequence
atgcagaggcctggagagcctggagctgcccgcttcggccccccagagggctgtgccgaccaccggccccaccgctaccgctccttcatgattgaggagatcctgacagagcccccaggccccaagggggccgccccagctgctgctgctgctgctgctggggagctgctgaagtttggagtgcaggccctgctggccgcccggcccttccacagccacctggccgtgctgaaggccgagcaggccgctgtgttcaagttccccctggcccccctgggctgcagcggcctgagcagcgccctgctggccgccggccctggcctgcctggagctgctggggccccccacctgcccctggagctgcagctgcggggcaagctggaggccgccggccctggagagcccggcaccaaggccaagaagggcagaagaagcaggacagtgttcacagagctgcagctgatgggcctggagaagagatttgagaagcagaagtacctgagcaccccagacagaattgacctggccgagagcctgggcctgagccagctgcaggtgaagacctggtaccagaacagaaggatgaagtggaagaagatcgtgctgcagggcggcggcctggagagccccaccaagcccaagggccggcccaagaagaacagcatccccaccagcgagcagctgacagagcaggagcgggccaaggatgctgagaagccagctgaggtgcctggagagcccagcgacaggagcagagaagattag

SEQ ID NO: 144813 - DNA, 303 bp, Artificial Sequence
  Description of Artificial Sequence: Synthetic coding sequence
atgggcctggagaagagatttgagaagcagaagtacctgagcaccccagacagaattgacctggccgagagcctgggcctgagccagctgcaggtgaagacctggtaccagaacagaaggatgaagtggaagaagatcgtgctgcagggcggcggcctggagagccccaccaagcccaagggccggcccaagaagaacagcatccccaccagcgagcagctgacagagcaggagcgggccaaggatgctgagaagccagctgaggtgcctggagagcccagcgacaggagcagagaagattag

SEQ ID NO: 144814 - DNA, 840 bp, Artificial Sequence
  Description of Artificial Sequence: Synthetic coding sequence
atgcactgccacgccgagctgcggctgagcagccctggccagctgaaggccgcccggcggcgctacaagaccttcatgattgatgagatcctgagcaaggagacctgtgactactttgagaagctgagcctgtacagcgtgtgccccagcctggtggtgcggcccaagcccctgcacagctgcaccggcagccccagcctgcgggcctaccccctgctgagcgtcatcacccggcagcccaccgtcatcagccacctggtgcctgccaccccaggcatcgcccaggccctgagctgccaccaggtgacagaagctgtgtctgctgaggcccctggaggagaggccctggccagcagcgagagcgagacagagcagcccaccccccggcagaagaagccccggcgcagcaggaccatcttcacagagctgcagctgatgggcctggagaagaagttccagaagcagaagtacctgagcaccccagaccggctggacctggcccagagcctgggcctgacccagctgcaggtgaagacctggtaccagaacagaaggatgaagtggaagaagatggtgctgaagggcggccaggaggcccccaccaagcccaagggccggcccaagaagaacagcatccccaccagcgaggagattgaggccgaggagaagatgaacagccaggcccagggccaggagcagctggagcccagccagggccaggaggagctgtgtgaggcccaggagcccaaggccagagatgtgcccctggagatggccgagcccccagaccccccccaggagctgcccatccccagcagcgagcccccacccctgtcctag

SEQ ID NO: 144815 - DNA, 1887 bp, Artificial Sequence
  Description of Artificial Sequence: Synthetic coding sequence
atggagcccccagatgccccagcccaggcccggggggccccccggctgctgctgctggccgtgctgctggccgcccacccagatgcccaggccgaggtgcggctgtctgtgccccccctggtggaggtgatgaggggcaagagcgtcatcctggactgcacccccaccggcacccatgaccactacatgctggagtggttcctgacagacagaagtggggcccggccccggctggccagcgctgagatgcagggcagcgagctgcaggtgaccatgcatgacacccggggccgcagccccccctaccagctggacagccagggccgcctggtgctggccgaggcccaggtgggagatgagcgggactatgtgtgtgtggtgcgggccggggccgccggcacagctgaggccacagcccggctgaatgtgtttgccaagccagaggccacagaggtgagccccaacaagggcaccctgtctgtgatggaggacagcgcccaggagatcgccacctgcaacagcagaaatggaaatcctgcccccaagatcacctggtacagaaatggccagaggctggaggtgcctgtggagatgaaccctgagggctacatgaccagcaggacagtgcgggaggccagcggcctgctgagcctgaccagcaccctgtacctgcggctgaggaaggatgacagagatgccagcttccactgtgccgcccactacagcctgcctgagggccgccacggccgcctggacagccccaccttccacctgaccctgcactaccccacagagcacgtgcagttctgggtgggcagccccagcaccccagctggctgggtgcgggagggggacacagtgcagctgctgtgcagaggagatggcagccccagccctgagtacaccctcttccggctgcaggatgagcaggaggaggtgctgaatgtgaacctggagggcaacctgaccctggagggcgtgacccggggccagagcggcacctacggctgccgggtggaggactatgatgctgctgatgatgtgcagctgagcaagaccctggagctgcgggtggcctacctggaccccctggagctgtctgagggcaaggtgctgagcctgcccctgaacagcagcgctgtggtgaactgcagcgtgcacggcctgcccaccccagccctgcgctggaccaaggacagcacccccctgggagatggccccatgctgagcctgagcagcatcacctttgacagcaatggcacctacgtgtgtgaggccagcctgcccaccgtgcctgtgctgagcaggacccagaacttcaccctgctggtgcagggcagccctgagctgaagacagctgagattgagcccaaggcagatggctcctggagagaaggagatgaggtgaccctcatctgcagcgcccggggccacccagaccccaagctgtcctggagccagctgggcggcagccctgctgagcccatccctggccggcagggctgggtgagcagcagcctgaccctgaaggtgaccagcgccctgagcagagatggcatcagctgtgaggccagcaacccccacggcaacaagagacatgtgttccactttggaacagtgagcccccagaccagccaggccggcgtggccgtgatggctgtggccgtgtctgtgggcctgctgctgctggtggtggccgtgttctactgtgtgcggaggaagggcggcccctgctgccggcagaggcgggagaagggggcccctcctcctggagagcccggcctgagccacagcggcagcgagcagcctgagcagacaggcctgctgatgggcggggccagcggcggggcccggggcggcagcggcggctttggagatgaatgttag

SEQ ID NO: 144816 - DNA, 1767 bp, Artificial Sequence
  Description of Artificial Sequence: Synthetic coding sequence
atggagcccccagatgccccagcccaggcccggggggccccccggctgctgctgctggccgtgctgctggccgcccacccagatgcccaggccgaggtgcggctgtctgtgccccccctggtggaggtgatgaggggcaagagcgtcatcctggactgcacccccaccggcacccatgaccactacatgctggagtggttcctgacagacagaagtggggcccggccccggctggccagcgctgagatgcagggcagcgagctgcaggtgaccatgcatgacacccggggccgcagccccccctaccagctggacagccagggccgcctggtgctggccgaggcccaggtgggagatgagcgggactatgtgtgtgtggtgcgggccggggccgccggcacagctgaggccacagcccggctgaatgtgtttgccaagccagaggccacagaggtgagccccaacaagggcaccctgtctgtgatggaggacagcgcccaggagatcgccacctgcaacagcagaaatggaaatcctgcccccaagatcacctggtacagaaatggccagaggctggaggtgcctgtggagatgaaccctgagggctacatgaccagcaggacagtgcgggaggccagcggcctgctgagcctgaccagcaccctgtacctgcggctgaggaaggatgacagagatgccagcttccactgtgccgcccactacagcctgcctgagggccgccacggccgcctggacagccccaccttccacctgaccctgcactaccccacagagcacgtgcagttctgggtgggcagccccagcaccccagctggctgggtgcgggagggggacacagtgcagctgctgtgcagaggagatggcagccccagccctgagtacaccctcttccggctgcaggatgagcaggaggaggtgctgaatgtgaacctggagggcaacctgaccctggagggcgtgacccggggccagagcggcacctacggctgccgggtggaggactatgatgctgctgatgatgtgcagctgagcaagaccctggagctgcgggtggcctacctggaccccctggagctgtctgagggcaaggtgctgagcctgcccctgaacagcagcgctgtggtgaactgcagcgtgcacggcctgcccaccccagccctgcgctggaccaaggacagcacccccctgggagatggccccatgctgagcctgagcagcatcacctttgacagcaatggcacctacgtgtgtgaggccagcctgcccaccgtgcctgtgctgagcaggacccagaacttcaccctgctggtgcagggcagccctgagctgaagacagctgagattgagcccaaggcagatggctcctggagagaaggagatgaggtgaccctcatctgcagcgcccggggccacccagaccccaagctgtcctggagccagctgggcggcagccctgctgagcccatccctggccggcagggctgggtgagcagcagcctgaccctgaaggtgaccagcgccctgagcagagatggcatcagctgtgaggccagcaacccccacggcaacaagagacatgtgttccactttggaacagtgagcccccagaccagccaggccggcgtggccgtgatggctgtggccgtgtctgtgggcctgctgctgctggtggtggccgtgttctactgtgtgcggaggaagggcggcccctgctgccggcagaggcgggagaagggggccccctag

SEQ ID NO: 144817 - DNA, 321 bp, Artificial Sequence
  Description of Artificial Sequence: Synthetic coding sequence
atgatgaccctggtgccccgggcccggacccgggccggccaggaccactacagccacccctgcccccgcttcagccaggtgctgctgacagagggcatcatgacctactgcctgaccaagaacctgagtgatgtgaacatcctgcaccggctgctgaagaatggaaatgtgaggaacaccctgctgcagagcaaggtgggcctgctgacctactacgtgaagctgtacccaggagaggtgaccctgctgacccggcccagcatccagatgaggctgtgctgcatcaccggctctgtgtcccggcccaggagccagaagtag

SEQ ID NO: 144818 - DNA, 321 bp, Artificial Sequence; identical to SEQ ID NO: 144817
  Description of Artificial Sequence: Synthetic coding sequence

SEQ ID NO: 144819 - DNA, 1146 bp, Artificial Sequence
  Description of Artificial Sequence: Synthetic coding sequence
atggagcggggcatgcacctgggcgctgctgctgctggggaggatgacctcttcctgcacaagagcctgagcgccagcaccagcaagaggctggaggccgccttccgcagcaccccacctggcatggacctgagcctggcccccccaccccgggagaggcctgccagcagcagcagcagccccctgggctgctttgagcctgctgaccctgagggcgccggcctgctgctgcccccacctgggggcggcggcggcggcagcgctggcagcggcggcggcggcggcggcggcgtgggcgtgcccggcctgctggtgggcagcgctggggtgggcggggaccccagcctgagcagcctgcctgctggagctgccctgtgcctgaagtatggagagagcgccagccggggctctgtggccgagagcagcggcggggagcagagcccagatgatgacagtgatggccgctgtgagctggtgctgcgggccggcgtggccgacccccgggccagccctggagctgggggcggcggggccaaggctgctgagggctgcagcaatgcccacctgcacggcggggcctctgtgcccccaggcggcctgggcggcggcggcggcggcggcagcagcagcggcagcagcggcggcggcggcggcagcggcagcggcagcggcggcagcagcagcagcagcagcagcagcagcaagaagagcaaggagcagaaggccctgcggctgaacatcaatgcccgggagaggaggaggatgcatgacctgaatgatgccctggatgagctgcgggctgtgatcccctatgcccacagccccagcgtgaggaagctgagcaagatcgccaccctgctgctggccaagaactacatcctgatgcaggcccaggccctggaggagatgaggcggctggtggcctacctgaaccagggccaggccatctctgctgccagcctgcccagcagcgctgctgctgctgctgctgctgctgccctgcacccagccctgggcgcctatgagcaggccgccggctaccccttctctgctggcctgcccccagctgccagctgcccagagaagtgtgccctcttcaacagcgtgagcagcagcctgtgcaagcagtgcacagagaagccctag

SEQ ID NO: 144820 - DNA, 678 bp, Artificial Sequence
  Description of Artificial Sequence: Synthetic coding sequence
atggccgagctgaagagcctgtctggagatgcctacctggccctgagccacggctacgccgctgctgctgctggcctggcctacggggccgcccgggagcctgaggccgcccggggctacggcaccccaggccctggaggagacctgcctgctgccccagccccccgggccccagcccaggccgctgagagcagtggagagcagagcggagatgaagatgatgcctttgagcagaggagaagaagaagaggccctggcagcgctgctgatggaagaagaagaccccgggagcagaggagcctgcggctgagcatcaatgcccgggagaggaggaggatgcatgacctgaatgatgccctggatggcctgcgggctgtgatcccctatgcccacagccccagcgtgaggaagctgagcaagatcgccaccctgctgctggccaagaactacatcctgatgcaggcccaggccctggatgagatgaggcggctggtggccttcctgaaccagggccagggcctggccgcccctgtgaatgctgcccccctgacccccttcggccaggccaccgtgtgccccttctctgctggggccgccctgggcccctgcccagacaagtgtgccgccttcagcggcaccccatctgccctgtgcaagcactgccacgagaagccctag

SEQ ID NO: 144821 - DNA, 1239 bp, Artificial Sequence
  Description of Artificial Sequence: Synthetic coding sequence
atggagcgcatccccagcgcccagcccccaccagcctgcctgcccaaggcccctggcctggagcacggggacctgcccggcatgtacccagcccacatgtaccaggtgtacaagagccggcggggcatcaagagaagtgaggacagcaaggagacctacaagctgccccacaggctcatcgagaagaagaggcgggaccgcatcaatgaatgcatcgcccagctgaaggacctgctgcctgagcacctgaagctgaccaccctgggccacctggagaaggctgtggtgctggagctgaccctgaagcacgtgaaggccctgaccaacctgattgaccagcagcagcagaagatcatcgccctgcagagcggcctgcaggccggggagctgtctggaagaaatgtggagaccggccaggagatgttctgcagcggcttccagacctgtgcccgggaggtgctgcagtacctggccaagcatgagaacacccgggacctgaagagcagccagctggtgacccacctgcaccgggtggtgtctgagctgctgcagggcggcaccagcaggaagcccagcgaccctgcccccaaggtgatggacttcaaggagaagcccagcagccctgccaagggcagcgagggccctgggaagaactgtgtgcctgtgatccagaggacctttgcccacagcagtggagagcagagcggcagtgacacagacacagattctggctatggaggagagagcgagaagggggacctgcggtctgagcagccctgcttcaagagtgaccatggaagacgcttcaccatgggagagagaattggagccatcaagcaggagagcgaggagccccccaccaagaagaacaggatgcagctgagtgatgatgagggccacttcaccagcagtgacctgatcagcagccccttcctgggcccccacccccaccagccccccttctgcctgcccttctacctgatccccccatctgccacagcctacctgcccatgctggagaagtgctggtaccccacctctgtgcctgtgctgtacccaggcctgaatgccagcgctgctgccctgagcagcttcatgaacccagacaagatcagcgcccccctgctgatgccccagaggctgcccagccccctgcctgcccaccccagcgtggacagctctgtgctgctgcaggccctgaagcccatcccccccctgaacctggagaccaaggactag

SEQ ID NO: 144822 - DNA, 378 bp, Artificial Sequence
  Description of Artificial Sequence: Synthetic coding sequence
atgccccacagcagtgacagcagtgacagcagcttcagccgcagccccccacctgggaagcaggacagcagtgatgatgtgcggcgggtgcagaggcgggagaagaacagaattgctgcccagaagagccggcagaggcagacccagaaggctgacaccctgcacctggagagcgaggacctggagaagcagaatgctgccctgaggaaggagatcaagcagctgacagaggagctgaagtacttcacctctgtgctgaacagccatgagcccctgtgcagcgtgctggccgccagcacccccagccccccagaggtggtgtacagcgcccacgccttccaccagccccacgtgagcagcccccgcttccagccctag

SEQ ID NO: 144823 - DNA, 384 bp, Artificial Sequence
  Description of Artificial Sequence: Synthetic coding sequence
atgagccagggcctgcctgctgctggctctgtgctgcagaggtctgtggccgcccctggcaaccagccccagccccagccccagcagcagagcccagaagatgatgacaggaaggtgagaagaagagagaagaacagagtggccgcccagaggagcaggaagaagcagacccagaaggctgacaagctgcacgaggagtatgagagcctggagcaggagaacaccatgctgcggcgggagatcggcaagctgacagaggagctgaagcacctgacagaggccctgaaggagcacgagaagatgtgccccctgctgctgtgccccatgaactttgtgcctgtgccccccaggccagaccctgtggccggctgcctgcccaggtag

SEQ ID NO: 144824 - DNA, 489 bp, Artificial Sequence
  Description of Artificial Sequence: Synthetic coding sequence
atgaaggagaccatcatgaaccaggagaagctggccaagctgcaggcccaggtgcgcatcggcggcaaaggaacagcccggaggaagaagaaggtggtgcacaggacagccacagcagatgacaagaagctgcagttcagcctgaagaagctgggcgtgaacaacatctctggaattgaggaggtgaacatgttcaccaaccagggcaccgtcatccacttcaacaaccccaaggtgcaggccagcctggccgccaacaccttcaccatcactggacatgctgagaccaagcagctgacagagatgctgcccagcatcctgaaccagctgggcgctgacagcctgaccagcctgcggcggctggccgaggccctgcccaagcagagcgtggatggcaaggcccccctggccaccggggaggatgatgatgatgaggtgcctgacctggtggagaactttgatgaggccagcaagaatgaggccaactag

SEQ ID NO: 144825 - DNA, 621 bp, Artificial Sequence
  Description of Artificial Sequence: Synthetic coding sequence
atgagaagaactggagccccagcccaggccgacagccggggccggggccgggcccggggcggctgccctggaggagaggccaccctgagccagcccccaccccggggcggcacccggggccaggagccccagatgaaggagaccatcatgaaccaggagaagctggccaagctgcaggcccaggtgcgcatcggcggcaaaggaacagcccggaggaagaagaaggtggtgcacaggacagccacagcagatgacaagaagctgcagttcagcctgaagaagctgggcgtgaacaacatctctggaattgaggaggtgaacatgttcaccaaccagggcaccgtcatccacttcaacaaccccaaggtgcaggccagcctggccgccaacaccttcaccatcactggacatgctgagaccaagcagctgacagagatgctgcccagcatcctgaaccagctgggcgctgacagcctgaccagcctgcggcggctggccgaggccctgcccaagcagagcgtggatggcaaggcccccctggccaccggggaggatgatgatgatgaggtgcctgacctggtggagaactttgatgaggccagcaagaatgaggccaactag

SEQ ID NO: 144826 - DNA, 1158 bp, Artificial Sequence
  Description of Artificial Sequence: Synthetic coding sequence
atggctgctgccctgtttgtgctgctgggctttgccctgctgggcacccatggagccagcggggctgctggctttgtgcaggcccccctgagccagcagcgctgggtgggcggctctgtggagctgcactgtgaggccgtgggcagccctgtgcctgagatccagtggtggtttgagggccagggccccaatgacacctgcagccagctgtgggatggagcccggctggacagagtgcacatccacgccacctaccaccagcacgccgccagcaccatcagcattgacaccctggtggaggaggacaccggcacctatgaatgtcgggccagcaatgaccctgacaggaaccacctgacccgggccccccgggtgaagtgggtgcgggcccaggccgtggtgctggtgctggagcccggcaccgtcttcaccaccgtggaggacctgggcagcaagatcctgctgacctgcagcctgaatgacagcgccacagaggtgacaggccaccgctggctgaagggcggcgtggtgctgaaggaggatgccctgcccggccagaagacagagttcaaggtggacagtgatgaccagtggggcgagtacagctgtgtgttcctgcctgagcccatgggcacagccaacatccagctgcacggccccccccgggtgaaggctgtgaagagcagcgagcacatcaatgaaggagaaacagccatgctggtgtgcaagtctgagagcgtgccccctgtgacagactgggcctggtacaagatcacagattctgaggacaaggccctgatgaatggcagcgagagccgcttctttgtgagcagcagccagggccgctctgagctgcacatcgagaacctgaacatggaggccgaccccggccagtaccgctgcaatggcaccagcagcaaaggaagtgaccaggccatcatcaccctgcgggtgcgcagccacctggccgccctgtggcccttcctgggcatcgtggccgaggtgctggtgctggtgaccatcatcttcatctatgagaagaggaggaagccagaagatgtgctggatgatgatgatgctggcagcgcccccctgaagagcagcggccagcaccagaatgacaagggcaagaatgtgcggcagaggaacagcagctag

SEQ ID NO: 144827 - DNA, 618 bp, Artificial Sequence
  Description of Artificial Sequence: Synthetic coding sequence
atgaagcagagtgatgccagcccccaggagcgggtggacagtgatgaccagtggggcgagtacagctgtgtgttcctgcctgagcccatgggcacagccaacatccagctgcacggccccccccgggtgaaggctgtgaagagcagcgagcacatcaatgaaggagaaacagccatgctggtgtgcaagtctgagagcgtgccccctgtgacagactgggcctggtacaagatcacagattctgaggacaaggccctgatgaatggcagcgagagccgcttctttgtgagcagcagccagggccgctctgagctgcacatcgagaacctgaacatggaggccgaccccggccagtaccgctgcaatggcaccagcagcaaaggaagtgaccaggccatcatcaccctgcgggtgcgcagccacctggccgccctgtggcccttcctgggcatcgtggccgaggtgctggtgctggtgaccatcatcttcatctatgagaagaggaggaagccagaagatgtgctggatgatgatgatgctggcagcgcccccctgaagagcagcggccagcaccagaatgacaagggcaagaatgtgcggcagaggaacagcagctag

SEQ ID NO: 144828 - DNA, 810 bp, Artificial Sequence
  Description of Artificial Sequence: Synthetic coding sequence
atggctgctgccctgtttgtgctgctgggctttgccctgctgggcacccatggagccagcggggctgctggcaccgtcttcaccaccgtggaggacctgggcagcaagatcctgctgacctgcagcctgaatgacagcgccacagaggtgacaggccaccgctggctgaagggcggcgtggtgctgaaggaggatgccctgcccggccagaagacagagttcaaggtggacagtgatgaccagtggggcgagtacagctgtgtgttcctgcctgagcccatgggcacagccaacatccagctgcacggccccccccgggtgaaggctgtgaagagcagcgagcacatcaatgaaggagaaacagccatgctggtgtgcaagtctgagagcgtgccccctgtgacagactgggcctggtacaagatcacagattctgaggacaaggccctgatgaatggcagcgagagccgcttctttgtgagcagcagccagggccgctctgagctgcacatcgagaacctgaacatggaggccgaccccggccagtaccgctgcaatggcaccagcagcaaaggaagtgaccaggccatcatcaccctgcgggtgcgcagccacctggccgccctgtggcccttcctgggcatcgtggccgaggtgctggtgctggtgaccatcatcttcatctatgagaagaggaggaagccagaagatgtgctggatgatgatgatgctggcagcgcccccctgaagagcagcggccagcaccagaatgacaagggcaagaatgtgcggcagaggaacagcagctag

SEQ ID NO: 144829 - DNA, 531 bp, Artificial Sequence
  Description of Artificial Sequence: Synthetic coding sequence
atgggcacagccaacatccagctgcacggccccccccgggtgaaggctgtgaagagcagcgagcacatcaatgaaggagaaacagccatgctggtgtgcaagtctgagagcgtgccccctgtgacagactgggcctggtacaagatcacagacagcgaggacaaggccctgatgaatggaagtgagagccgcttctttgtgagcagcagccagggccgctctgagctgcacatcgagaacctgaacatggaggccgaccccggccagtaccgctgcaatggcaccagcagcaagggcagtgaccaggccatcatcaccctgcgggtgcgcagccacctggccgccctgtggcccttcctgggcatcgtggccgaggtgctggtgctggtgaccatcatcttcatctatgagaagaggaggaagccagaagatgtgctggatgatgatgatgctggcagcgcccccctgaagagcagcggccagcaccagaatgacaagggcaagaatgtgcggcagaggaacagcagctag

SEQ ID NO: 144830 - DNA, 2985 bp, Artificial Sequence
  Description of Artificial Sequence: Synthetic coding sequence
atgagaagaagaccacccagcagaggaggaagaggagctgcccgggcccgggagacccggcggcagcccaggcacaggtctggaagaaggatggccgaggccatcagctgcaccctgaactgcagctgccagagcttcaagccaggcaagatcaaccaccggcagtgtgaccagtgcaagcacggctgggtggcccacgccctgagcaagctgcgcatcccccccatgtaccccaccagccaggtggagatcgtgcagagcaatgtggtgtttgacatcagcagcctgatgctgtatggcacccaggccatccctgtgcggctgaagatcctgctggacaggctcttctctgtgctgaagcaggatgaggtgctgcagatcctgcacgccctggactggaccctgcaggactacatccggggctacgtgctgcaggatgccagcggcaaggtgctggaccactggagcatcatgaccagcgaggaggaggtggccaccctgcagcagttcctgcgctttggagagaccaagagcatcgtggagctgatggccatccaggagaaggaggagcagagcatcatcatcccccccagcacagccaacgtggacatccgggccttcatcgagagctgcagccacaggagcagcagcctgcccacccctgtggacaagggcaaccccagcagcatccacccctttgagaacctgatcagcaacatgaccttcatgctgcccttccagttcttcaaccccctgcccccagccctgattggcagcctgcctgagcagtacatgctggagcagggccatgaccagagccaggaccccaagcaggaggtgcacggccccttcccagacagcagcttcctgaccagcagcagcacccccttccaggtggagaaggaccagtgcctgaactgcccagatgccatcaccaagaaggaggacagcacccacctgagtgacagcagcagctacaacatcgtgaccaagtttgagaggacccagctgagccctgaggccaaggtgaagccagagaggaacagcctgggcaccaagaagggccgggtcttctgcacagcctgtgagaagaccttctatgacaagggcaccctgaagatccactacaatgctgtgcacctgaagatcaagcacaagtgcaccatcgagggctgcaacatggtgttcagcagcctgcggagcaggaacagacacagcgccaaccccaacccccggctgcacatgcccatgaacagaaacaacagagacaaggacctgaggaacagcctgaacctggccagcagcgagaactacaagtgccccggcttcaccgtgaccagcccagactgccggcccccacccagctacccaggcagcggggaggacagcaagggccagcctgccttccccaacatcggccagaatggagtgctcttccccaacctgaagacagtgcagcctgtgctgcccttctaccgcagccctgccaccccagctgaggtggccaacaccccaggcatcctgcccagcctgcccctgctgagcagcagcatccctgagcagctgatcagcaatgagatgccctttgatgccctgcccaagaagaagagcaggaagagctccatgcccatcaagattgagaaggaggccgtggagatcgccaatgagaagaggcacaacctgagcagtgatgaggacatgcccctgcaggtggtgtctgaagatgagcaggaggcctgcagcccccagagccaccgggtgtctgaggagcagcacgtgcagagcggcggcctgggcaagcccttccctgagggggagcggccctgccaccgggagagcgtgattgagagcagcggggccatcagccagaccccagagcaggccacccacaacagcgagcgggagacagagcagaccccagccctgatcatggtgccccgggaggtggaggatggcggccacgagcactacttcaccccaggcatggagccccaggtgcccttcagtgactacatggagctgcagcagaggctgctggccggcggcctcttcagcgccctgagcaacagaggcatggccttcccctgcctggaggacagcaaggagctggagcacgtgggccagcacgccctggcccggcagattgaagaaaatcgcttccagtgtgacatctgcaagaagaccttcaagaatgcctgcagcgtgaagatccaccacaagaacatgcacgtgaaggagatgcacacctgcaccgtggagggctgcaatgccaccttccccagccgccgcagccgggacagacacagcagcaacctgaacctgcaccagaaggccctgagccaggaggccctggagagcagcgaggaccacttccgggccgcctacctgctgaaggatgtggccaaggaggcctaccaggatgtggccttcacccagcaggccagccagaccagcgtcatcttcaagggcaccagcaggatgggcagcctggtgtaccccatcacccaggtgcacagcgccagcctggagagctacaacagcggccccctgtctgagggcaccatcctggacctgagcaccaccagctccatgaagtctgagagcagcagccacagctcctgggacagtgatggagtgtctgaggagggcaccgtgctgatggaggacagtgatggcaactgtgagggcagcagcctggtgcctggagaagatgagtaccccatctgtgtgctgatggagaaggctgaccagagcctggccagcctgcccagcggcctgcccatcacctgccacctgtgccagaagacctacagcaacaagggcaccttccgggcccactacaagacagtgcacctgcggcagctgcacaagtgcaaggtgcccggctgcaacaccatgttcagctctgtgcgcagcaggaacagacacagccagaaccccaacctgcacaagagcctggccagcagccccagccacctgcagtag

SEQ ID NO: 144831 - DNA, 2964 bp, Artificial Sequence
  Description of Artificial Sequence: Synthetic coding sequence
atgcgctgcaggaacatgttcttctccttcaaggccagcctgtgtggctgtggggccgccacagcccccagcctgacagccatcagctgcaccctgaactgcagctgccagagcttcaagccaggcaagatcaaccaccggcagtgtgaccagtgcaagcacggctgggtggcccacgccctgagcaagctgcgcatcccccccatgtaccccaccagccaggtggagatcgtgcagagcaatgtggtgtttgacatcagcagcctgatgctgtatggcacccaggccatccctgtgcggctgaagatcctgctggacaggctcttctctgtgctgaagcaggatgaggtgctgcagatcctgcacgccctggactggaccctgcaggactacatccggggctacgtgctgcaggatgccagcggcaaggtgctggaccactggagcatcatgaccagcgaggaggaggtggccaccctgcagcagttcctgcgctttggagagaccaagagcatcgtggagctgatggccatccaggagaaggaggagcagagcatcatcatcccccccagcacagccaacgtggacatccgggccttcatcgagagctgcagccacaggagcagcagcctgcccacccctgtggacaagggcaaccccagcagcatccacccctttgaaaatctcatcagcaacatgaccttcatgctgcccttccagttcttcaaccccctgcccccagccctgattggcagcctgcctgagcagtacatgctggagcagggccatgaccagagccaggaccccaagcaggaggtgcacggccccttcccagacagcagcttcctgaccagcagcagcacccccttccaggtggagaaggaccagtgcctgaactgcccagatgccatcaccaagaaggaggacagcacccacctgagtgacagcagcagctacaacatcgtgaccaagtttgagaggacccagctgagccctgaggccaaggtgaagccagagaggaacagcctgggcaccaagaagggccgggtcttctgcacagcctgtgagaagaccttctatgacaagggcaccctgaagatccactacaatgctgtgcacctgaagatcaagcacaagtgcaccatcgagggctgcaacatggtgttcagcagcctgcggagcaggaacagacattctgccaaccccaacccccggctgcacatgcccatgaacagaaacaacagagacaaggacctgaggaacagcctgaacctggccagcagcgagaactacaagtgccccggcttcaccgtgaccagcccagactgccggcccccacccagctacccaggcagcggggaggacagcaagggccagcctgccttccccaacatcggccagaatggagtgctcttccccaacctgaagacagtgcagcctgtgctgcccttctaccgcagccctgccaccccagctgaggtggccaacaccccaggcatcctgcccagcctgcccctgctgagcagcagcatccctgagcagctgatcagcaatgagatgccctttgatgccctgcccaagaagaagagcaggaagagctccatgcccatcaagattgagaaggaggccgtggagatcgccaatgagaagaggcacaacctgagcagtgatgaggacatgcccctgcaggtggtgtctgaagatgagcaggaggcctgcagcccccagagccaccgggtgtctgaggagcagcacgtgcagagcggcggcctgggcaagcccttccctgagggggagcggccctgccaccgggagagcgtcatcgagagcagcggggccatcagccagaccccagagcaggccacccacaacagcgagcgggagacagagcagaccccagccctgatcatggtgccccgggaggtggaggatggcggccacgagcactacttcaccccaggcatggagccccaggtgcccttcagtgactacatggagctgcagcagaggctgctggccggcggcctcttcagcgccctgagcaacagaggcatggccttcccctgcctggaggacagcaaggagctggagcacgtgggccagcacgccctggcccggcagatcgaggagaaccgcttccagtgtgacatctgcaagaagaccttcaagaatgcctgcagcgtgaagatccaccacaagaacatgcacgtgaaggagatgcacacctgcaccgtggagggctgcaatgccaccttccccagcagaagaagccgggacagacacagcagcaacctgaacctgcaccagaaggccctgagccaggaggccctggagagcagcgaggaccacttccgggccgcctacctgctgaaggatgtggccaaggaggcctaccaggatgtggccttcacccagcaggccagccagaccagcgtcatcttcaagggcaccagcaggatgggcagcctggtgtaccccatcacccaggtgcacagcgccagcctggagagctacaacagcggccccctgtctgagggcaccatcctggacctgagcaccaccagctccatgaagtctgagagcagcagccacagctcctgggacagtgatggagtgtctgaggagggcaccgtgctgatggaggacagtgatggcaactgtgagggcagcagcctggtgcctggagaagatgagtaccccatctgtgtgctgatggagaaggctgaccagagcctggccagcctgcccagcggcctgcccatcacctgccacctgtgccagaagacctacagcaacaagggcaccttccgggcccactacaagacagtgcacctgcggcagctgcacaagtgcaaggtgcccggctgcaacaccatgttcagctctgtgcgcagcaggaacagacacagccagaaccccaacctgcacaagagcctggccagcagccccagccacctgcagtag

SEQ ID NO: 144832 - DNA, 2712 bp, Artificial Sequence
  Description of Artificial Sequence: Synthetic coding sequence
atggcccacctgggccccaccccaccaccccacagcctgaactacaagtctgaggaccggctgtctgagcaggactggccagcctacttcaaggtgccctgctgcggcgtggacaccagccagatcgagagcgaggaggccgaggtggatgtgcgggagcgggagacccagagggaccgggagcccaagagggcccgggacctgaccctgcgggacagctgcacagacaacagcatgcagtttggcaccaggaccaccacagctgagcccggcttcatgggcacctggcagaatgctgacaccaacctgctcttcaggatgagccagcaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgcccccaaatggcctgctgctggagcagcccggcctgcggctgcgggagcccagcctgagcacccagaatgagtacaatgaatcttctgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacacagcgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttttctggcctgaagacagtgcagcctgtgccccccttctaccgcagcctgctgaccccaggagagatggtgtccccacccaccagcctgcccaccagccccatcatccccaccagcggcaccatcgagcagcaccccccacctccttctgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggcggcgctgtggtgaatgacatgagccatgacaaccactgccacagccaggaggagatgagccctggcatgtctgtgaaggacttcagcaagcacaacagaacccgctgcatcagcaggacagagatccggcgggctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggacgtcatcaaggtgaaggaggagttcacagaccccacctatgacatgttctacatgagccagtatggcctgtacaatggaggaggagcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagcagaagaagccgggaccgctactgggagaagagcaatgagcagaatggcctgctggtgtcctggggcgagaccctgagcagcctgaagtag

SEQ ID NO: 144833 - DNA, 3099 bp, Artificial Sequence
  Description of Artificial Sequence: Synthetic coding sequence
atggcccacctgggccccaccccaccaccccacagcctgaactacaagtctgaggaccggctgtctgagcaggactggccagcctacttcaaggtgccctgctgcggcgtggacaccagccagatcgaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgccccccaacggcctgctgctggagcagcccggcctgcggctgcgggagcccagcctgagcacccagaatgagtacaatgaaagcagcgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacattctgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttcagcggcctgaagacagtgcagcctgtgccccccttctaccgcagcctgctgaccccaggagagatggtgagcccccccaccagcctgcccaccagccccatcatccccaccagcggcaccatcgagcagcaccccccaccacccagcgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggaggagctgtggtgaatgacatgagccatgacaaccactgccacagccaggaggagatgagccctggcatgtctgtgaaggacttcagcaagcacaacagaacccgctgcatcagcaggacagagatcagaagagctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggatgtgatcaaggtgaaggaggagttcacagaccccacctatgacatgttctacatgagccagtatggcctgtacaacggcggcggggcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagccgccgcagccgggacagacattctgccaacatcaacctgcacaggaagctgctgaccaaggagctggatgacatgggcctggacagcagccagcccagcctgagcaaggacctgagagatgagttcctggtgaagatctacggggcccagcaccccatgggcctggatgtgcgggaggatgccagcagccctgctggaacagaggacagccacctgaatggctacggccggggcatggccgaggactacatggtgctggacctgagcaccaccagcagcctgcagagcagcagcagcatccacagcagccgggagagtgatgctggcagtgatgagggcatcctgctggatgacattgatggagccagtgacagcggggagagcgcccacaaggccgaggccccagccctgcccggcagcctgggcgctgaggtgtctggcagcctgatgttcagcagcctgagcggcagcaatggaggcatcatgtgcaacatctgccacaagatgtacagcaacaagggcaccctgcgggtgcactacaagacagtgcacctgcgggagatgcacaagtgcaaggtgcccggctgcaacatgatgttcagctctgtgcgcagcaggaacagacacagccagaaccccaacctgcacaagaacatccccttcacctctgtggactag

SEQ ID NO: 144834 - DNA, 3300 bp, Artificial Sequence
  Description of Artificial Sequence: Synthetic coding sequence
atggcccacctgggccccaccccaccaccccacagcctgaactacaagtctgaggaccggctgtctgagcaggactggccagcctacttcaaggtgccctgctgcggcgtggacaccagccagatcgagagcgaggaggccgaggtggatgtgcgggagcgggagacccagagggaccgggagcccaagagggcccgggacctgaccctgcgggacagctgcacagacaacagcatgcagtttggcaccaggaccaccacagctgagcccggcttcatgggcacctggcagaatgctgacaccaacctgctcttcaggatgagccagcaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgcccccaaatggcctgctgctggagcagcccggcctgcggctgcgggagcccagcctgagcacccagaatgagtacaatgaatcttctgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacacagcgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttttctggcctgaagacagtgcagcctgtgccccccttctaccgcagcctgctgaccccaggagagatggtgtccccacccaccagcctgcccaccagccccatcatccccaccagcggcaccatcgagcagcaccccccacctccttctgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggcggcgctgtggtgaatgacatgagccatgacaaccactgccacagccaggaggagatgagccctggcatgtctgtgaaggacttcagcaagcacaacagaacccgctgcatcagcaggacagagatccggcgggctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggacgtcatcaaggtgaaggaggagttcacagaccccacctatgacatgttctacatgagccagtatggcctgtacaatggaggaggagcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagcagaagaagccgggacagacacagcgccaacatcaacctgcacaggaagctgctgaccaaggagctggatgacatgggcctggacagcagccagcccagcctgagcaaggacctgagagatgagttcctggtgaagatctatggagcccagcaccccatgggcctggatgtgagagaagatgccagcagccctgctggaacagaggacagccacctgaatggctacggccggggcatggccgaggactacatggtgctggacctgagcaccaccagcagcctgcagagcagcagcagcatccacagcagccgggagagtgatgctggcagtgatgagggcatcctgctggatgacattgatggagccagtgacagcggggagagcgcccacaaggccgaggccccagccctgcccggcagcctgggcgctgaggtgtctggcagcctgatgttcagcagcctgagcggcagcaatggaggcatcatgtgcaacatctgccacaagatgtacagcaacaagggcaccctgcgggtgcactacaagacagtgcacctgcgggagatgcacaagtgcaaggtgcccggctgcaacatgatgttcagctctgtgcgcagcaggaacagacacagccagaaccccaacctgcacaagaacatccccttcacctctgtggactag

SEQ ID NO: 144835 - DNA, 984 bp, Artificial Sequence
  Description of Artificial Sequence: Synthetic coding sequence
cccagcgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggaggagctgtggtgaatgacatgagccatgacaaccactgccacagccaggaggagatgagccctggcatgtctgtgaaggacttcagcaagcacaacagaacccgctgcatcagcaggacagagatcagaagagctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggatgtgatcaaggtgaaggaggagttcacagaccccacctatgacatgttctacatgagccagtatggcctgtacaacggcggcggggcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagccgccgcagccgggacaggaacagaaacctgaggatggagaggaccatcggccctggccaccgggacagcctgcacctgcggcggggcaacagcaacagacctggcacctgctgcctgcacactggagacagcctggaggagagcgtgattgtgcgcatcagctgcaagaggctggagagctag

SEQ ID NO: 144836 - DNA, 2583 bp, Artificial Sequence
  Description of Artificial Sequence: Synthetic coding sequence
tctgaggaggccgaggtggatgtgcgggagcgggagacccagagggaccgggagcccaagagggcccgggacctgaccctgcgggacagctgcacagacaacagcatgcagtttggcaccaggaccaccacagctgagcccggcttcatgggcacctggcagaatgctgacaccaacctgctcttcaggatgagccagcaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgccccccaacggcctgctgctggagcagcccggcctgcggctgcgggagcccagcctgagcacccagaatgagtacaatgaaagcagcgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacattctgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttcagcggcctgaagacagtgcagcctgtgccccccttctaccgcagcctgctgaccccaggagagatggtgagcccccccaccagcctgcccaccagccccatcatccccaccagcggcaccatcgagcagcaccccccaccacccagcgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggaggagctgtggtgaatgacatgagccatgacaaccactgccacagccaggaggagatgagccctggcatgtctgtgaaggacttcagcaagcacaacagaacccgctgcatcagcaggacagagatcagaagagctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggatgtgatcaaggtgaaggaggagttcacagaccccacctatgacatgttctacatgagccagtatggcctgtacaacggcggcggggcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagccgccgcagccgggacaggaacagaaacctgaggatggagaggaccatcggccctggccaccgggacagcctgcacctgctgcccacctag

SEQ ID NO: 144837 - DNA, 1206 bp, Artificial Sequence
  Description of Artificial Sequence: Synthetic coding sequence
atggcccacctgggccccaccccaccaccccacagcctgaactacaagtctgaggaccggctgtctgagcaggactggccagcctacttcaaggtgccctgctgcggcgtggacaccagccagatcgagagcgaggaggccgaggtggatgtgcgggagcgggagacccagagggaccgggagcccaagagggcccgggacctgaccctgcgggacagctgcacagacaacagcatgcagtttggcaccaggaccaccacagctgagcccggcttcatgggcacctggcagaatgctgacaccaacctgctcttcaggatgagccagcaggtgcccctggcctgcaccggccgggtgctgggcgctgacttctgccccaacctggaggagccctaccaccggctggaggtgcaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgcccccaaatggcctgctgctggagcagcccggcctgcggctgcgggagcccagcctgagcacccagaatgagtacaatgaatcttctgagagcgaggtgagcccctag

SEQ ID NO: 144838 - DNA, 306 bp, Artificial Sequence
  Description of Artificial Sequence: Synthetic coding sequence
atgtgccgcctgctggtgcccctggcctgcaccggccgggtgctgggcgctgacttctgccccaacctggaggagccctaccaccggctggaggtgcaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggatag

SEQ ID NO: 144839 - DNA, 1233 bp, Artificial Sequence
  Description of Artificial Sequence: Synthetic coding sequence
atggcccacctgggccccaccccaccaccccacagcctgaactacaagtctgaggaccggctgtctgagcaggactggccagcctacttcaaggtgccctgctgcggcgtggacaccagccagatcgagagcgaggaggccgaggtggatgtgcgggagcgggagacccagagggaccgggagcccaagagggcccgggacctgaccctgcgggacagctgcacagacaacagcatgcagtttggcaccaggaccaccacagctgagcccggcttcatgggcacctggcagaatgctgacaccaacctgctcttcaggatgagccagcaggccggcctgaagctgctgaccagcggggacccccctgtgctggacttccagagcgctggcatcaccggggtgagccactgcacccggctgaaggtggccatgatcagcaaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgccccccaacggcctgctgctggagcagcccggcctgcggctgcgggagcccagcctgagcacccagaatgagtacaatgaaagcagcgagagcgaggtgagcccctag

SEQ ID NO: 144840 - DNA, 2712 bp, Artificial Sequence; identical to SEQ ID NO: 144832
  Description of Artificial Sequence: Synthetic coding sequence

SEQ ID NO: 144841 - DNA, 2712 bp, Artificial Sequence
  Description of Artificial Sequence: Synthetic coding sequence
atggcccacctgggccccaccccaccaccccacagcctgaactacaagtctgaggaccggctgtctgagcaggactggccagcctacttcaaggtgccctgctgcggcgtggacaccagccagatcgagagcgaggaggccgaggtggatgtgcgggagcgggagacccagagggaccgggagcccaagagggcccgggacctgaccctgcgggacagctgcacagacaacagcatgcagtttggcaccaggaccaccacagctgagcccggcttcatgggcacctggcagaatgctgacaccaacctgctcttcaggatgagccagcaggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgcccccaaatggcctgctgctggagcagcccggcctgcggctgcgggagcccagcctgagcacccagaatgagtacaatgaatcttctgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacacagcgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttttctggcctgaagacagtgcagcctgtgccccccttctaccgcagcctgctgaccccaggagagatggtgtccccacccaccagcctgcccaccagccccatcatccccaccagcggcaccatcgagcagcaccccccacctccttctgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggcggcgctgtggtgaatgacatgagccatgacaaccactgccacagccaggaggagatgagccctggcatgtctgtgaaggacttcagcaagcacaacagaacccgctgcatcagcaggacagagatccggcgggctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggacgtcatcaaggtgaaggaggagttcacagaccccacctatgacatgttctacatgagccagtatggcctgtacaatggaggaggagcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagcagaagaagccgggacaggaacagaaacctgaggatggagaggaccatcggccctggccaccgggacagcctgcacctgcggagcacctag

SEQ ID NO: 144842 - DNA, 1950 bp, Artificial Sequence
  Description of Artificial Sequence: Synthetic coding sequence
atgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgcccccaaatggcctgctgctggagcagcccggcctgcggctgcgggagcccagcctgagcacccagaatgagtacaatgaatcttctgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacacagcgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttttctggcctgaagacagtgcagcctgtgccccccttctaccgcagcctgctgaccccaggagagatggtgtccccacccaccagcctgcccaccagccccatcatccccaccagcggcaccatcgagcagcaccccccacctccttctgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggcggcgctgtggtgaatgacatgagccatgacaaccactgccacagccaggaggagatgagccctggcatgtctgtgaaggacttcagcaagcacaacagaacccgctgcatcagcaggacagagatccggcgggctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggacgtcatcaaggtgaaggaggagttcacagaccccacctatgacatgttctacatgagccagtatggcctgtacaatggaggaggagcctccatggccgccctgcacgagagcttcaccagcagcctgaactacggcagcccccaggtgctgcccaggaggtag

SEQ ID NO: 144843 - DNA, 3015 bp, Artificial Sequence
  Description of Artificial Sequence: Synthetic coding sequence
atgacagatgatgtgaaggagcccagccgcttcagcctgctgctggccatccgctgcaccctggtgaactgcacctgtgagtgcttccagcccgggaagatcaacctgcggacctgtgaccagtgcaagcacggctgggtggcccacgccctggacaagctgagcacccagcacctgtaccaccccacccaggtggagatcgtgcagagcaatgtggtgtttgacatcagcagcctgatgctgtatggcacccaggccgtgcctgtgcggctgaagatcctgctggacaggctcttctctgtgctgaagcaggaggaggtgctgcacatcctgcacggcctgggctggaccctgcgggactatgtgcggggctacatcctgcaggatgctgctgggaaggtgctggaccgctgggccatcatgagccgggaggaggagatcatcaccctgcagcagttcctgcgctttggagagaccaagagcatcgtggagctgatggccatccaggagaaggagggccaggccgtggccgtgcccagcagcaagacagacagcgacatccgcaccttcatcgagagcaacaacagaaccaggagccccagcctgctggcccacctggagaacagcaaccccagcagcatccaccactttgagaacatccccaacagcctggccttcctgctgcccttccagtacatcaaccctgtgtctgcccccctgctgggcctgccccccaacggcctgctgctggagcagcccggcctgcggctgcgggagcccagcctgagcacccagaatgagtacaatgaaagcagcgagagcgaggtgagccccaccccctacaagaatgaccagacccccaacagaaatgccctgaccagcatcaccaacgtggagcccaagacagagcccgcctgtgtgagccccatccagaacagcgcccctgtgtctgacctgaccaagacagagcaccccaagagcagcttccgcatccacaggatgaggaggatgggcagcgccagcaggaagggccgggtcttctgcaatgcctgtgggaagaccttctatgacaagggcaccctgaagatccactacaatgctgtgcacctgaagatcaagcaccgctgcaccatcgagggctgcaacatggtgttcagcagcctgcggagcaggaacagacattctgccaaccccaacccccggctgcacatgcccatgctgaggaacaacagagacaaggacctgatccgggccaccagcggggccgccacccctgtgattgccagcaccaagagcaacctggccctgaccagccctggccggccccccatgggcttcaccaccccacccctggaccctgtgctgcagaaccccctgcccagccagctggtgttcagcggcctgaagacagtgcagcctgtgccccccttctaccgcagcctgctgaccccaggagagatggtgagcccccccaccagcctgcccaccagccccatcatccccaccagcggcaccatcgagcagcaccccccaccacccagcgagcctgtggtgcctgctgtgatgatggccacccatgagcccagcgctgacctggcccccaagaagaagcccaggaagagctccatgcctgtgaagattgagaaggagatcatcgacacagcagatgaatttgatgatgaagatgatgaccccaatgatggaggagctgtggtgaatgacatgagccatgacaaccactgccacagccaggaggagatgagccctggcatgtctgtgaaggacttcagcaagcacaacagaacccgctgcatcagcaggacagagatcagaagagctgacagcatgaccagcgaggaccaggagcctgagcgggactatgaaaatgaaagtgagagcagcgagcccaagctgggggaggagagcatggagggagatgagcacatccacagcgaggtgtctgagaaggtgctgatgaacagcgagaggccagatgagaaccacagcgagcccagccaccaggatgtgatcaaggtgaaggaggagttcacagaccccacctatgacatgttctacatgagccagtatggcctgtacaacggcggcggggcctccatggccgccctgcacgagagcttcaccagcagcctgaactacggcagcccccagaagttcagccctgagggggacctgtgcagcagcccagaccccaagatctgctacgtgtgcaagaagagcttcaagagcagctacagcgtgaagctgcactacagaaatgtgcacctgaaggagatgcacgtgtgcaccgtggccggctgcaatgctgccttccccagccgccgcagccgggacagacattctgccaacatcaacctgcacaggaagctgctgaccaaggagctggatgacatgggcctggacagcagccagcccagcctgagcaaggacctgagagatgagttcctggtgaagatctacggggcccagcaccccatgggcctggatgtgcgggaggatgccagcagccctgctggaacagaggacagccacctgaatggctacggccggggcatggccgaggactacatggtgctggacctgagcaccaccagcagcctgcagagcagcagcagcatccacagcagccgggagagtgatgctggcagtgatgagggcatcctgctggatgacattgatggagccagtgacagcggggagagcgcccacaaggccgaggccccagccctgcccggcagcctgggcgctgaggtgtctggcagcctgatgttcagcagcctgagcggcagcaatggaggcatcatgtgcaacatctgccacaagatgtacagcaacaagggcaccctgcgggtgcactacaagacagtgcacctgcgggagatgcacaagtgcaaggtgcccggctgcaacatgatgttcagctctgtgcgcagcaggaacagacacagccagaaccccaacctgcacaagaacatccccttcacctctgtggactag

SEQ ID NO: 144844 - DNA, 11781 bp, Artificial Sequence
  Description of Artificial Sequence: Synthetic coding sequence
atgggaaatgaggtgtccctggagggcggcgctggagatggccccctgcccccaggaggagctggccctggccctggccctggccctggccctggagctgggaagccacccagcgccccagctgggggcggccagctgcctgctgctggagctgcccggagcacagctgtgccccctgtgcccggccctggccctggccctggccctggccctggccctggcagcaccagccggcggctggaccccaaggagcccctgggcaaccagagagctgccagccccacccccaagcaggccagcgccaccaccccaggccacgagagcccccgggagacccgggcccagggccctgctggccaggaggctgatggccccaggaggaccctgcaggtggacagcaggacccagaggagcggccgcagccccagcgtgtccccagaccggggcagcacccccaccagcccctacagcgtgccccagatcgcccccctgcccagcagcaccctgtgccccatctgcaagaccagtgacctgaccagcacccccagccagcccaacttcaacacctgcacccagtgccacaacaaggtgtgcaaccagtgtggcttcaaccccaacccccacctgacccaggtgaaggagtggctgtgcctgaactgccagatgcagagggccctgggcatggacatgaccacagcccccaggagcaagagccagcagcagctgcacagccctgccctgagccctgcccacagccctgccaagcagcccctgggcaagccagaccaggagaggagccggggccctgggggcccccagcccggcagccggcaggccgagacagcccgggccacctctgtgcccggccctgcccaggccgccgcccctcctgaggtgggccgggtgagcccccagcccccccagcccaccaagcccagcacagctgagcccaggcctcctgctggggaggccccagccaagagcgccacagctgtgcctgctggcctgggcgccacagagcagacccaggagggcctgaccgggaagctgtttggcctgggcgccagcctgctgacccaggccagcaccctgatgtctgtgcagcctgaggccgacacccagggccagcctgcccccagcaagggcacccccaagatcgtgttcaatgatgccagcaaggaggccggccccaagcccctgggcagcggccctggccctggccctgcccctggggccaagacagagcccggggccaggatgggccctggcagcggccctggggccctgcccaagacaggaggcaccaccagccccaagcacggccgggcagagcaccaggccgccagcaaggccgccgccaagcccaagaccatgcccaaggagcgggccatctgccccctgtgccaggccgagctgaatgtgggcagcaagagccctgccaactacaacacctgcaccacctgccgcctgcaggtgtgcaacctgtgtggcttcaaccccaccccccacctggtggagaagacagagtggctgtgcctgaactgccagaccaagaggctgctggagggcagcctgggggagcccacccccctgcccccacccaccagccagcagccccctgtgggcgccccccaccgggccagcggcaccagccccctgaagcagaagggcccccagggcctgggccagcccagcggccccctgcctgccaaggccagccccctgagcaccaaggccagccccctgcccagcaaggccagcccccaggccaagcccctgcgggccagcgagcccagcaagacccccagctctgtgcaggagaagaagaccagggtgcccaccaaggccgagcccatgcccaagcccccacctgagaccacccccaccccagccacccccaaggtgaagtctggagtgcggcgggcagagcccgccacccctgtggtgaaggctgtgcctgaggcccccaagggcggggaggccgaggacctggtgggcaagccctacagccaggatgccagccgcagcccccagagcctgagtgacaccggctacagcagtgatggcatcagcagcagccagagcgagatcaccggggtggtgcagcaggaggtggagcagctggacagcgctggggtgacaggcccccacccccccagccccagcgagatccacaaggtgggcagctccatgaggcccctgctgcaggcccagggcctggcccccagcgagaggagcaagcccctgagcagcggcactggagaggagcagaagcagaggccccacagcctgagcatcaccccagaggcctttgacagtgatgaggagctggaggacatcctggaggaggatgaagattctgctgagtggaggagaagaagagagcagcaggacacagctgagagcagtgatgactttggcagccagctgcggcatgactatgtggaggacagcagcgagggcggcctgagccccctgcccccccagcccccagcccgggctgctgagctgacagatgaggacttcatgaggcggcagatcctggagatgtctgctgaggaggacaacctggaggaggatgacacagccaccagcggccggggcctggccaagcacggcacccagaagggcggcccccggcccaggcctgagcccagccaggagcctgctgccctgcccaagaggcggctgccccacaatgccaccaccggctatgaggagctgctgcctgagggcggcagcgctgaggccacagatggcagcggcaccctgcagggcggcctgcggcgcttcaagaccatcgagctgaacagcacaggcagctatggccacgagctggacctgggccagggccctgaccccagcctggaccgggagcctgagctggagatggagagcctgaccggcagccctgaggacaggagcagaggagagcacagcagcaccctgcctgccagcacccccagctacaccagcggcaccagccccaccagcctgagcagcctggaggaggacagcgacagcagccccagccggcggcagaggctggaggaggccaagcagcagaggaaggcccggcacaggagccacggccccctgctgcccaccatcgaggacagcagcgaggaggaggagctgcgggaggaggaggagctgctgcgggagcaggagaagatgagggaggtggagcagcagaggatccgcagcacagccaggaagacccggcgggacaaggaggagctgcgggcccagaggcggcgggagaggagcaagaccccacccagcaacctgagccccattgaagatgccagccccacagaggagctgcggcaggccgctgagatggaggagctgcacaggagcagctgcagcgagtacagccccagccccagcctggacagcgaggccgaggccctggatggcggccccagccggctgtacaagagcggcagcgagtacaacctgcccaccttcatgagcctgtacagccccacagagaccccatctggcagcagcaccacccccagcagcggccggcccctgaagtctgctgaggaggcctatgaggagatgatgaggaaggccgagctgctgcagaggcagcagggccaggccgccggggcccggggcccccacggcggccccagccagcccaccggcccccggggcctgggcagctttgagtaccaggacaccacagaccgggagtatggccaggccgcccagcctgctgctgagggcaccccagccagcctgggcgctgctgtgtatgaggagatcctgcagaccagccagagcatcgtgaggatgaggcaggccagcagccgggacctggcctttgctgaggacaagaagaaggagaagcagttcctgaatgctgagagcgcctacatggaccccatgaagcagaatggaggccccctgaccccaggcaccagccccacccagctggccgcccctgtgtccttcagcacccccaccagcagtgacagcagcggcggccgggtcatcccagatgtgcgggtgacccagcactttgccaaggagacccaggaccccctgaagctgcacagcagccctgccagccccagcagcgccagcaaggagatcggcatgcccttcagccagggccctggcaccccagccaccacagctgtggccccctgcccagctggcctgccccggggctacatgaccccagccagccctgctggcagcgagaggagccccagccccagcagcacagcccacagctatggccacagccccaccacagccaactacggcagccagacagaggacctgccccaggcccccagcggcctggccgctgctggccgggccgcccgggagaagcccctgagcgccagtgatggagagggcggcaccccccagcccagccgggcctacagctactttgccagcagcagcccccccctgagccccagcagccccagcgagagccccaccttcagccctgggaagatgggcccccgggccacagctgagttcagcacccagacccccagccctgccccagccagtgacatgcccaggagccctggggcccccacccccagccccatggtggcccagggcacccagaccccccaccggcccagcaccccccggctggtgtggcaggagagcagccaggaggcccccttcatggtgatcaccctggccagtgatgccagcagccagaccaggatggtgcacgccagcgccagcaccagccccctgtgcagccccacagagacccagcccaccacccacggctacagccagaccaccccaccttctgtgtcccagctgcccccagagcccccaggccccccaggcttcccccgggtgcccagcgctggagcagatggccccctggccctgtatggctggggcgccctgcctgctgagaacatcagcctgtgccgcatcagctctgtgcccggcaccagccgggtggagcccggccccaggaccccaggcacagctgtggtggacctgaggacagctgtgaagcccacccccatcatcctgacagaccagggcatggacctgaccagcctggccgtggaggccaggaaatatggcctggccctggaccccatccctggccggcagagcacagctgtgcagcccctggtgatcaacctgaatgcccaggagcacaccttcctggccacagccaccaccgtgtccatcaccatggccagctctgtgttcatggcccagcagaagcagcctgtggtgtatggagacccctaccagagccggctggactttggccagggcggcggcagccctgtgtgcctggcccaggtgaagcaggtggagcaggccgtgcagacagccccctaccgcagcggcccccggggccggccccgggaggccaagtttgcccgctacaacctgcccaaccaggtggcccccctggccaggagagatgtgctgatcacccagatgggcacagcccagagcatcggcctgaagccaggccctgtgcctgagcctggagctgagccccaccgggccaccccagctgagctgcggagccacgccctgcccggggccaggaagccccacacagtggtggtgcagatgggagagggcacagctggcaccgtgaccaccctgctgcctgaggagcctgctggggccctggacctgaccggcatgaggcctgagagccagctggcctgctgtgacatggtgtacaagctgcccttcggcagcagctgcaccggcaccttccacccagcccccagcgtgcctgagaagtccatggctgatgctgcccctcctggccagagcagcagccccttctacggcccccgggaccctgagcccccagagccccccacctaccgggcccagggcgtggtgggccctggcccccatgaggagcagaggccctacccccagggcctgcccggccgcctgtacagctccatgtctgacaccaacctggccgaggccggcctgaactaccacgcccagagaattggccagctgttccagggccctggccgggacagcgccatggacctgagcagcctgaagcacagctacagcctgggctttgctgatggccgctacctgggccagggcctgcagtatggctctgtgacagacctgcggcaccccacagacctgctggcccaccccctgcccatgaggcgctacagctctgtgagcaacatctacagcgaccacagatatggccccagaggagatgctgtgggcttccaggaggccagcctggcccagtacagcgccaccacagcccgggagatcagcaggatgtgtgccgccctgaacagcatggaccagtatggaggaagacatggcagcggcggcggcggccctgacctggtgcagtaccagccccagcacggccctggcctgagcgccccccagagcctggtgcccctgcggcccggcctgctgggcaaccccaccttccctgagggccaccccagccctggcaacctggcccagtatggccctgctgctggccagggcacagctgtgcggcagctgctgcccagcacagccaccgtgcgggcagcagatggcatgatctacagcaccatcaacacccccatcgccgccaccctgcccatcaccacccagcctgcctctgtgctgcggcccatggtgcggggcggcatgtaccggccctatgccagcggcggcatcacagctgtgcccctgaccagcctgaccagggtgcccatgattgccccccgggtgcccctgggccccaccggcctgtaccgctacccagcccccagccgcttccccatcgccagctctgtgcccccagctgagggccctgtgtacctgggcaagccagctgctgccaaggcccctggagctgggggccccagcaggcctgagatgcctgtgggcgccgcccgggaggagcccctgcccaccaccaccccagctgccatcaaggaggccgccggggccccagccccagcccccctggccggccagaagcccccagcagatgctgcccctgggggcggcagcggggccctgagccggcccggctttgagaaggaggaggccagccaggaggagcggcagaggaagcagcaggagcagctgctgcagctggagcgggagcgggtggagctggagaagctgcggcagctgcggctgcaggaggagctggagcgggagcgggtggagctgcagaggcaccgggaggaggagcagctgctggtgcagcgggagctgcaggagctgcagaccatcaagcaccacgtgctgcagcagcagcaggaggagcggcaggcccagtttgccctgcagcgggagcagctggcccagcagaggctgcagctggagcagatccagcagctgcagcagcagctgcagcagcagctggaggagcagaagcagaggcagaaggcccccttccctgctgcctgtgaggcccctggccggggcccccccctggccgctgctgagctggcccagaatggccagtactggccacccctgacccacgccgccttcatcgccatggccggccctgagggcctgggccagccccgggagcctgtgctgcaccggggcctgcccagcagcgccagtgacatgagcctgcagacagaggagcagtgggaggccagccgcagcggcatcaagaagaggcacagcatgccccggctgagagatgcctgtgagctggagagcggcacagagccctgtgtggtgagaagaattgctgacagctctgtgcagacagatgatgaagatggagagagccgctacctgctgagcagaagaagaagagccaggagatctgctgactgcagcgtgcagacagatgatgaagattctgctgagtgggagcagcctgtgagaagaagaagaagccggctgcccaggcacagcgacagcggcagtgacagcaagcatgatgccacagccagcagcagcagcgctgctgccaccgtgcgggccatgagctctgtgggcatccagaccatcagtgactgcagcgtgcagacagagccagaccagctgccccgggtgtccccagccatccacatcacagctgccacagaccccaaggtggagatcgtgcgctacatcagcgcccctgagaagacaggccgcggggagagcctggcctgccagacagagccagatggccaggcccagggcgtggccggcccccagctggtgggccccacagccatcagcccctacctgcccggcatccagatcgtgaccccaggccccctgggccgctttgagaagaagaagccagaccccctggagatcggctaccaggcccacctgcccccagagagcctgagccagctggtgtcccggcagccccccaagagcccccaggtgctgtacagccctgtgagccccctgagcccccaccggctgctggacaccagctttgccagcagcgagcggctgaacaaggcccacgtgagcccccagaagcacttcaccgctgacagcgccctgcggcagcagaccctgccccggcccatgaagaccctgcagaggagcctgagtgaccccaagcccctgagccccacagctgaggagagcgccaaggagcgcttcagcctgtaccagcaccagggcggcctgggcagccaggtgtctgccctgccccccaacagcctggtgaggaaggtgaagaggaccctgcccagccccccacctgaggaggcccacctgcccctggccggccaggccagcccccagctgtatgctgccagcctgctgcagaggggcctgaccggccccaccaccgtgcctgccaccaaggccagcctgctgcgggagctggaccgggacctgcggctggtggagcacgagagcaccaagctgaggaagaagcaggccgagctggatgaggaggagaaggagattgatgccaagctgaagtacctggagctgggcatcacccagaggaaggagagcctggccaaggacagaggaggccgggactacccacccctgcggggcctgggggagcaccgggactacctgagtgacagcgagctgaaccagctgcggctgcagggctgcaccaccccagctggccagtttgtggacttccctgccacagctgctgccccagccacccccagcggccccacagccttccagcagccccgcttccagcccccagccccccagtacagcgctggcagcggcggccccacccagaatggcttccctgcccaccaggcccccacctacccaggccccagcacctacccagccccagccttccccccaggggccagctacccagctgagcccggcctgcccaaccagcaggccttccggcccaccggccactacgccggccagacccccatgcccaccacccagagcaccctcttccctgtgcctgctgacagccgggcccccctgcagaagccccggcagaccagcctggccgacctggagcagaaggtgcccaccaactatgaagtcatcgccagccctgtggtgcccatgagcagcgcccccagcgagaccagctacagcggccctgctgtgagcagcggctatgagcagggcaaggtgcctgaggtgccccgggccggggaccggggctctgtgtcccagagccctgcccccacctaccccagcgacagccactacaccagcctggagcagaatgtgcccagaaattatgtgatgattgatgacatcagcgagctgaccaaggacagcaccagcacagccccagacagccagaggctggagcccctgggccctggcagcagcggccggcctgggaaggagcctggagagcccggggtgctggatggccccaccctgccctgctgctacgcccggggggaggaggagagtgaagaagattcctatgacccccggggcaaaggaggccacctgcgctccatggagagcaatggccggcctgccagcacccactactacggggacagcgactacagacatggagcccgggtggagaagtatggccctggccccatgggccccaagcaccccagcaagagcctggccccagctgccatcagcagcaagaggagcaagcacaggaagcagggcatggagcagaagatcagcaagttcagccccatcgaggaggccaaggatgtggagagtgacctggccagctacccacctcctgctgtgagcagcagcctggtgtcccggggcaggaagttccaggatgagatcacctacggcctgaagaagaatgtgtatgagcagcagaagtactacggcatgagcagcagagatgctgtggaggatgaccgcatctatggaggcagcagccgcagccgggcccccagcgcctacagcggggagaagctgagcagccatgacttcagcggctggggcaagggctatgaaagagagcgggaggccgtggagcggctgcagaaggccggccccaagcccagcagcctgtccatggcccacagccgggtgcggccccccatgaggagccaggccagcgaggaggagagccctgtgagccccctgggccggcccaggcctgctgggggccccctgcccccaggaggagacacctgcccccagttctgcagcagccacagcatgccagatgtgcaggagcacgtgaaggatggcccccgggcccacgcctacaagcgggaggagggctacatcctggatgacagccactgtgtggtgtctgattctgaggcctaccacctgggccaggaggagacagactggtttgacaagcccagagatgcccggagtgaccgcttccgccaccacggcggccatgctgtgagcagcagcagccagaagaggggccctgcccggcacagctaccatgactatgatgagcccccagaggagggcctgtggccccatgatgagggcggccctggaagacatgccagcgccaaggagcacagacatggagaccacggccgccacagcggccgccacactggagaggagcccggccggcgggccgccaagccccacgcccgggacctgggcagacatgaggcccggccccacagccagcccagcagcgccccagccatgcccaagaagggccagcccggctaccccagcagcgctgagtacagccagcccagccgggccagcagcgcctaccaccacgccagtgacagcaagaagggcagccggcaggcccacagcggccctgctgccctgcagagcaaggccgagccccaggcccagccccagctgcagggccggcaggccgcccctggcccccagcagagccagagccccagcagccggcagatccccagcggggccgccagccggcagccccagacccagcagcagcagcagggcctgggcctgcagcccccccagcaggccctgacccaggcccggctgcagcagcagagccagcccaccacccggggcagcgccccagctgccagccagcctgctgggaagccccagcccggccccagcacagccaccggcccccagcctgctggcccccccagggctgagcagaccaacggcagcaagggcacagccaaggccccccagcagggccgggccccccaggcccagcctgcccctggccctggccctgctggggtgaaggccggggcccggcctgggggcacccctggggccccagctggccagcccggggctgatggagagagcgtcttcagcaagatcctgcctggaggagctgctgagcaggccggcaagctgacagaggccgtgtctgccttcggcaagaagttcagcagcttctggtag

SEQ ID NO: 144845 - DNA, 702 bp, Artificial Sequence
  Description of Artificial Sequence: Synthetic coding sequence
atggagcccacagcccccagcctgacagaggaggacctgacagaggtgaagaaggatgccctggagaacctgcgggtgtacctgtgtgagaagatcatcgccgagcggcactttgaccacctgcgggccaagaagatcctgagccgggaggacacagaggagatcagctgcaggaccagcagcaggaagagagctgggaagctgctggactacctgcaggagaaccccaagggcctggacaccctggtggagagcatcagaagagagaagacccagaacttcctgatccagaagatcacagatgaggtgctgaagctgaggaacatcaagctggagcacctgaagggcctgaagtgcagcagctgtgagcccttcccagatggagccaccaacaacctgagccgcagcaacagtgatgagagcaacttcagcgagaagctgcgggccagcacagtgatgtaccaccctgagggggagagcagcaccacccccttcttcagcaccaacagcagcctgaacctgcctgtgctggaggtgggccgcacagagaacaccatcttcagcagcaccaccctgcccaggcctggggaccccggggccccacccctgcccccagacctgcagctggaggaggagggcacctgtgccaacagcagcgagatgttcctgcccctgcggagcaggacagtgtcccggcagtag

SEQ ID NO: 144846 - DNA, 702 bp, Artificial Sequence; identical to SEQ ID NO: 144845
  Description of Artificial Sequence: Synthetic coding sequence

SEQ ID NO: 144847 - DNA, 471 bp, Artificial Sequence
  Description of Artificial Sequence: Synthetic coding sequence
atggagcccacagcccccagcctgacagaggaggacctgacagaggtgaagaaggatgccctggagaacctgcgggtgtacctgtgtgagaagatcatcgccgagcggcactttgaccacctgcgggccaagaagatcctgagccgggaggacacagaggagatcagctgcaggaccagcagcaggaagagagctgggaagctgctggactacctgcaggagaaccccaagggcctggacaccctggtggagagcatcagaagagagaagacccagaacttcctgatccagaagatcacagatgaggtgctgaagctgaggaacatcaagctggagcacctgaaggatggagccaccaacaacctgagccgcagcaacagtgatgagagcaacttcagcgagaagctgcgggccagcacagtgatgtaccaccctgagggggagagcagcaccacccccttcttctactag

SEQ ID NO: 144848 - DNA, 2508 bp, Artificial Sequence
  Description of Artificial Sequence: Synthetic coding sequence
atgagcaggaggaagcagggcaagccccagcacctgagcaagcgggagttcagccctgagcccctggaggccatcctgacagatgatgagccagaccacggccccctgggcgcccctgagggggaccatgacctgctgacctgtggccagtgccagatgaacttccccctgggggacatcctgatcttcatcgagcacaagaggaagcagtgcaatggcagcctgtgcctggagaaggctgtggacaagccacccagccccagccccatcgagatgaagaaggccagcaaccctgtggaggtgggcatccaggtgaccccagaagatgatgactgcctgagcaccagcagccggggcatctgccccaagcaggagcacatcgctgacaagctgctgcactggaggggcctgagcagccccaggtctgcccacggggccctgatccccaccccaggcatgtctgcagaatatgccccccagggcatctgcaaggatgagcccagcagctacacctgcaccacctgcaagcagcccttcaccagcgcctggttcctgctgcagcacgcccagaacacccacggcctgcgcatctacctggagagcgagcacggcagccccctgaccccccgggtgggcatccccagcggcctgggcgctgagtgccccagccagccccccctgcacggcatccacatcgctgacaacaaccccttcaacctgctgcgcatccctggctctgtgtcccgggaggccagcggcctggccgagggccgcttcccccccaccccacccctcttcagccccccacccaggcaccacctggacccccacagaattgagcggctgggcgctgaggagatggccctggccacccaccaccccagcgcctttgacagagtgctgcggctgaaccccatggccatggagcccccagccatggacttcagccggcggctgcgggagctggccggcaacaccagcagcccccccctgagccctggccggcccagccccatgcagaggctgctgcagcccttccagcccggcagcaagccacccttcctggccaccccacccctgccccccctgcagagcgcccccccacccagccagccccctgtgaagagcaagagctgtgagttctgtgggaagaccttcaagttccagagcaacctggtggtgcaccggcgcagccacactggagagaagccctacaagtgcaacctgtgtgaccacgcctgcacccaggccagcaagctgaagaggcacatgaagacccacatgcacaagagcagccccatgacagtgaagagtgatgatggcctgagcacagccagcagccctgagcccggcaccagtgacctggtgggcagcgccagcagcgccctgaagtctgtggtggccaagttcaagtcagaaaatgaccccaacctgatcccagaaaatggagatgaggaggaggaggaggatgatgaggaggaggaggaggaggaggaggaggaggaggaggagctgacagagagcgagcgggtggactatggcttcggcctgagcctggaggccgcccggcaccacgagaacagcagcagaggagctgtggtgggcgtgggagatgagagccgggccctgcctgatgtgatgcagggcatggtgctgagctccatgcagcacttcagcgaggccttccaccaggtgctgggggagaagcacaagaggggccacctggccgaggccgagggccaccgggacacctgtgatgaagattctgtggccggggagagtgacagaattgatgatggcaccgtgaatggccggggctgcagccctggagagagcgccagcggcggcctgagcaagaagctgctgctgggcagccccagcagcctgagccccttcagcaagaggatcaagctggagaaggagtttgacctgcccccagctgccatgcccaacacagaaaatgtgtacagccagtggctggccggctacgccgccagccggcagctgaaggaccccttcctgagctttggagacagccggcagagcccctttgccagcagcagcgagcacagcagtgaaaatggcagcctgcgcttcagcaccccacctggagagctggatggcggcatcagcggccgcagcggcaccggcagcggcggcagcaccccccacatcagcggccctggccctggccggcccagcagcaaggagggcagaagaagtgacacctgtgagtactgcggcaaggtgttcaagaactgcagcaacctgactgtgcacagaagaagccacactggagagcggccctacaagtgtgagctgtgcaactatgcctgtgcccagagcagcaagctgaccaggcacatgaagacccacggccaggtgggcaaggatgtgtacaagtgtgagatctgcaagatgcccttctctgtgtacagcaccctggagaagcacatgaagaagtggcacagcgacagagtgctgaacaatgacatcaagacagaatag

SEQ ID NO: 144849 - DNA, 2322 bp, Artificial Sequence
  Description of Artificial Sequence: Synthetic coding sequence
atgagcaggaggaagcagggcaagccccagcacctgagcaagcgggagttcagccctgagcccctggaggccatcctgacagatgatgagccagaccacggccccctgggcgcccctgagggggaccatgacctgctgacctgtggccagtgccagatgaacttccccctgggggacatcctgatcttcatcgagcacaagaggaagcagtgcaatggcagcctgtgcctggagaaggctgtggacaagccacccagccccagccccatcgagatgaagaaggccagcaaccctgtggaggtgggcatccaggtgaccccagaagatgatgactgcctgagcaccagcagccggggcatctgccccaagcaggagcacatcgctgacaagctgctgcactggaggggcctgagcagccccaggtctgcccacggggccctgatccccaccccaggcatgtctgcagaatatgccccccagggcatctgcaaggatgagcccagcagctacacctgcaccacctgcaagcagcccttcaccagcgcctggttcctgctgcagcacgcccagaacacccacggcctgcgcatctacctggagagcgagcacggcagccccctgaccccccgggtgggcatccccagcggcctgggcgctgagtgccccagccagccccccctgcacggcatccacatcgctgacaacaaccccttcaacctgctgcgcatccctggctctgtgtcccgggaggccagcggcctggccgagggccgcttcccccccaccccacccctcttcagccccccacccaggcaccacctggacccccacagaattgagcggctgggcgctgaggagatggccctggccacccaccaccccagcgcctttgacagagtgctgcggctgaaccccatggccatggagcccccagccatggacttcagccggcggctgcgggagctggccggcaacaccagcagcccccccctgagccctggccggcccagccccatgcagaggctgctgcagcccttccagcccggcagcaagccacccttcctggccaccccacccctgccccccctgcagagcgcccccccacccagccagccccctgtgaagagcaagagctgtgagttctgtgggaagaccttcaagttccagagcaacctggtggtgcaccggcgcagccacactggagagaagccctacaagtgcaacctgtgtgaccacgcctgcacccaggccagcaagctgaagaggcacatgaagacccacatgcacaagagcagccccatgacagtgaagagtgatgatggcctgagcacagccagcagccctgagcccggcaccagtgacctggtgggcagcgccagcagcgccctgaagtctgtggtggccaagttcaagtcagaaaatgaccccaacctgatcccagaaaatggagatgaggaggaggaggaggatgatgaggaggaggaggaggaggaggaggaggaggaggaggagctgacagagagcgagcgggtggactatggcttcggcctgagcctggaggccgcccggcaccacgagaacagcagcagaggagctgtggtgggcgtgggagatgagagccgggccctgcctgatgtgatgcagggcatggtgctgagctccatgcagcacttcagcgaggccttccaccaggtgctgggggagaagcacaagaggggccacctggccgaggccgagggccaccgggacacctgtgatgaagattctgtggccggggagagtgacagaattgatgatggcaccgtgaatggccggggctgcagccctggagagagcgccagcggcggcctgagcaagaagctgctgctgggcagccccagcagcctgagccccttcagcaagaggatcaagctggagaaggagtttgacctgcccccagctgccatgcccaacacagaaaatgtgtacagccagtggctggccggctacgccgccagccggcagctgaaggaccccttcctgagctttggagacagccggcagagcccctttgccagcagcagcgagcacagcagtgaaaatggcagcctgcgcttcagcaccccacctggagagctggatggcggcatcagcggccgcagcggcaccggcagcggcggcagcaccccccacatcagcggccctggccctggccggcccagcagcaaggagggcagaagaagtgacacctgcagcagccacacccccatcagaagaagcacccagagggcccaggatgtgtggcagttcagtgatggcagcagccgggccctgaagttctag

SEQ ID NO: 144850 - DNA, 2406 bp, Artificial Sequence
  Description of Artificial Sequence: Synthetic coding sequence
atgagcaggaggaagcagggcaagccccagcacctgagcaagcgggagttcagccctgagcccctggaggccatcctgacagatgatgagccagaccacggccccctgggcgcccctgagggggaccatgacctgctgacctgtggccagtgccagatgaacttccccctgggggacatcctgatcttcatcgagcacaagaggaagcagtgcaatggcagcctgtgcctggagaaggctgtggacaagccacccagccccagccccatcgagatgaagaaggccagcaaccctgtggaggtgggcatccaggtgaccccagaagatgatgactgcctgagcaccagcagccggggcatctgccccaagcaggagcacatcgccggcaaggatgagcccagcagctacacctgcaccacctgcaagcagcccttcaccagcgcctggttcctgctgcagcacgcccagaacacccacggcctgcgcatctacctggagagcgagcacggcagccccctgaccccccgggtgggcatccccagcggcctgggcgctgagtgccccagccagccccccctgcacggcatccacatcgctgacaacaaccccttcaacctgctgcgcatccctggctctgtgtcccgggaggccagcggcctggccgagggccgcttcccccccaccccacccctcttcagccccccacccaggcaccacctggacccccacagaattgagcggctgggcgctgaggagatggccctggccacccaccaccccagcgcctttgacagagtgctgcggctgaaccccatggccatggagcccccagccatggacttcagccggcggctgcgggagctggccggcaacaccagcagcccccccctgagccctggccggcccagccccatgcagaggctgctgcagcccttccagcccggcagcaagccacccttcctggccaccccacccctgccccccctgcagagcgcccccccacccagccagccccctgtgaagagcaagagctgtgagttctgtgggaagaccttcaagttccagagcaacctggtggtgcaccggcgcagccacactggagagaagccctacaagtgcaacctgtgtgaccacgcctgcacccaggccagcaagctgaagaggcacatgaagacccacatgcacaagagcagccccatgacagtgaagagtgatgatggcctgagcacagccagcagccctgagcccggcaccagtgacctggtgggcagcgccagcagcgccctgaagtctgtggtggccaagttcaagtcagaaaatgaccccaacctgatcccagaaaatggagatgaggaggaggaggaggatgatgaggaggaggaggaggaggaggaggaggaggaggaggagctgacagagagcgagcgggtggactatggcttcggcctgagcctggaggccgcccggcaccacgagaacagcagcagaggagctgtggtgggcgtgggagatgagagccgggccctgcctgatgtgatgcagggcatggtgctgagctccatgcagcacttcagcgaggccttccaccaggtgctgggggagaagcacaagaggggccacctggccgaggccgagggccaccgggacacctgtgatgaagattctgtggccggggagagtgacagaattgatgatggcaccgtgaatggccggggctgcagccctggagagagcgccagcggcggcctgagcaagaagctgctgctgggcagccccagcagcctgagccccttcagcaagaggatcaagctggagaaggagtttgacctgcccccagctgccatgcccaacacagaaaatgtgtacagccagtggctggccggctacgccgccagccggcagctgaaggaccccttcctgagctttggagacagccggcagagcccctttgccagcagcagcgagcacagcagtgaaaatggcagcctgcgcttcagcaccccacctggagagctggatggcggcatcagcggccgcagcggcaccggcagcggcggcagcaccccccacatcagcggccctggccctggccggcccagcagcaaggagggcagaagaagtgacacctgtgagtactgcggcaaggtgttcaagaactgcagcaacctgactgtgcacagaagaagccacactggagagcggccctacaagtgtgagctgtgcaactatgcctgtgcccagagcagcaagctgaccaggcacatgaagacccacggccaggtgggcaaggatgtgtacaagtgtgagatctgcaagatgcccttctctgtgtacagcaccctggagaagcacatgaagaagtggcacagcgacagagtgctgaacaatgacatcaagacagaatag

SEQ ID NO: 144851 - DNA, 732 bp, Artificial Sequence
  Description of Artificial Sequence: Synthetic coding sequence
atgagcaggaggaagcagggcaagccccagcacctgagcaagcgggagttcagccctgagcccctggaggccatcctgacagatgatgagccagaccacggccccctgggcgcccctgagggggaccatgacctgctgacctgtggccagtgccagatgaacttccccctgggggacatcctgatcttcatcgagcacaagaggaagcagtgcaatggcagcctgtgcctggagaaggctgtggacaagccacccagccccagccccatcgagatgaagaaggccagcaaccctgtggaggtgggcatccaggtgaccccagaagatgatgactgcctgagcaccagcagccggggcatctgccccaagcaggagcacatcgctgacaagctgctgcactggaggggcctgagcagccccaggtctgcccacggggccctgatccccaccccaggcatgtctgcagaatatgccccccagggcatctgcaaggatgagcccagcagctacacctgcaccacctgcaagcagcccttcaccagcgcctggttcctgctgcagcacgcccagaacacccacggcctgcgcatctacctggagagcgagcacggcagccccctgaccccccgggtgctgcacaccccaccatttggagtggtgccccgggagctgaagatgtgtggcagcttcaggatggaggcccgggagcccctgagcagcgagaagatctag

SEQ ID NO: 144852 - DNA, 2397 bp, Artificial Sequence
  Description of Artificial Sequence: Synthetic coding sequence
atgagcaaaggaacagatgaggacatcttctctggagtgtccttcttcctgacccggctgagccgctgtgagcccagcagaagacctcctccagccccccagcccaccatgagcaggaggaagcagggcaagccccagcacctgagcaagcgggagttcagccctgagcccctggaggccatcctgacagatgatgagccagaccacggccccctgggcgcccctgagggggaccatgacctgctgacctgtggccagtgccagatgaacttccccctgggggacatcctgatcttcatcgagcacaagaggaagcagtgcaatggcagcctgtgcctggagaaggctgtggacaagccacccagccccagccccatcgagatgaagaaggccagcaaccctgtggaggtgggcatccaggtgaccccagaagatgatgactgcctgagcaccagcagccggggcatctgccccaagcaggagcacatcgctgacaagctgctgcactggaggggcctgagcagccccaggtctgcccacggggccctgatccccaccccaggcatgtctgcagaatatgccccccagggcatctgcaaggatgagcccagcagctacacctgcaccacctgcaagcagcccttcaccagcgcctggttcctgctgcagcacgcccagaacacccacggcctgcgcatctacctggagagcgagcacggcagccccctgaccccccgggtgggcatccccagcggcctgggcgctgagtgccccagccagccccccctgcacggcatccacatcgctgacaacaaccccttcaacctgctgcgcatccctggctctgtgtcccgggaggccagcggcctggccgagggccgcttcccccccaccccacccctcttcagccccccacccaggcaccacctggacccccacagaattgagcggctgggcgctgaggagatggccctggccacccaccaccccagcgcctttgacagagtgctgcggctgaaccccatggccatggagcccccagccatggacttcagccggcggctgcgggagctggccggcaacaccagcagcccccccctgagccctggccggcccagccccatgcagaggctgctgcagcccttccagcccggcagcaagccacccttcctggccaccccacccctgccccccctgcagagcgcccccccacccagccagccccctgtgaagagcaagagctgtgagttctgtgggaagaccttcaagttccagagcaacctggtggtgcaccggcgcagccacactggagagaagccctacaagtgcaacctgtgtgaccacgcctgcacccaggccagcaagctgaagaggcacatgaagacccacatgcacaagagcagccccatgacagtgaagagtgatgatggcctgagcacagccagcagccctgagcccggcaccagtgacctggtgggcagcgccagcagcgccctgaagtctgtggtggccaagttcaagtcagaaaatgaccccaacctgatcccagaaaatggagatgaggaggaggaggaggatgatgaggaggaggaggaggaggaggaggaggaggaggaggagctgacagagagcgagcgggtggactatggcttcggcctgagcctggaggccgtggtgggcgtgggagatgagagccgggccctgcctgatgtgatgcagggcatggtgctgagctccatgcagcacttcagcgaggccttccaccaggtgctgggggagaagcacaagaggggccacctggccgaggccgagggccaccgggacacctgtgatgaggacagcgtggccggggagagtgacagaattgatgatggcaccgtgaatggccggggctgcagccctggagagagcgccagcggcggcctgagcaagaagctgctgctgggcagccccagcagcctgagccccttcagcaagaggatcaagctggagaaggagtttgacctgcccccagctgccatgcccaacacagaaaatgtgtacagccagtggctggccggctatgctgccagccggcagctgaaggaccccttcctgagctttggagacagccggcagagcccctttgccagcagcagcgagcacagcagtgaaaatggcagcctgcgcttcagcaccccacctggagagctggatggcggcatcagcggccgctctggaactggaagtggcggcagcaccccccacatcagcggccctggccctggccggcccagcagcaaggagggccgccgcagtgacacctgcagcagccacacccccatccgccgcagcacccagagggcccaggatgtgtggcagttcagtgatggcagcagccgggccctgaagttctag

SEQ ID NO: 144853 - DNA, 1329 bp, Artificial Sequence
  Description of Artificial Sequence: Synthetic coding sequence
atgtctgcagaatatgccccccagggcatctgcaaggatgagcccagcagctacacctgcaccacctgcaagcagcccttcaccagcgcctggttcctgctgcagcacgcccagaacacccacggcctgcgcatctacctggagagcgagcacggcagccccctgacccccaggagcaacctggtggtgcacagaagaagccacactggagagaagccctacaagtgcaacctgtgtgaccacgcctgcacccaggccagcaagctgaagaggcacatgaagacccacatgcacaagagcagccccatgacagtgaagagtgatgatggcctgagcacagccagcagccctgagcccggcaccagtgacctggtgggcagcgccagcagcgccctgaagtctgtggtggccaagttcaagtcagaaaatgaccccaacctgatcccagaaaatggagatgaggaggaggaggaggatgatgaggaggaggaggaggaggaggaggaggaggaggaggagctgacagaaagtgagcgggtggactatggcttcggcctgagcctggaggccgcccggcaccacgagaacagcagcagaggagctgtggtgggcgtgggagatgagagccgggccctgcctgatgtgatgcagggcatggtgctgagctccatgcagcacttcagcgaggccttccaccaggtgctgggggagaagcacaagaggggccacctggccgaggccgagggccaccgggacacctgtgatgaggacagcgtggccggggagagtgacagaattgatgatggcaccgtgaatggccggggctgcagccctggagagagcgccagcggcggcctgagcaagaagctgctgctgggcagccccagcagcctgagccccttcagcaagaggatcaagctggagaaggagtttgacctgcccccagctgccatgcccaacacagaaaatgtgtacagccagtggctggccggctatgctgccagccggcagctgaaggaccccttcctgagctttggagacagccggcagagcccctttgccagcagcagcgagcacagcagtgaaaatggcagcctgcgcttcagcaccccacctggagagctggatggcggcatcagcggccgctctggaactggaagtggcggcagcaccccccacatcagcggccctggccctggccggcccagcagcaaggagggccgccgcagtgacacctgcagcagccacacccccatccgccgcagcacccagagggcccaggatgtgtggcagttcagtgatggcagcagccgggccctgaagttctag

SEQ ID NO: 144854 - DNA, 2382 bp, Artificial Sequence
  Description of Artificial Sequence: Synthetic coding sequence
atgagcaggaggaagcagggcaagccccagcacctgagcaagcgggagttcagccctgagcccctggaggccatcctgacagatgatgagccagaccacggccccctgggcgcccctgagggggaccatgacctgctgacctgtggccagtgccagatgaacttccccctgggggacatcctgatcttcatcgagcacaagaggaagcagtgcaatggcagcctgtgcctggagaaggctgtggacaagccacccagccccagccccatcgagatgaagaaggccagcaaccctgtggaggtgggcatccaggtgaccccagaagatgatgactgcctgagcaccagcagccggggcatctgccccaagcaggagcacatcgccggcaaggatgagcccagcagctacacctgcaccacctgcaagcagcccttcaccagcgcctggttcctgctgcagcacgcccagaacacccacggcctgcgcatctacctggagagcgagcacggcagccccctgaccccccgggtgggcatccccagcggcctgggcgctgagtgccccagccagccccccctgcacggcatccacatcgctgacaacaaccccttcaacctgctgcgcatccctggctctgtgtcccgggaggccagcggcctggccgagggccgcttcccccccaccccacccctcttcagccccccacccaggcaccacctggacccccacagaattgagcggctgggcgctgaggagatggccctggccacccaccaccccagcgcctttgacagagtgctgcggctgaaccccatggccatggagcccccagccatggacttcagccggcggctgcgggagctggccggcaacaccagcagcccccccctgagccctggccggcccagccccatgcagaggctgctgcagcccttccagcccggcagcaagccacccttcctggccaccccacccctgccccccctgcagagcgcccccccacccagccagccccctgtgaagagcaagagctgtgagttctgtgggaagaccttcaagttccagagcaacctggtggtgcaccggcgcagccacactggagagaagccctacaagtgcaacctgtgtgaccacgcctgcacccaggccagcaagctgaagaggcacatgaagacccacatgcacaagagcagccccatgacagtgaagagtgatgatggcctgagcacagccagcagccctgagcccggcaccagtgacctggtgggcagcgccagcagcgccctgaagtctgtggtggccaagttcaagtcagaaaatgaccccaacctgatcccagaaaatggagatgaggaggaggaggaggatgatgaggaggaggaggaggaggaggaggaggaggaggaggagctgacagagagcgagcgggtggactatggcttcggcctgagcctggaggccgcccggcaccacgagaacagcagcagaggagctgtggtgggcgtgggagatgagagccgggccctgcctgatgtgatgcagggcatggtgctgagctccatgcagcacttcagcgaggccttccaccaggtgctgggggagaagcacaagaggggccacctggccgaggccgagggccaccgggacacctgtgatgaagattctgtggccggggagagtgacagaattgatgatggcaccgtgaatggccggggctgcagccctggagagagcgccagcggcggcctgagcaagaagctgctgctgggcagccccagcagcctgagccccttcagcaagaggatcaagctggagaaggagtttgacctgcccccagctgccatgcccaacacagaaaatgtgtacagccagtggctggccggctacgccgccagccggcagctgaaggaccccttcctgagctttggagacagccggcagagcccctttgccagcagcagcgagcacagcagtgaaaatggcagcctgcgcttcagcaccccacctggagagctggatggcggcatcagcggccgcagcggcaccggcagcggcggcagcaccccccacatcagcggccctggccctggccggcccagcagcaaggagggcagaagaagtgacacctgtgagtactgcggcaaggtgttcaagaactgcagcaacctgactgtgcacagaagaagccacactggagagcggccctacaagtgtgagctgtgcaactatgcctgtgcccagagcagcaagctgaccaggcacatgaagacccacggccaggtgctgcacaccccaccatttggagtggtgccccgggagctgaagatgtgtggcagcttcaggatggaggcccgggagcccctgagcagcgagaagatctag

SEQ ID NO: 144855 - DNA, 2472 bp, Artificial Sequence
  Description of Artificial Sequence: Synthetic coding sequence
atgagcaggaggaagcagggcaacccccagcacctgagccagcgggagctgatcaccccagaggccgaccacgtggaggccgccatcctggaggaggatgagggcctggagattgaggagcccagcggcctgggcctgatggtgggcggccctgaccctgacctgctgacctgtggccagtgccagatgaacttccccctgggggacatcctggtgttcatcgagcacaagaggaagcagtgtggcggcagcctgggcgcctgctatgacaaggccctggacaaggacagccccccacccagcagccgctctgagctgaggaaggtgtctgagcctgtggagatcggcatccaggtgaccccagatgaagatgaccacctgctgagccccaccaagggcatctgccccaagcaggagaacattgctgggaaggatgagcccagcagctacatctgcaccacctgcaagcagcccttcaacagcgcctggttcctgctgcagcacgcccagaacacccacggcttccgcatctacctggagcccggccctgccagcagcagcctgaccccccggctgaccatccccccacccctgggccctgaggccgtggcccagagccccctgatgaacttcctgggggacagcaaccccttcaacctgctgaggatgacaggccccatcctgcgggaccaccctggctttggagagggccgcctgcccggcaccccacccctcttcagccccccacccaggcaccacctggacccccaccggctgtctgctgaggagatgggcctggtggcccagcaccccagcgcctttgacagagtgatgaggctgaaccccatggccatcgacagccctgccatggacttcagccggcggctgcgggagctggccggcaacagcagcaccccacctcctgtgtccccaggccggggcaaccccatgcaccggctgctgaaccccttccagcccagccccaagagccccttcctgagcaccccacccctgccccccatgcctcctgggggcaccccaccaccccagcccccagccaagagcaagagctgtgagttctgtgggaagaccttcaagttccagagcaacctgattgtgcacagaagaagccacactggagagaagccctacaagtgccagctgtgtgaccacgcctgcagccaggccagcaagctgaagaggcacatgaagacccacatgcacaaggccggcagcctggccggccgcagtgatgatggcctgtctgctgccagcagccctgagcccggcaccagcgagctggccggggagggcctgaaggccgcagatggagacttccgccaccatgaaagtgaccccagcctgggccacgagcctgaggaggaggatgaggaggaggaggaggaggaggaggagctgctgctggagaatgaaagcaggcctgagagcagcttctccatggattctgagctgagcaggaaccgggagaatggaggcggcggcgtgcctggggtgcctggggccggcggcggggccgccaaggccctggctgatgagaaggccctggtgctgggcaaggtgatggagaatgtgggcctgggcgccctgccccagtatggagagctgctggccgacaagcagaagagaggagccttcctgaagagagctgctggaggaggagatgctggagatgatgatgatgctgggggctgtggagatgctggggccggcggcgctgtgaatggccggggcggcggctttgcccctggaacagagcccttccctggcctcttccccaggaagccagcccccctgcccagccctggcctgaacagcgctgccaagaggatcaaggtggagaaggacctggagctgcccccagctgccctgatccccagtgaaaatgtgtacagccagtggctggtgggctatgctgccagccgccacttcatgaaggaccccttcctgggcttcacagatgcccggcagagcccctttgccaccagcagcgagcacagcagtgaaaatggcagcctgcgcttcagcaccccacctggggacctgctggatggcggcctgagcggccgctctggaacagccagcggcggcagcaccccccacctgggcggccctggccctggccggcccagcagcaaggagggccgccgcagtgacacctgtgagtactgtgggaaggtgttcaagaactgcagcaacctgactgtgcaccggcgcagccacactggagagcggccctacaagtgtgagctgtgcaactatgcctgtgcccagagcagcaagctgaccaggcacatgaagacccacggccagatcggcaaggaggtgtaccgctgtgacatctgccagatgcccttctctgtgtacagcaccctggagaagcacatgaagaagtggcacggggagcacctgctgaccaatgatgtgaagattgagcaggccgagaggagctag

SEQ ID NO: 144856 - DNA, 2685 bp, Artificial Sequence
  Description of Artificial Sequence: Synthetic coding sequence
atgagcaggaggaagcagggcaacccccagcacctgagccagcgggagctgatcaccccagaggccgaccacgtggaggccgccatcctggaggaggatgagggcctggagattgaggagcccagcggcctgggcctgatggtgggcggccctgaccctgacctgctgacctgtggccagtgccagatgaacttccccctgggggacatcctggtgttcatcgagcacaagaggaagcagtgtggcggcagcctgggcgcctgctatgacaaggccctggacaaggacagccccccacccagcagccgctctgagctgaggaaggtgtctgagcctgtggagatcggcatccaggtgaccccagatgaagatgaccacctgctgagccccaccaagggcatctgccccaagcaggagaacattgctggcccctgcaggcctgcccagctgcctgctgtggcccccatcgccgccagcagccacccccacagcagcgtcatcaccagccccctgcgggccctgggcgccctgcccccctgcctgcccctgccctgctgcagcgcccggcctgtgtctggagatggcacccagggcgagggccagacagaggcccccttcggctgccagtgccagctgagcggcaaggatgagcccagcagctacatctgcaccacctgcaagcagcccttcaacagcgcctggttcctgctgcagcacgcccagaacacccacggcttccgcatctacctggagcccggccctgccagcagcagcctgaccccccggctgaccatccccccacccctgggccctgaggccgtggcccagagccccctgatgaacttcctgggggacagcaaccccttcaacctgctgaggatgacaggccccatcctgcgggaccaccctggctttggagagggccgcctgcccggcaccccacccctcttcagccccccacccaggcaccacctggacccccaccggctgtctgctgaggagatgggcctggtggcccagcaccccagcgcctttgacagagtgatgaggctgaaccccatggccatcgacagccctgccatggacttcagccggcggctgcgggagctggccggcaacagcagcaccccacctcctgtgtccccaggccggggcaaccccatgcaccggctgctgaaccccttccagcccagccccaagagccccttcctgagcaccccacccctgccccccatgcctcctgggggcaccccaccaccccagcccccagccaagagcaagagctgtgagttctgtgggaagaccttcaagttccagagcaacctgattgtgcaccggcgcagccacactggagagaagccctacaagtgccagctgtgtgaccacgcctgcagccaggccagcaagctgaagaggcacatgaagacccacatgcacaaggccggcagcctggccggccgcagtgatgatggcctgtctgctgccagcagccctgagcccggcaccagcgagctggccggggagggcctgaaggctgctgatggagacttccgccaccacgagagtgaccccagcctgggccacgagcctgaggaggaggatgaggaggaggaggaggaggaggaggagctgctgctggagaatgaaagcaggcctgagagcagcttctccatggacagcgagctgagcaggaacagagaaaatggaggcggcggcgtgcctggggtgcctggagctgggggcggggccgccaaggccctggctgatgagaaggccctggtgctgggcaaggtgatggagaatgtgggcctgggcgccctgccccagtacggggagctgctggccgacaagcagaagagaggagccttcctgaagagagctgctggaggaggagatgctggagatgatgatgatgctgggggctgtggagatgctggagctggaggagctgtgaatggccggggcggcggctttgcccctggaacagagcccttccctggcctcttccccaggaagccagcccccctgcccagccctggcctgaacagcgctgccaagaggatcaaggtggagaaggacctggagctgcccccagctgccctgatccccagtgaaaatgtgtacagccagtggctggtgggctacgccgccagccgccacttcatgaaggaccccttcctgggcttcacagatgcccggcagagcccctttgccaccagcagcgagcacagcagtgaaaatggcagcctgcgcttcagcaccccacctggggacctgctggatggcggcctgagcggccgcagcggcacagccagcggcggcagcaccccccacctgggcggccctggccctggccggcccagcagcaaggagggcagaagaagtgacacctgtgagtactgcggcaaggtgttcaagaactgcagcaacctgactgtgcacagaagaagccacactggagagcggccctacaagtgtgagctgtgcaactatgcctgtgcccagagcagcaagctgaccaggcacatgaagacccacggccagatcggcaaggaggtgtaccgctgtgacatctgccagatgcccttctctgtgtacagcaccctggagaagcacatgaagaagtggcatggagagcacctgctgaccaatgatgtgaagattgagcaggccgagaggagctag

SEQ ID NO: 144857 - DNA, 1365 bp, Artificial Sequence
  Description of Artificial Sequence: Synthetic coding sequence
atgccccgctgcccagctggggccatggatgagggccctgtggacctgcggacccggcccaaggctgctggcctgcccggggccgccctgcccctgaggaagaggcccctgcgggcccccagccctgagcctgctgcccccagaggagctgctggcctggtggtgcccctggaccccctgcggggcggctgtgacctgcctgctgtgcccggccccccccacggcctggcccggcctgaggccctgtactacccaggggccctgctgcccctgtaccccacccgggccatgggcagccccttccccctggtgaacctgcccacccccctgtaccccatgatgtgccccatggagcaccccctgtctgctgacatcgccatggccaccagggcagatgaagatggagacacccccctgcacatcgctgtggtgcagggcaacctgcctgctgtgcaccggctggtgaacctcttccagcagggcggccgggagctggacatctacaacaacctgcggcagacccccctgcacctggccgtcatcaccaccctgcccagcgtggtgcggctgctggtgacagctggggccagccccatggccctggacagacatggccagacagctgcccacctggcctgtgagcacaggagccccacctgcctgcgggccctgctggacagcgctgcccctggcaccctggacctggaggccaggaactatgatggcctgacagccctgcacgtggccgtgaacacagagtgccaggagaccgtgcagctgctgctggagagaggagctgacattgatgctgtggacatcaagagcggccgcagccccctcatccatgctgtggagaacaacagcctgtccatggtgcagctgctgctgcagcacggggccaacgtgaatgcccagatgtacagcggcagcagcgccctgcacagcgccagcggccggggcctgctgcccctggtgaggaccctggtgcgctctggagctgacagcagcctgaagaactgccacaatgacacccccctgatggtggcccggagccggcgggtgattgacatcctgcggggcaaggccaccaggcctgccagcaccagccagcctgaccccagcccagacagaagtgccaacaccagccctgagagcagcagccggctgagcagcaatggcctgctgagcgccagccccagcagcagccccagccagagccccccccgggaccccccaggcttccccatggccccacccaacttcttcctgcccagccccagccccccagccttcctgccctttgctggggtgctgcggggccctggccggcctgtgccccccagccctgcccctgggggcagctag

SEQ ID NO: 144858 - DNA, 1071 bp, Artificial Sequence
  Description of Artificial Sequence: Synthetic coding sequence
atggaggagggccgggagaggaacagatcctggcccccagctgagtgccagagcctgccccgggtgcggctcttcacccccaccaaggaggagacagcccagagaggagaggtgtttggccagggccacccagcccgggccctgctgcccctgtaccccacccgggccatgggcagccccttccccctggtgaacctgcccacccccctgtaccccatgatgtgccccatggagcaccccctgtctgctgacatcgccatggccaccagggcagatgaagatggagacacccccctgcacatcgctgtggtgcagggcaacctgcctgctgtgcaccggctggtgaacctcttccagcagggcggccgggagctggacatctacaacaacctgcggcagacccccctgcacctggccgtcatcaccaccctgcccagcgtggtgcggctgctggtgacagctggggccagccccatggccctggacagacatggccagacagctgcccacctggcctgtgagcacaggagccccacctgcctgcgggccctgctggacagcgctgcccctggcaccctggacctggaggccaggaactatgatggcctgacagccctgcacgtggccgtgaacacagagtgccaggagaccgtgcagctgctgctggagagaggagctgacattgatgctgtggacatcaagagcggccgcagccccctcatccatgctgtggagaacaacagcctgtccatggtgcagctgctgctgcagcacggggccaacgtgaatgcccagatgtacagcggcagcagcgccctgcacagcgccagcggccggggcctgctgcccctggtgaggaccctggtgcgctctggagctgacagcagcctgaagaactgccacaatgacacccccctgatggtggcccggagccggcgggtgtcccggggcagctgtggccacgccccctgcaccagggtgtctgctggctggctgcaggcctctgtgcctgagaggagaggagtgcgggtgtctgtgcccctgcggggcggggagtgggtgtccctgtag

SEQ ID NO: 144859 - DNA, 1440 bp, Artificial Sequence
  Description of Artificial Sequence: Synthetic coding sequence
atgggcagccctgctgcccctgagggcgccctgggctacgtgcgggagttcaccaggcacagcagtgatgtgctgggcaacctgaatgagctgcggctgcggggcatcctgacagatgtgaccctgctggtgggcggccagcccctgcgggcccacaaggctgtgctgattgcctgcagcggcttcttctacagcatcttccggggccgggccggcgtgggcgtggatgtgctgagcctgcccggcggccctgaggcccggggctttgcccccctgctggacttcatgtacaccagccggctgcggctgagccctgccacagccccagctgtgctggccgccgccacctacctgcagatggagcacgtggtgcaggcctgccaccgcttcatccaggccagctatgagcccctgggcatcagcctgcggcccctggaggccgagccccccaccccacccacagcccctcctcctggcagcccccggcgctctgagggccacccagaccccccaacagagagccgcagctgcagccagggcccccccagccctgccagcccagaccccaaggcctgcaactggaagaagtacaagtacatcgtgctgaacagccaggccagccaggccggcagcctggtgggggagaggagcagcggccagccctgcccccaggcccggctgcccagcggagatgaggccagcagcagcagcagcagcagcagcagcagcagcgaggagggccccatccctggcccccagagccggctgagccccacagctgccaccgtgcagttcaagtgtggggccccagccagcaccccctacctgctgaccagccaggcccaggacaccagcggcagccccagcgagcgggcccggcccctgcccggcagcgagttcttcagctgccagaactgtgaggccgtggccggctgcagcagcggcctggacagcctggtgcctggagatgaggacaagccctacaagtgccagctgtgccgcagcagcttccgctacaagggcaacctggccagccacaggacagtgcacactggagagaagccctaccactgcagcatctgtggggcccgcttcaacagacctgccaacctgaagacccacagccgcatccacagcggggagaagccctacaagtgtgagacctgtggcagcagatttgtgcaggtggcccacctgcgggcccacgtgctgatccacactggagagaagccctacccctgccccacctgtggcacccgcttccgccacctgcagaccctgaagagccacgtgcgcatccacactggagagaagccctaccactgtgacccctgtggcctgcacttccgccacaagagccagctgcggctgcacctgcggcagaagcatggagctgccaccaacaccaaggtgcactaccacatcctgggcggcccctag

SEQ ID NO: 144860 - DNA, 129 bp, Artificial Sequence
  Description of Artificial Sequence: Synthetic coding sequence
atccacactggagagaagccctacccctgccccacctgtggcacccgcttccgccacctgcagaccctgaagagccacgtgcgcatccacactggagagaagccctaccacgagcctgtgaccagctag

SEQ ID NO: 144861 - DNA, 633 bp, Artificial Sequence
  Description of Artificial Sequence: Synthetic coding sequence
atgagcggccgctctgtgcgggcagagaccaggagccgggccaaggatgacatcaagagggtgatggccgccatcgagaaggtgaggaagtgggagaagaagtgggtgacagtgggggacaccagcctgcgcatctacaagtgggtgcctgtgacagagcccaaggtggatgacaagaacaagaacaagaagaagggcaaggatgagaagtgtggcagcgaggtgaccaccccagagaacagcagcagccctggcatgatggacatgcatgatgacaacagcaaccagagcagcattgctgatgccagccccatcaagcaggagaacagcagcaacagcagccctgcccctgagcccaacagcgctgtgcccagtgatggaacagaggccaaggtggatgaggcccaggctgatggcaaggagcaccctggagcagaagatgccagtgatgagcagaacagccagagctccatggagcacagcatgaacagcagcgagaaggtggaccggcagcccagcggggacagcggcctggccgctgagaccagcgccatcagccaggacctggagggcgtgccccccagcaagaagatgaagctggaggccagccagcagaacagcgaggagatgtag

SEQ ID NO: 144862 - DNA, 696 bp, Artificial Sequence
  Description of Artificial Sequence: Synthetic coding sequence
atgagcggccgctctgtgcgggcagagaccaggagccgggccaaggatgacatcaagagggtgatggccgccatcgagaaggtgaggaagtgggagaagaagtgggtgacagtgggggacaccagcctgcgcatctacaagtgggtgcctgtgacagagcccaaggtggatgacaagaacaagaacaagaagaagggcaaggatgagaagtgtggcagcgaggtgaccaccccagagaacagcagcagccctggcatgatggacatgcatgatgacaacagcaaccagagcagcattgctgatgccagccccatcaagcaggagaacagcagcaacagcagccctgcccctgagcccaacagcgctgtgcccagtgatggaacagaggccaaggtggatgaggcccaggctgatggcaaggagcaccctggagcagaagatgccagtgatgagcagaacagccagagctccatggagcacagcatgaacagcagcgagaaggtggaccggcagcccagcggggacagcggcctggccgctgagaccagcgccatcagccaggtgcccaggagccgcagccagaggggcagccagatcggccgggagcccatcggcctgagcggggacctggagggcgtgccccccagcaagaagatgaagctggaggccagccagcagaacagcgaggagatgtag

SEQ ID NO: 144863 - DNA, 528 bp, Artificial Sequence
  Description of Artificial Sequence: Synthetic coding sequence
atggccagcaggaaggccggcacccggggcaaggtggccgccaccaagcaggcccagaggggcagcagcaatgtgttctccatgtttgagcaggcccagatccaggagttcaaggaggccttcagctgcatcgaccagaacagagatggcatcatctgcaaggctgacctgcgggagacctacagccagctgggcaaggtgtctgtgcctgaggaggagctggatgccatgctgcaggagggcaagggccccatcaacttcaccgtcttcctgaccctgtttggagagaagctgaatggaacagatcctgaggaggccatcctgagcgccttcaggatgtttgaccccagcgggaaaggagtggtgaacaaggatgagttcaagcagctgctgctgacccaggccgacaagttcagccctgctgaggtggagcagatgtttgccctgacccccatggacctggccggcaacatcgactacaagagcctgtgctacatcatcacccatggagatgagaaggaggagtag

SEQ ID NO: 144864 - DNA, 438 bp, Artificial Sequence
  Description of Artificial Sequence: Synthetic coding sequence
atgagcggccgctctgtgcgggcagagaccaggagccgggccaaggatgacatcaagaaggtgatggccgccatcgagaaggtgaggaagtgggagaagaagtgggtgacagtgggggacaccagcctgcgcatcttcaagtgggtgcctgtgacagacagcaaggagaaggagaagagcaagagcaacagcagcgctgcccgggagcccaacggcttccccagtgatgccagcgccaacagcagcctgctgctggagttccaggagcccagcctgcccagcagcgaggtggctgatgagccccccaccctgaccaaggaggagcctgtgcccctggagacccaggtggtggaggaggaggaggacagcggggccccacccctgaagcgcttctgtgtggaccagcccaccgtgccccagacagccagcgagagctag

SEQ ID NO: 144865 - DNA, 867 bp, Artificial Sequence
  Description of Artificial Sequence: Synthetic coding sequence
atgaaggacaggacccaggagctgcggagcgccaaggacagtgatgatgaggaggaggtggtgcacgtggaccgggaccacttcatggatgagttctttgagcaggtggaggagatccggggctgcatcgagaagctgtctgaagatgtggagcaggtgaagaagcagcacagcgccatcctggccgcccccaacccagatgagaagaccaagcaggagctggaggacctgacagctgacatcaagaagacagccaacaaggtgcgcagcaagctgaaggccatcgagcagagcattgagcaggaggagggcctgaacagaagcagcgctgacctgcgcatcaggaagacccagcacagcaccctgagcaggaagtttgtggaggtgatgacagagtacaatgccacccagagcaagtacagagaccgctgcaaggaccgcatccagaggcagctggagatcactggaagaaccaccaccaatgaggagctggaggacatgctggagagcggcaagctggccatcttcacagatgacatcaagatggacagccagatgaccaagcaggccctgaatgaaattgagaccaggcacaatgagatcatcaagctggagaccagcatccgggagctgcatgacatgtttgtggacatggccatgctggtggagagccagggcgagatgattgaccgcatcgagtacaacgtggagcacagcgtggactatgtggagagagctgtgtctgacaccaagaaggctgtgaagtaccagagcaaggcccggaggaagaagatcatgatcatcatctgctgcgtggtgctgggcgtggtgctggccagcagcatcggcggcaccctgggcctgtag

SEQ ID NO: 144866 - DNA, 729 bp, Artificial Sequence
  Description of Artificial Sequence: Synthetic coding sequence
atggccggccgcacagtgcgggcagagaccaggagccgggccaaggatgacatcaagaaggtgatggccaccatcgagaaggtgcggcgctgggagaagcgctgggtgacagtgggggacaccagcctgcgcatcttcaagtgggtgcctgtggtggacccccaggaggaggagcggcggcgggccggcggcggcgctgagaggagccggggccgggagcggcggggccgcggggccagcccccggggcggcggccccctcatcctgctggacctgaatgatgagaacagcaaccagagcttccacagcgagggcagcctgcagaagggcacagagcccagccctgggggcaccccccagcccagcaggcctgtgtccccagctggccccccagagggcgtgcctgaggaggcccagcccccccggctgggccaggagcgggaccccggcggcatcacagctggcagcacagatgagccccccatgctgaccaaggaggagcctgtgcctgagctgctggaggccgaggacagcggcgtgaggatgacccggcgggccctgcacgagaagggcctgaagacagagcccctgcggcggctgctgccccggcggggcctgcggaccaacgtgcggcccagctccatggctgtgcctgacacccgggcccctgggggcggcagcaaggccccccgggcccccaggaccatcccccagggcaagggccgctag

SEQ ID NO: 144867 - DNA, 1680 bp, Artificial Sequence
  Description of Artificial Sequence: Synthetic coding sequence
atgcacagcttcatccatgctgccatgggcatggtgatggcctggtgtgccgccgtcatcacccagggccagtacagcttcctggtggtgccctgcaccggcaccaacagctttggcagccctgctgcccagacctgcctgaatgagtaccacctgttcttcctgctgactggagccttcatgggctacagctacagcctgctgtactttgtgaacaacatgaactacctgcccttccccatcatccagcagtacaagttcctgcgcttcagaagaagcctgctgctgctggtgaagcacagctgtgtggagagcctcttcctggtgaggaacttctgcatcctgtactacttcctgggctacatccccaaggcctggatcagcacagccatgaacctgcacattgatgagcaggtgcaccggcccctggacacagtgtctggcctgctgaacctgagcctgctgtaccacgtgtggctgtgtggggtcttcctgctgaccacctggtacgtgtcctggatcctcttcaagatctatgccacagaggcccacgtgtttcctgtgcagcccccatttgctgagggcagtgatgagtgcctgcccaaggtgctgaacagcaaccccccacccatcatcaagtacctggccctgcaggacctgatgctgctgagccagtacagccccagccggcggcaggaggtgttcagcctgagccagcccggcggccacccccacaactggacagccatcagcagagaatgtctgaacctgctgaatggcatgacccagaagctgatcctgtaccaggaggccgccgccaccaacggccgggtgagcagcagctaccctgtggagcccaagaagctgaacagccctgaggagacagccttccagacccccaagagcagccagatgccccggcccagcgtgccccccctggtgaagaccagcctcttcagcagcaagctgagcaccccagatgtggtgagccccttcggcacccccttcggcagctctgtgatgaacaggatggccggcatctttgatgtgaacacctgctacggcagcccccagagcccccagctgatccggcggggcccccggctgtggaccagcgccagtgaccagcagatgacagagttcagcaaccccagccccagcaccagcatctctgctgagggcaagaccatgaggcagcccagcgtcatctacagctggatccagaacaagcgggagcagatcaagaacttcctgagcaagagggtgctgatcatgtacttcttcagcaagcaccctgaggccagcatccaggccgtgttcagtgatgcccagatgcacatctgggccctggagggcctgagccacctggtggccgccagcttcacagaagatcgcttcggcgtggtgcagaccaccctgcctgccatcctgaacaccctgctgaccctgcaggaggccgtggacaagtacttcaagctgccccacgccagcagcaagccaccccgcatcagcggcagcctggtggacaccagctacaagaccctgcgctttgccttccgggccagcctgaagacagccatctaccgcatcaccaccaccttcggggagcacctgaatgctgtgcaggccagcgctgagcaccagaagaggctgcagcagttcctggagttcaaggagtag

SEQ ID NO: 144868 - DNA, 4500 bp, Artificial Sequence
  Description of Artificial Sequence: Synthetic coding sequence
atgaggatcctggccaacaagacccggctgccccaccccaggagaagagaggcccctggcagcccccccctgagcccccggggccactgccccccagccccagccaagcccatgcaccctgagaacaagctgaccaaccacggcaagacaggaaatggaggagcccagagccagcaccagaatgtgaaccagggccccacctgcaatgtgggcagcaaaggagtgggcgccggcaaccacggggccaaggccaaccagatcagccccagcaacagcagcctgaagaacccccaggccggcgtgccccccttcagcagcctgaagggcaaggtgaagagggacagatctgtgtctgtggacagcggggagcagcgggaggccggcacccccagcctggacagcgaggccaaggaggtggcccccaggagcaagagaagatgtgtgctggagaggaagcagccctacagcggagatgagtggtgcagcggccctgacagcgaggaggatgacaagcccatcggggccacccacaactgcaatgtggccgaccctgccatggccgccccccagctgggccctggccagaccacccagctgcccctgtctgagagctctgtgcctggggcccctcatggccccccacctggcctgcggccagatgcccctgggggcggcggcggcggcggcggcgtgcctgggaagccacccagccagtttgtgtatgtgttcaccacccacctggccaacacagctgctgaggccgtgctgcagggccgggctgacagcatcctggcctaccaccagcagaatgtgccccgggccaagctggaccaggcccccaaggtgccccccaccccagagcccctgcccctgagcaccccatctgctggcaccccccagagccagcccccacccctgcccccacctcctcctccagcccctggcagcgcccccccagccctgcccccagagggccccccagaggacagcagccaggacctggcccccaacagcgtgggcgccgccagcactggaggcggcaccggcggcacccaccccaacacccccacagccaccacagccaacaaccccctgcccccaggaggagaccccagcagcgcccctggccctgccctgctgggggaggccgccgcccctggaaatggccagaggagcctggtgggcagcgagggcctgagcaaggagcagctggagcaccgggagaggagcctgcagaccctgcgggacatcgagcggctgctgctgcggagcggggagacagagcccttcctgaagggccccccaggaggagctggggagggcggccccccagcccaggcccctcctccaccccagcagcccccaacagccccacccagcggcctgaagaagtatgaggagcccctgcagagcatgatcagccagacccagagcctgggcggcccccccctggagcacgaggtgcccggccaccccccaggaggagacatgggccagcagatgaacatgatgatccagaggctgggccaggacagcctgaccccagagcaggtggcctggaggaagctgcaggaggagtactatgaggagaagaggaggaaggaggagcagatcggcctgcacggcagccggcccctgcaggacatgatgggcatgggcggcatgatggtgcggggccccccaccaccctaccacagcaagccaggggaccagtggcccccaggcatgggcgcccagctgcggggccccatggatgtgcaggaccccatgcagctgcggggcggcccccccttccctggcccccgcttccctggcaaccagatccagagggtgcccggctttggaggcatgcagagcatgcccatggaggtgcccatgaatgccatgcagaggcctgtgcggcccggcatgggctggacagaggacctgccccccatgggcggccccagcaactttgcccagaacaccatgccctacccaggcggccagggcgaggccgagcgcttcatgaccccccgggtgcgggaggagctgctgcggcaccagctgctggagaagaggtccatgggcatgcagaggcccctgggcatggccggcagcggcatgggccagagcatggagatggagaggatgatgcaggcccaccggcagatggaccctgccatgtttcctggccagatggccggcggggagggcctggccggcacccccatgggcatggagtttggaggcggccggggcctgctgagcccccccatgggccagagcggcctgcgggaggtggacccccccatgggccctggcaacctgaacatgaacatgaatgtgaacatgaacatgaacatgaacctgaatgtgcagatgaccccccagcagcagatgctgatgagccagaagatgaggggccctggggacctgatgggcccccagggcctgagccctgaggagatggcccgggtgcgggcccagaacagcagcggcgtgatgggcggcccccagaagatgctgatgcccagccagttccccaaccagggccagcagggcttcagcggcggccagggcccctaccaggccatgagccaggacatgggcaacacccaggacatgttctccccagaccagagctccatgcccatgagcaatgtgggcaccacccggctgagccacatgcccctgcccccagccagcaaccccccaggcaccgtgcacagcgcccccaacagaggcctgggccggcggcccagcgacctgaccatcagcatcaaccagatgggcagccctggcatgggccacctgaagagccccaccctgagccaggtgcacagccccctggtgaccagccccagcgccaacctgaagagcccccagacccccagccagatggtgcccctgcccagcgccaaccccccaggccccctgaagagcccccaggtgctgggcagcagcctgtctgtgcgcagccccaccggcagccccagccggctgaagagccccagcatggctgtgcccagccctggctgggtggccagccccaagacagccatgcccagccctggggtgtcccagaacaagcagccccccctgaacatgaacagcagcaccaccctgagcaacatggagcagggcaccctgcccccatctggccccaggagcagcagcagcgcccccccagccaacccccccagcggcctgatgaaccccagcctgcccttcaccagcagcccagaccccacccccagccagaaccccctgagcctgatgatgacccagatgagcaaatatgccatgcccagcagcacccccctgtaccacaatgccatcaagaccatcgccaccagtgatgatgagctgctgcctgaccggcccctgctgcccccacctcctccaccccagggcagcggccctggcatcagcaacagccagcccagccagatgcacctgaacagcgctgctgcccagagccccatgggcatgaacctgcccggccagcagcccctgagccatgagcccccaccagccatgctgcccagccccacccccctgggcagcaacatccccctgcaccccaatgcccagggcaccggcggccccccccagaacagcatgatgatggcccctgggggccctgacagcctgaatgccccctgtggccctgtgcccagcagcagccagatgatgcccttccccccccggctgcagcagccccacggggccatggcccccaccggcggcggcggcggcggccctggcctgcagcagcactaccccagcggcatggccctgcccccagaggacctgcccaaccagcccccaggccccatgccaccccagcagcacctgatgggcaaggccatggccggccgcatgggagatgcctacccacctggggtgctgcccggggtggcctctgtgctgaatgaccctgagctgtctgaggtgatccggcccacccccaccggcatccctgagtttgacctgagccgcatcatccccagcgagaagcccagcagcaccctgcagtacttccccaagtctgagaaccagccccccaaggcccagccccccaacctgcacctgatgaacctgcagaacatgatggccgagcagacccccagccggccccccaacctgcccggccagcagggcgtgcagaggggcctgaacatgtccatgtgccaccctggccagatgagcctgctgggccgcactggagtgcccccccagcagggcatggtgccccacggcctgcaccagggcgtgatgagccccccccagggcctgatgacccagcagaacttcatgctgatgaagcagaggggcgtgggcggggaggtgtacagccagcccccccacatgctgagcccccagggcagcctgatgggccccccaccccagcagaacctgatggtgagccaccccctgcggcagaggtctgtgtccctggacagccagatgggctacctgcctgcccctgggggcatggccaacctgcccttctag

SEQ ID NO: 144869 - DNA, 4188 bp, Artificial Sequence
  Description of Artificial Sequence: Synthetic coding sequence
atgaggatcctggccaacaagacccggctgccccaccccaggagaagagaggcccctggcagcccccccctgagcccccggggccactgccccccagccccagccaagcccatgcaccctgagaacaagctgaccaaccacggcaagacaggaaatggaggagcccagagccagcaccagaatgtgaaccagggccccacctgcaatgtgggcagcaaaggagtgggcgccggcaaccacggggccaaggccaaccagatcagccccagcaacagcagcctgaagaacccccaggccggcgtgccccccttcagcagcctgaagggcaaggtgaagagggacagatctgtgtctgtggacagcggggagcagcgggaggccggcacccccagcctggacagcgaggccaaggaggtggcccccaggagcaagagaagatgtgtgctggagaggaagcagccctacagcggagatgagtggtgcagcggccctgacagcgaggaggatgacaagcccatcggggccacccacaactgcaatgtggccgaccctgccatggccgccccccagctgggccctggccagaccacccagctgcccctgtctgagagctctgtgcctggggcccctcatggccccccacctggcctgcggccagatgcccctgggggcggcggcggcggcggcggcgtgcctgggaagccacccagccagtttgtgtatgtgttcaccacccacctggccaacacagctgctgaggccgtgctgcagggccgggctgacagcatcctggcctaccaccagcagaatgtgccccgggccaagctggaccaggcccccaaggtgccccccaccccagagcccctgcccctgagcaccccatctgctggcaccccccagagccagcccccacccctgcccccacctcctcctccagcccctggcagcgcccccccagccctgcccccagagggccccccagaggacagcagccaggacctggcccccaacagcgtgggcgccgccagcactggaggcggcaccggcggcacccaccccaacacccccacagccaccacagccaacaaccccctgcccccaggaggagaccccagcagcgcccctggccctgccctgctgggggaggccgccgcccctggaaatggccagaggagcctggtgggcagcgagggcctgagcaaggagcagctggagcaccgggagaggagcctgcagaccctgcgggacatcgagcggctgctgctgcggagcggggagacagagcccttcctgaagggccccccaggaggagctggggagggcggccccccagcccaggcccctcctccaccccagcagcccccaacagccccacccagcggcctgaagaagtatgaggagcccctgcagagcatgatcagccagacccagagcctgggcggcccccccctggagcacgaggtgcccggccaccccccaggaggagacatgggccagcagatgaacatgatgatccagaggctgggccaggacagcctgaccccagagcaggtggcctggaggaagctgcaggaggagtactatgaggagaagaggaggaaggaggagcagatcggcctgcacggcagccggcccctgcaggacatgatgggcatgggcggcatgatggtgcggggccccccaccaccctaccacagcaagccaggggaccagtggcccccaggcatgggcgcccagctgcggggccccatggatgtgcaggaccccatgcagctgcggggcggcccccccttccctggcccccgcttccctggcaaccagatccagagggtgcccggctttggaggcatgcagagcatgcccatggaggtgcccatgaatgccatgcagaggcctgtgcggcccggcatgggctggacagaggacctgccccccatgggcggccccagcaactttgcccagaacaccatgccctacccaggcggccagggcgaggccgagcgcttcatgaccccccgggtgcgggaggagctgctgcggcaccagctgctggagaagaggtccatgggcatgcagaggcccctgggcatggccggcagcggcatgggccagagcatggagatggagaggatgatgcaggcccaccggcagatggaccctgccatgtttcctggccagatggccggcggggagggcctggccggcacccccatgggcatggagtttggaggcggccggggcctgctgagcccccccatgggccagagcggcctgcgggaggtggacccccccatgggccctggcaacctgaacatgaacatgaatgtgaacatgaacatgaacatgaacctgaatgtgcagatgaccccccagcagcagatgctgatgagccagaagatgaggggccctggggacctgatgggcccccagggcctgagccctgaggagatggcccgggtgcgggcccagaacagcagcggcgtgatgggcggcccccagaagatgctgatgcccagccagttccccaaccagggccagcagggcttcagcggcggccagggcccctaccaggccatgagccaggacatgggcaacacccaggacatgttctccccagaccagagctccatgcccatgagcaatgtgggcaccacccggctgagccacatgcccctgcccccagccagcaaccccccaggcaccgtgcacagcgcccccaacagaggcctgggccggcggcccagcgacctgaccatcagcatcaaccagatgggcagccctggcatgggccacctgaagagccccaccctgagccaggtgcacagccccctggtgaccagccccagcgccaacctgaagagcccccagacccccagccagatggtgcccctgcccagcgccaaccccccaggccccctgaagagcccccaggtgctgggcagcagcctgtctgtgcgcagccccaccggcagccccagccggctgaagagccccagcatggctgtgcccagccctggctgggtggccagccccaagacagccatgcccagccctggggtgtcccagaacaagcagccccccctgaacatgaacagcagcaccaccctgagcaacatggagcagggcaccctgcccccatctggccccaggagcagcagcagcgcccccccagccaacccccccagcggcctgatgaaccccagcctgcccttcaccagcagcccagaccccacccccagccagaaccccctgagcctgatgatgacccagatgagcaaatatgccatgcccagcagcacccccctgtaccacaatgccatcaagaccatcgccaccagtgatgatgagctgctgcctgaccggcccctgctgcccccacctcctccaccccagggcagcggccctggcatcagcaacagccagcccagccagatgcacctgaacagcgctgctgcccagagccccatgggcatgaacctgcccggccagcagcccctgagccatgagcccccaccagccatgctgcccagccccacccccctgggcagcaacatccccctgcaccccaatgcccagggcaccggcggccccccccagaacagcatgatgatggcccctgggggccctgacagcctgaatgccccctgtggccctgtgcccagcagcagccagatgatgcccttccccccccggctgcagcagccccacggggccatggcccccaccggcggcggcggcggcggccctggcctgcagcagcactaccccagcggcatggccctgcccccagaggacctgcccaaccagcccccaggccccatgccaccccagcagcacctgatgggcaaggccatggccggccgcatgggagatgcctacccacctggggtgctgcccggggtggcctctgtgctgaatgaccctgagctgtctgaggtgatccggcccacccccaccggcatccctgagtttgacctgagccgcatcatccccagcgagttcctgcggacccggcccttctccttctgcctgtacctgctgcgcatcctgagcctgctgatgtggctgacccccctgccccccctgcctgctgggggctggccaggcggccaggtgcctgctggagctgtgaacagagccctgcgcttctgtgccggcctgtgtgtgtgctgcatctctgtgttctag

SEQ ID NO: 144870 - DNA, 4365 bp, Artificial Sequence
  Description of Artificial Sequence: Synthetic coding sequence
atgaggatcctggccaacaagacccggctgccccaccccaggagaagagaggcccctggcagcccccccctgagcccccggggccactgccccccagccccagccaagcccatgcaccctgagaacaagctgaccaaccacggcaagacaggaaatggaggagcccagagccagcaccagaatgtgaaccagggccccacctgcaatgtgggcagcaaaggagtgggcgccggcaaccacggggccaaggccaaccagatcagccccagcaacagcagcctgaagaacccccaggccggcgtgccccccttcagcagcctgaagggcaaggtgaagagggacagatctgtgtctgtggacagcggggagcagcgggaggccggcacccccagcctggacagcgaggccaaggaggtggcccccaggagcaagagaagatgtgtgctggagaggaagcagccctacagcggagatgagtggtgcagcggccctgacagcgaggaggatgacaagcccatcggggccacccacaactgcaatgtggccgaccctgccatggccgccccccagctgggccctggccagaccacccagctgcccctgtctgagagctctgtgcctggggcccctcatggccccccacctggcctgcggccagatgcccctgggggcggcggcggcggcggcggcgtgcctgggaagccacccagccagtttgtgtatgtgttcaccacccacctggccaacacagctgctgaggccgtgctgcagggccgggctgacagcatcctggcctaccaccagcagaatgtgccccgggccaagctggaccaggcccccaaggtgccccccaccccagagcccctgcccctgagcaccccatctgctggcaccccccagagccagcccccacccctgcccccacctcctcctccagcccctggcagcgcccccccagccctgcccccagagggccccccagaggacagcagccaggacctggcccccaacagcgtgggcgccgccagcactggaggcggcaccggcggcacccaccccaacacccccacagccaccacagccaacaaccccctgcccccaggaggagaccccagcagcgcccctggccctgccctgctgggggaggccgccgcccctggaaatggccagaggagcctggtgggcagcgagggcctgagcaaggagcagctggagcaccgggagaggagcctgcagaccctgcgggacatcgagcggctgctgctgcggagcggggagacagagcccttcctgaagggccccccaggaggagctggggagggcggccccccagcccaggcccctcctccaccccagcagcccccaacagccccacccagcggcctgaagaagtatgaggagcccctgcagagcatgatcagccagacccagagcctgggcggcccccccctggagcacgaggtgcccggccaccccccaggaggagacatgggccagcagatgaacatgatgatccagaggctgggccaggacagcctgaccccagagcaggtggcctggaggaagctgcaggaggagtactatgaggagaagaggaggaaggaggagcagatcggcctgcacggcagccggcccctgcaggacatgatgggcatgggcggcatgatggtgcggggccccccaccaccctaccacagcaagccaggggaccagtggcccccaggcatgggcgcccagctgcggggccccatggatgtgcaggaccccatgcagctgcggggcggcccccccttccctggcccccgcttccctggcaaccagatccagagggtgcccggctttggaggcatgcagagcatgcccatggaggtgcccatgaatgccatgcagaggcctgtgcggcccggcatgggctggacagaggacctgccccccatgggcggccccagcaactttgcccagaacaccatgccctacccaggcggccagggcgaggccgagcgcttcatgaccccccgggtgcgggaggagctgctgcggcaccagctgctggagaagaggtccatgggcatgcagaggcccctgggcatggccggcagcggcatgggccagagcatggagatggagaggatgatgcaggcccaccggcagatggaccctgccatgtttcctggccagatggccggcggggagggcctggccggcacccccatgggcatggagtttggaggcggccggggcctgctgagcccccccatgggccagagcggcctgcgggaggtggacccccccatgggccctggcaacctgaacatgaacatgaatgtgaacatgaacatgaacatgaacctgaatgtgcagatgaccccccagcagcagatgctgatgagccagaagatgaggggccctggggacctgatgggcccccagggcctgagccctgaggagatggcccgggtgcgggcccagaacagcagcggcgtgatgggcggcccccagaagatgctgatgcccagccagttccccaaccagggccagcagggcttcagcggcggccagggcccctaccaggccatgagccaggacatgggcaacacccaggacatgttctccccagaccagagctccatgcccatgagcaatgtgggcaccacccggctgagccacatgcccctgcccccagccagcaaccccccaggcaccgtgcacagcgcccccaacagaggcctgggccggcggcccagcgacctgaccatcagcatcaaccagatgggcagccctggcatgggccacctgaagagccccaccctgagccaggtgcacagccccctggtgaccagccccagcgccaacctgaagagcccccagacccccagccagatggtgcccctgcccagcgccaaccccccaggccccctgaagagcccccaggtgctgggcagcagcctgtctgtgcgcagccccaccggcagccccagccggctgaagagccccagcatggctgtgcccagccctggctgggtggccagccccaagacagccatgcccagccctggggtgtcccagaacaagcagccccccctgaacatgaacagcagcaccaccctgagcaacatggagcagggcaccctgcccccatctggccccaggagcagcagcagcgcccccccagccaacccccccagcggcctgatgaaccccagcctgcccttcaccagcagcccagaccccacccccagccagaaccccctgagcctgatgatgacccagatgagcaaatatgccatgcccagcagcacccccctgtaccacaatgccatcaagaccatcgccaccagtgatgatgagctgctgcctgaccggcccctgctgcccccacctcctccaccccagggcagcggccctggcatcagcaacagccagcccagccagatgcacctgaacagcgctgctgcccagagccccatgggcatgaacctgcccggccagcagcccctgagccatgagcccccaccagccatgctgcccagccccacccccctgggcagcaacatccccctgcaccccaatgcccagggcaccggcggccccccccagaacagcatgatgatggcccctgggggccctgacagcctgaatgccccctgtggccctgtgcccagcagcagccagatgatgcccttccccccccggctgcagcagccccacggggccatgatggccggccgcatgggagatgcctacccacctggggtgctgcccggggtggcctctgtgctgaatgaccctgagctgtctgaggtgatccggcccacccccaccggcatccctgagtttgacctgagccgcatcatccccagcgagaagcccagcagcaccctgcagtacttccccaagtctgagaaccagccccccaaggcccagccccccaacctgcacctgatgaacctgcagaacatgatggccgagcagacccccagcaggcctcccaacctgcccggccagcagggcgtgcagaggggcctgaacatgtccatgtgccaccctggccagatgagcctgctgggccgcactggagtgcccccccagcagggcatggtgccccacggcctgcaccagggcgtgatgagccccccccagggcctgatgacccagcagaacttcatgctgatgaagcagaggggcgtgggcggggaggtgtacagccagcccccccacatgctgagcccccagggcagcctgatgggccccccaccccagcagaacctgatggtgagccaccccctgcggcagaggtctgtgtccctggacagccagatgggctacctgcctgcccctgggggcatggccaacctgcccttctag

SEQ ID NO: 144871 - DNA, 1401 bp, Artificial Sequence
  Description of Artificial Sequence: Synthetic coding sequence
atgagcaccaggtctgtgagcagcagcagctacagaaggatgtttggaggccctggaacagccagccggcccagcagcagccgctcctatgtgaccaccagcaccaggacctacagcctgggcagcgccctgcggcccagcaccagccgcagcctgtatgccagcagccctggaggagtgtatgccaccaggagcagcgctgtgcggctgcggagctctgtgcctggggtgcggctgctgcaggacagcgtggacttcagcctggctgatgccatcaacacagagttcaagaacaccaggaccaatgagaaggtggagctgcaggagctgaatgacagatttgccaactacatcgacaaggtgcgcttcctggagcagcagaacaagatcctgctggccgagctggagcagctgaagggccagggcaagagccggctgggggacctgtatgaggaggagatgagggagctgcggcggcaggtggaccagctgaccaatgacaaggcccgggtggaggtggagcgggacaacctggccgaggacatcatgaggctgcgggagaagctgcaggaggagatgctgcagcgggaggaggccgagaacaccctgcagagcttccggcaggatgtggacaatgccagcctggcccggctggacctggagaggaaggtggagagcctgcaggaggagatcgccttcctgaagaagctgcacgaggaggagatccaggagctgcaggcccagatccaggagcagcacgtgcagattgatgtggatgtgtccaagccagacctgacagctgccctgagagatgtgcggcagcagtatgagagcgtggccgccaagaacctgcaggaggccgaggagtggtacaagagcaagtttgctgacctgtctgaggccgccaacagaaataatgatgccctgcggcaggccaagcaggagagcacagagtaccgccggcaggtgcagagcctgacctgtgaggtggatgccctgaagggcaccaatgaaagcctggagcggcagatgagggagatggaggagaactttgctgtggaggccgccaactaccaggacaccatcggccgcctgcaggatgagatccagaacatgaaggaggagatggcccggcacctgcgggagtaccaggacctgctgaatgtgaagatggccctggacattgaaattgccacctacaggaagctgctggagggggaggagagccgcatcagcctgcccctgcccaacttcagcagcctgaacctgcgggagaccaacctggacagcctgcccctggtggacacccacagcaagaggaccctgctgatcaagacagtggagaccagagatggccaggtgatcaatgagaccagccagcaccatgatgacctggagtag

SEQ ID NO: 144872 - DNA, 1302 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcgacaacagaagcagccagaggcacagcccccccttcagcaagaccctgcccagcaagcccagctggcccagcgagaaggcccggctgaccagcaccctgcctgccctgacagccctgcagaagccccaggtgccccccaagcccaagggcctgctggaggatgaggccgactatgtggtgcctgtggaggacaatgatgagaactacatccaccccacagagagcagcagccccccacctgagaagggcaggaacagcggggcctgggagaccaagagccccccacctgctgcccccagccccctgcccagggctgggaagaagcccaccacccccctgaagaccacccctgtggccagccagcagaatgccagctctgtgtgtgaggagaagcccatcccagctgagcggcaccggggcagcagccaccggcaggaggccgtgcagagccctgtgttccccccagcccagaagcagatccaccagaagcccatccccctgccccgcttcacagaaggaggcaaccccaccgtggatggccccctgcccagcttcagcagcaacagcaccatcagcgagcaggaggccggcgtgctgtgcaagccctggtacgccggggcctgtgacaggaagtctgctgaggaggccctgcacaggagcaacaaggatggcagcttcctgatcaggaagagcagcggccatgacagcaagcagccctacaccctggtggtgttcttcaacaagagggtgtacaacatccctgtgcgcttcatcgaggccaccaagcagtatgccctgggcaggaagaagaatggagaggagtacttcggctctgtggccgagatcatccggaaccaccagcacagccccctggtgctgattgacagccagaacaacaccaaggacagcacccggctgaagtatgctgtgaaggtgtcctag

SEQ ID NO: 144873 - DNA, 525 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcatcttcctgtgtgacctgctgaagcagcagaacaacatgccctgggccgagaggaagatggtgaagagcaccctggaggtgctgctgaagagcagcggcatcatcaacatcgtgctgtggttcctgctgactgtgcgcatcacccagaagatccccccagactag

SEQ ID NO: 144874 - DNA, 558 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcgacaacagaagcagccagaggcacagcccccccttcagcaagaccctgcccagcaagcccagctggcccagcgagaagtacttcggctctgtggccgagatcatccggaaccaccagcacagccccctggtgctgattgacagccagaacaacaccaaggacagcacccggctgaagtatgctgtgaaggtgtcctag

SEQ ID NO: 144875 - DNA, 204 bp, Artificial Sequence
  Description of Artificial Sequence: Synthetic coding sequence
ctggacagctacagctgcctgctgcagctgcccaacaggatggacaagctgaacaagatcaccgtgcctgccagccagaagctgcggcagctgcagaagatggtgcatgacatcaagaacaatgaaggaggcatcatgaacaagatcaagaagacagccaccatgaagatccagatgagcaccaggacccagcgctgcacctag

SEQ ID NO: 144876 - DNA, 1215 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcgacaacagaagcagccagaggcacagcccccccttcagcaagaccctgcccagcaagcccagctggcccagcgagaaggcccggctgaccagcaccctgcctgccctgacagccctgcagaagccccaggtgccccccaagcccaagggcctgctggaggatgaggccgactatgtggtgcctgtggaggacaatgatgagaactacatccaccccacagagagcagcagccccccacctgagaaggcccccatggtgaacagaagcaccaagcccaacagcagcaccccagccagccccccaggcacagccagcggcagaaattctggggcctgggagaccaagagccccccacctgctgcccccagccccctgccccgggccggcaagaagcccaccacccccctgaagaccacccctgtggccagccagcagaatgccagctctgtgtgtgaggagaagcccatcccagctgagcggcaccggggcagcagccaccggcaggaggccgtgcagagccctgtgtttcctccagcccagaagcagatccaccagaagcccatccccctgccccgcttcacagagggcggcaaccccaccgtggatggccccctgcccagcttcagcagcaacagcaccatcagcgagcaggaggccggcgtgctgtgcaagccctggtacgccggggcctgtgacaggaagtctgctgaggaggccctgcacaggagcaacaagtactttggatctgtggccgagatcatccggaaccaccagcacagccccctggtgctgattgacagccagaacaacaccaaggacagcacccggctgaagtatgctgtgaaggtgtcctag

SEQ ID NO: 144877 - DNA, 1266 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcgacaacagaagcagccagaggcacagcccccccttcagcaagaccctgcccagcaagcccagctggcccagcgagaaggcccggctgaccagcaccctgcctgccctgacagccctgcagaagccccaggtgccccccaagcccaagggcctgctggaggatgaggccgactatgtggtgcctgtggaggacaatgatgagaactacatccaccccacagagagcagcagccccccacctgagaaggcccccatggtgaacagaagcaccaagcccaacagcagcaccccagccagccccccaggcacagccagcggcagaaattctggggcctgggagaccaagagccccccacctgctgcccccagccccctgccccgggccggcaagaagcccaccacccccctgaagaccacccctgtggccagccagcagaatgccagctctgtgtgtgaggagaagcccatcccagctgagcggcaccggggcagcagccaccggcaggaggccgtgcagagccctgtgtttcctccagcccagaagcagatccaccagaagcccatccccctgccccgcttcacagagggcggcaaccccaccgtggatggccccctgcccagcttcagcagcaacagcaccatcagcgagcaggaggccggcgtgctgtgcaagccctggtacgccggggcctgtgacaggaagtctgctgaggaggccctgcacaggagcaacaaggacccccagccccccctgcccagcaagcagtgggagaccaggaagctgcagtacttcggctctgtggccgagatcatccggaaccaccagcacagccccctggtgctgattgacagccagaacaacaccaaggacagcacccggctgaagtatgctgtgaaggtgtcctag

SEQ ID NO: 144878 - DNA, 630 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcgacaacagaagcagccagaggcacagcccccccttcagcaagaccctgcccagcaagcccagctggcccagcgagaaggcccggctgaccagcaccctgcctgccctgacagccctgcagaagccccaggtgccccccaagcccaagggcctgctggaggatgaggccgactatgtggtgcctgtggaggacaatgatgagaactacatccaccccacagagagcagcagccccccacctgagaagggcaagaaccagaggcaccactag

SEQ ID NO: 144879 - DNA, 900 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcggcaggaacagcggggcctgggagaccaagagccccccacctgctgcccccagccccctgcccagggctgggaagaagcccaccacccccctgaagaccacccctgtggccagccagcagaatgccagctctgtgtgtgaggagaagcccatcccagctgagcggcaccggggcagcagccaccggcaggaggccgtgcagagccctgtgttccccccagcccagaagcagatccaccagaagcccatccccctgccccgcttcacagaaggaggcaaccccaccgtggatggccccctgcccagcttcagcagcaacagcaccatcagcgagcaggaggccggcgtgctgtgcaagccctggtacgccggggcctgtgacaggaagtctgctgaggaggccctgcacaggagcaacaagtacttcggctctgtggccgagatcatccggaaccaccagcacagccccctggtgctgattgacagccagaacaacaccaaggacagcacccggctgaagtatgctgtgaaggtgtcctag

SEQ ID NO: 144880 - DNA, 2358 bp, Artificial Sequence
  Description of Artificial Sequence: Synthetic coding sequence
atgctgcctgctgcccctgggaagggcctgggcagcccagaccctgccccctgtggccctgcccctcctggcaacaccaaggacatcatcatgatctatgaagaagatgctgaggagtgggccctgtacctgacagaggtgttcctgcacgtggtgaagcgggaggccatcctgctgtaccgcctggagaacttctccttccgccacctggagctgctgaacctgaccagctacaagtgcaagctgctgatcctgagcaacagcctgctgcgggacctgacccccaagaagtgccagttcctggagaagatcctgcacagccccaagtctgtggtgaccctgctgtgtggggtgaagagcagtgaccagctgtatgagctgctgaacatcagccagagccgctgggagatcagcacagagcaggagcctgaggactacatcagcgtcatccagagcatcatcttcaaggacagcgaggactactttgaggtgaacatccccacagacctgcgggccaagcacagcggggagatcagcgagaggaaggagattgaggagctgtctgaggccagcaggaacaccatccccctggccgtggtgctgcccacagagatcccctgtgagaaccctggagagatcttcatcatcctgagagatgaagtcatcggggacacagtggaggtggagttcaccagcagcaacaagaggatccgcaccaggcctgccctgtggaacaagaaggtgtggtgcatgaaggccctggagttccctgctggctctgtgcacgtgaatgtgtactgtgatggcatcgtgaaggccaccaccaagatcaagtactaccccacagccaaggccaaggaatgtctcttcaggatggctgacagcggggagagcctgtgccagaacagcattgaggagctggatggagtgctgaccagcatcttcaagcatgagatcccctactatgagttccagagcctgcagacagagatctgcagccagaacaagtacacccacttcaaggagctgcccaccctgctgcactgtgccgccaagtttggcctgaagaacctggccatccacctgctgcagtgcagcggggccacctgggccagcaagatgaagaacatggagggcagtgaccctgcccacatcgccgagagacatggccacaaggagctgaagaagatctttgaggacttcagcatccaggagattgacatcaacaatgagcaggagaatgactatgaggaggacatcgccagcttcagcacctacatccccagcacccagaacccagccttccaccacgagagcaggaagacctacggccagagcgcagatggagctgaggccaatgagatggagggggagggcaagcagaatggcagcggcatggagaccaagcacagccccctggaggtgggcagcgagagcagcgaggaccagtatgatgacctgtatgtgttcatccctggagctgaccctgagaacaacagccaggagcccctgatgagcagcaggcctcccctgcccccacccaggcctgtggccaatgccttccagctggagcggccccacttcaccctgcccggcaccatggtggagggccagatggagaggagccagaactggggccaccctggggtgcggcaggagactggagatgagcccaagggggagaaggagaagaaggaggaggagaaggagcaggaggaggaggaggacccctacacctttgctgagattgatgacagtgaatatgacatgatcctggccaacctgagcatcaagaagaagacaggcagccgctccttcatcatcaacagacctccagcccccaccccccggcccaccagcatcccccccaaggaggagaccaccccctacatcgcccaggtgttccagcagaagacagcccggcggcagagtgatgatgacaagttctgtggcctgcccaagaagcaggaccgggccagaattgagagccctgccttcagcaccctgcggggctgcctgacagatggccaggaggagctgatcctgctgcaggagaaggtgaagaatggcaagatgtccatggatgaggccctggagaagttcaagcactggcagatgggcaagagcggcctggagatgatccagcaggagaagctgcggcagctgcgggactgcatcatcggcaagaggcctgaggaggagaatgtgtacaacaagctgaccatcgtgcaccaccctgggggcaaggagacagcccacaatgaaaacaagttctacaacgtgcacttcagcaacaagctgcctgcccggccccaggtggagaaggagtttggcttctgctgcaagaaggaccactag

SEQ ID NO: 144881 - DNA, 1959 bp, Artificial Sequence
  Description of Artificial Sequence: Synthetic coding sequence
atgctgcctgctgcccctgggaagggcctgggcagcccagaccctgccccctgtggccctgcccccccagattctgaggactactttgaggtgaacatccccacagacctgcgggccaagcacagcggggagatcagcgagaggaaggagattgaggagctgtctgaggccagcaggaacaccatccccctggccgtggtgctgcccacagagatcccctgtgaaaatcctggagagatcttcatcatcctgagagatgaggtgattggagacacagtggaggtggagttcaccagcagcaacaagaggatccgcaccaggcctgccctgtggaacaagaaggtgtggtgcatgaaggccctggagttccctgctggctctgtgcacgtgaatgtgtactgtgatggcatcgtgaaggccaccaccaagatcaagtactaccccacagccaaggccaaggagtgcctcttcaggatggctgacagcggggagagcctgtgccagaacagcattgaggagctggatggagtgctgaccagcatcttcaagcatgagatcccctactatgagttccagagcctgcagacagagatctgcagccagaacaagtacacccacttcaaggagctgcccaccctgctgcactgtgccgccaagtttggcctgaagaacctggccatccacctgctgcagtgcagcggggccacctgggccagcaagatgaagaacatggagggcagtgaccctgcccacatcgccgagcggcacggccacaaggagctgaagaagatctttgaggacttcagcatccaggagattgacatcaacaatgagcaggagaatgactatgaagaagatattgccagcttcagcacctacatccccagcacccagaacccagccttccaccacgagagcaggaagacctacggccagagcgcagatggagctgaggccaatgagatggagggggagggcaagcagaatggaagtggcatggagaccaagcacagccccctggaggtgggcagcgagagcagcgaggaccagtatgatgacctgtatgtgttcatccctggagctgaccctgagaacaacagccaggagcccctgatgagcagccggccccccctgcccccacccaggcctgtggccaatgccttccagctggagcggccccacttcaccctgcccggcaccatggtggagggccagatggagaggagccagaactggggccaccctggggtgcggcaggagactggagatgagcccaagggggagaaggagaagaaggaggaggagaaggagcaggaggaggaggaggacccctacacctttgctgagattgatgattctgaatatgacatgatcctggccaacctgagcatcaagaagaagacaggcagccgctccttcatcatcaaccggcccccagcccccaccccccggcccaccagcatcccccccaaggaggagaccaccccctacatcgcccaggtgttccagcagaagacagcccggcggcagagtgatgatgacaagttctgtggcctgcccaagaagcaggaccgggcccgcatcgagagccctgccttcagcaccctgcggggctgcctgacagatggccaggaggagctgatcctgctgcaggagaaggtgaagaatggcaagatgtccatggatgaggccctggagaagttcaagcactggcagatgggcaagagcggcctggagatgatccagcaggagaagctgcggcagctgcgggactgcatcatcggcaagaggcctgaggaggagaatgtgtacaacaagctgaccatcgtgcaccaccctgggggcaaggagacagcccacaatgaaaacaagttctacaacgtgcacttcagcaacaagctgcctgcccggccccaggtggagaaggagtttggcttctgctgcaagaaggaccactag

SEQ ID NO: 144882 - DNA, 2268 bp, Artificial Sequence
  Description of Artificial Sequence: Synthetic coding sequence
atgatctatgaagaagatgctgaggagtgggccctgtacctgacagaggtgttcctgcacgtggtgaagcgggaggccatcctgctgtaccgcctggagaacttctccttccgccacctggagctgctgaacctgaccagctacaagtgcaagctgctgatcctgagcaacagcctgctgcgggacctgacccccaagaagtgccagttcctggagaagatcctgcacagccccaagtctgtggtgaccctgctgtgtggggtgaagagcagtgaccagctgtatgagctgctgaacatcagccagagccgctgggagatcagcacagagcaggagcctgaggactacatcagcgtcatccagagcatcatcttcaaggacagcgaggactactttgaggtgaacatccccacagacctgcgggccaagcacagcggggagatcagcgagaggaaggagattgaggagctgtctgaggccagcaggaacaccatccccctggccgtggtgctgcccacagagatcccctgtgagaaccctggagagatcttcatcatcctgagagatgaagtcatcggggacacagtggaggtggagttcaccagcagcaacaagaggatccgcaccaggcctgccctgtggaacaagaaggtgtggtgcatgaaggccctggagttccctgctggctctgtgcacgtgaatgtgtactgtgatggcatcgtgaaggccaccaccaagatcaagtactaccccacagccaaggccaaggaatgtctcttcaggatggctgacagcggggagagcctgtgccagaacagcattgaggagctggatggagtgctgaccagcatcttcaagcatgagatcccctactatgagttccagagcctgcagacagagatctgcagccagaacaagtacacccacttcaaggagctgcccaccctgctgcactgtgccgccaagtttggcctgaagaacctggccatccacctgctgcagtgcagcggggccacctgggccagcaagatgaagaacatggagggcagtgaccctgcccacatcgccgagagacatggccacaaggagctgaagaagatctttgaggacttcagcatccaggagattgacatcaacaatgagcaggagaatgactatgaggaggacatcgccagcttcagcacctacatccccagcacccagaacccagccttccaccacgagagcaggaagacctacggccagagcgcagatggagctgaggccaatgagatggagggggagggcaagcagaatggcagcggcatggagaccaagcacagccccctggaggtgggcagcgagagcagcgaggaccagtatgatgacctgtatgtgttcatccctggagctgaccctgagaacaacagccaggagcccctgatgagcagcaggcctcccctgcccccacccaggcctgtggccaatgccttccagctggagcggccccacttcaccctgcccggcaccatggtggagggccagatggagaggagccagaactggggccaccctggggtgcggcaggagactggagatgagcccaagggggagaaggagaagaaggaggaggagaaggagcaggaggaggaggaggacccctacacctttgctgagattgatgacagtgaatatgacatgatcctggccaacctgagcatcaagaagaagacaggcagccgctccttcatcatcaacagacctccagcccccaccccccggcccaccagcatcccccccaaggaggagaccaccccctacatcgcccaggtgttccagcagaagacagcccggcggcagagtgatgatgacaagttctgtggcctgcccaagaagcaggaccgggccagaattgagagccctgccttcagcaccctgcggggctgcctgacagatggccaggaggagctgatcctgctgcaggagaaggtgaagaatggcaagatgtccatggatgaggccctggagaagttcaagcactggcagatgggcaagagcggcctggagatgatccagcaggagaagctgcggcagctgcgggactgcatcatcggcaagaggcctgaggaggagaatgtgtacaacaagctgaccatcgtgcaccaccctgggggcaaggagacagcccacaatgaaaacaagttctacaacgtgcacttcagcaacaagctgcctgcccggccccaggtggagaaggagtttggcttctgctgcaagaaggaccactag

SEQ ID NO: 144883 - DNA, 2313 bp, Artificial Sequence
  Description of Artificial Sequence: Synthetic coding sequence
atggtgaactgccacctgaagattggcaacaccaaggacatcatcatgatctatgaggaggatgctgaggagtgggccctgtacctgacagaggtgttcctgcacgtggtgaagcgggaggccatcctgctgtaccgcctggagaacttctccttccgccacctggagctgctgaacctgaccagctacaagtgcaagctgctgatcctgagcaacagcctgctgcgggacctgacccccaagaagtgccagttcctggagaagatcctgcacagccccaagtctgtggtgaccctgctgtgtggggtgaagagcagtgaccagctgtatgagctgctgaacatcagccagagccgctgggagatcagcacagagcaggagcctgaggactacatcagcgtcatccagagcatcatcttcaaggacagcgaggactactttgaggtgaacatccccacagacctgcgggccaagcacagcggggagatcagcgagaggaaggagattgaggagctgtctgaggccagcaggaacaccatccccctggccgtggtgctgcccacagagatcccctgtgaaaatcctggagagatcttcatcatcctgagagatgaggtgattggagacacagtggaggtggagttcaccagcagcaacaagaggatccgcaccaggcctgccctgtggaacaagaaggtgtggtgcatgaaggccctggagttccctgctggctctgtgcacgtgaatgtgtactgtgatggcatcgtgaaggccaccaccaagatcaagtactaccccacagccaaggccaaggagtgcctcttcaggatggctgacagcggggagagcctgtgccagaacagcattgaggagctggatggagtgctgaccagcatcttcaagcatgagatcccctactatgagttccagagcctgcagacagagatctgcagccagaacaagtacacccacttcaaggagctgcccaccctgctgcactgtgccgccaagtttggcctgaagaacctggccatccacctgctgcagtgcagcggggccacctgggccagcaagatgaagaacatggagggcagtgaccctgcccacatcgccgagcggcacggccacaaggagctgaagaagatctttgaggacttcagcatccaggagattgacatcaacaatgagcaggagaatgactatgaagaagatattgccagcttcagcacctacatccccagcacccagaacccagccttccaccacgagagcaggaagacctacggccagagcgcagatggagctgaggccaatgagatggagggggagggcaagcagaatggaagtggcatggagaccaagcacagccccctggaggtgggcagcgagagcagcgaggaccagtatgatgacctgtatgtgttcatccctggagctgaccctgagaacaacagccaggagcccctgatgagcagccggccccccctgcccccacccaggcctgtggccaatgccttccagctggagcggccccacttcaccctgcccggcaccatggtggagggccagatggagaggagccagaactggggccaccctggggtgcggcaggagactggagatgagcccaagggggagaaggagaagaaggaggaggagaaggagcaggaggaggaggaggacccctacacctttgctgagattgatgattctgaatatgacatgatcctggccaacctgagcatcaagaagaagacaggcagccgctccttcatcatcaaccggcccccagcccccaccccccggcccaccagcatcccccccaaggaggagaccaccccctacatcgcccaggtgttccagcagaagacagcccggcggcagagtgatgatgacaagttctgtggcctgcccaagaagcaggaccgggcccgcatcgagagccctgccttcagcaccctgcggggctgcctgacagatggccaggaggagctgatcctgctgcaggagaaggtgaagaatggcaagatgtccatggatgaggccctggagaagttcaagcactggcagatgggcaagagcggcctggagatgatccagcaggagaagctgcggcagctgcgggactgcatcatcggcaagaggcctgaggaggagaatgtgtacaacaagctgaccatcgtgcaccaccctgggggcaaggagacagcccacaatgaaaacaagttctacaacgtgcacttcagcaacaagctgcctgcccggccccaggtggagaaggagtttggcttctgctgcaagaaggaccactag

SEQ ID NO: 144884 - DNA, 1959 bp, Artificial Sequence; identical to SEQ ID NO: 144881
  Description of Artificial Sequence: Synthetic coding sequence

SEQ ID NO: 144885 - DNA, 516 bp, Artificial Sequence
  Description of Artificial Sequence: Synthetic coding sequence
atgcaccccttctacacccgggccgccaccatgattggagaaattgctgctgctgtgtccttcatcagcaagttcctgcggaccaagggcctgaccagcgagcggcagctgcagaccttcagccagagcctgcaggagctgctggccgagcactacaagcaccactggttccctgagaagccctgcaagggcagcggctaccgctgcatccgcatcaaccacaagatggaccccctcatcggccaggccgcccagagaattggcctgagcagccaggagctgttccggctgctgcccagcgagctgaccctgtgggtggacccctatgaggtgtcctacagaattggagaagatggcagcatctgtgtgctgtatgaggccagccctgctgggggcagcacccagaacagcaccaacgtgcagatggtggacagccgcatcagctgcaaggaggagctgctgctgggccgcaccagccccagcaagaactacaacatgatgacagtgtctggatag

SEQ ID NO: 144886 - DNA, 672 bp, Artificial Sequence
  Description of Artificial Sequence: Synthetic coding sequence
atgagagatgaaattgccaccaccgtcttctttgtgacccggctggtgaagaagcatgacaagctgagcaagcagcagatcgaggactttgctgagaagctgatgaccatcctgtttgagacctaccgcagccactggcacagcgactgccccagcaagggccaggccttccgctgcatccgcatcaacaacaaccagaacaaggaccccatcctggagcgggcctgtgtggagagcaatgtggacttcagccacctgggcctgcccaaggagatgaccatctgggtggacccctttgaggtgtgctgccgctatggagagaagaaccaccccttcaccgtggccagcttcaagggccgctgggaggagtgggagctgtaccagcagatctcctatgctgtgtcccgggccagcagtgatgtgagcagcggcaccagctgtgatgaggagagctgcagcaaggagcccagggtcatccccaaggtgagcaaccccaagagcatctaccaggtggagaacctgaagcagcccttccagagctggctgcagatccccaggaagaagaatgtggtggatggccgggtgggcctgctgggcaacacctaccacggcagccagaagcaccccaagtgctacagacctgccatgcaccggctggaccgcatcctgtag

SEQ ID NO: 144887 - DNA, 483 bp, Artificial Sequence
  Description of Artificial Sequence: Synthetic coding sequence
atgagagatgaaattgccaccaccgtcttctttgtgacccggctggtgaagaagcatgacaagctgagcaagcagcagatcgaggactttgctgagaagctgatgaccatcctgtttgagacctaccgcagccactggcacagcgactgccccagcaagggccaggccttccgctgcatccgcatcaacaacaaccagaacaaggaccccatcctggagcgggcctgtgtggagagcaatgtggacttcagccacctgggcctgcccaaggagatgaccatctgggtggacccctttgaggtgtgctgccgctatggagagaagaaccaccccttcaccgtggccagcttcaagggccgctgggaggagtgggagctgtaccagcagatctcctatgctgtgtcccgggccagcagtgatgtgagcagcggcaccagctgtgatgaggagagctgcagcaaggagcccagggtcatcccctag

SEQ ID NO: 144888 - DNA, 1188 bp, Artificial Sequence
  Description of Artificial Sequence: Synthetic coding sequence
atgagcctggtggacctgggcaagaagctgctggaggccgcccgggccggccaggatgatgaggtgcgcatcctgatggccaacggggcccccttcaccacagactggctgggcaccagccccctgcacctggccgcccagtatggccactacagcaccacagaggtgctgctgcgggccggcgtgtccagagatgcccggaccaaggtggacaggacccccctgcacatggccgccagcgagggccacgccagcatcgtggaggtgctgctgaagcatggagcagatgtgaatgccaaggacatgctgaagatgacagccctgcactgggccacagagcacaaccaccaggaggtggtggagctgctgatcaagtacggggctgatgtgcacacccagagcaagttctgcaagacagcctttgacatcagcattgacaatggaaatgaagacctggccgagatcctgcagatcgccatgcagaaccagatcaacaccaaccctgagagcccagacacagtgaccatccacgccgccaccccccagttcatcatcggccctggaggagtggtgaacctgaccggcctggtgtcctctgagaacagcagcaaggccacagatgaaacaggagtgtctgctgtgcagtttggaaacagcagcacctctgtgctggccaccctggccgccctggccgaggccagcgcccccctgagcaacagcagcgagacccctgtggtggccacagaggaggtggtgacagctgagagcgtggatggagccatccagcaggtggtgtcctctgggggccagcaggtgatcaccatcgtgacagatggcatccagctgggcaacctgcacagcatccccaccagcggcatcggccagcccatcatcgtgaccatgccagatggccagcaggtgctgactgtgcctgccacagacattgctgaggagaccgtcatcagcgaggagcccccagccaagaggcagtgcatcgagatcatcgagaacagagtggagagcgctgagattgaggagcgggaggccctgcagaagcagctggatgaggccaaccgggaggcccagaagtaccggcagcagctgctgaagaaggagcaggaggccgaggcctaccggcagaagctggaggccatgacccggctgcagaccaacaaggaggccgtgtag

SEQ ID NO: 144889 - DNA, 555 bp, Artificial Sequence
  Description of Artificial Sequence: Synthetic coding sequence
atggagcccagccagtgtgtggaggagctggaggatgatgtgttccagccagaagatggagagcctgtgacccagcccggcagcctgctgtctgctgacctgtttgcccagagcctgctggactgccccctgagccggctgcagctgttccccctgacccactgctgcggccctggcctgcggcccaccagccaggaggacaaggccacccagaccctgagccctgccagccccagccagggcgtgatgctgccctgtggggtgacagaggagccccagaggctcttctatggaaatgccggctaccgcctgcccctgcctgccagcttccctgctgtgctgcccatcggggagcagcccccagagggccagtggcagcaccaggccgaggtgcagatcgccaggaagctgcagtgcatcgctgaccagttccaccggctgcacgtgcagcagcaccagcagaaccagaacagagtgtggtggcagatcctgctcttcctgcacaacctggccctgaatggagaggagaacagaaatggagctggccccaggtag

SEQ ID NO: 144890 - DNA, 555 bp, Artificial Sequence; identical to SEQ ID NO: 144889
  Description of Artificial Sequence: Synthetic coding sequence

SEQ ID NO: 144891 - DNA, 492 bp, Artificial Sequence
  Description of Artificial Sequence: Synthetic coding sequence
atggagcccagccagtgtgtggaggagctggaggatgatgtgttccagccagaagatggagagcctgtgacccagcccggcagcctgctgtctgctgacctgtttgcccagagcctgctggactgccccctgagccggctgcagctgttccccctgacccactgctgcggccctggcctgcggcccaccagccaggaggacaaggccacccagaccctgagccctgccagccccagccagggcgtgatgctgccctgtggggtgacagaggagccccagaggctcttctatggaaatgccggctaccgcctgcccctgcctgccagcttccctgctgtgctgcccatcggggagcagcccccagagggccagtggcagcaccaggccgagcaccagcagaaccagaacagagtgtggtggcagatcctgctcttcctgcacaacctggccctgaatggagaagaaaatagaaatggagctggccccaggtag

SEQ ID NO: 144892 - DNA, 186 bp, Artificial Sequence
  Description of Artificial Sequence: Synthetic coding sequence
atggagcccagccagtgtgtggaggagctggaggatgatgtgttccagccagaagatggagagcctgtgacccagcccggcagcctgctgtctgctgacctgtttgcccagagcctgctggactgccccctgagccggctgcagctgttccccctgacccactgctgcggccctggcctgaggtag

SEQ ID NO: 144893 - DNA, 390 bp, Artificial Sequence
  Description of Artificial Sequence: Synthetic coding sequence
atggagcccagccagtgtgtggaggagctggaggatgatgtgttccagccagaagatggagagcctgtgacccagcccggcagcctgctgtctgctgacctgtttgcccagagcctgctggactgccccctgagccggctgcagctgttccccctgacccactgctgcggccctggcctgcggcccaccagccaggaggacaaggccacccagaccctgagccctgccagccccagccagggcgtgatgctgccctgtggggtgacagaggagccccagaggctcttctacgccccagctgagcccaagagctgtgtggtggccgacccccccctgcctgcccagccctgctttgagtggaggcgggagcaggagcggggccggccctag

SEQ ID NO: 144894 - DNA, 42 bp, Artificial Sequence
  Description of Artificial Sequence: Synthetic coding sequence
atggagcccagccagtgtgtggaggagctggaggatgactag

SEQ ID NO: 144895 - DNA, 555 bp, Artificial Sequence; identical to SEQ ID NO: 144889
  Description of Artificial Sequence: Synthetic coding sequence

SEQ ID NO: 144896 - DNA, 555 bp, Artificial Sequence; identical to SEQ ID NO: 144889
  Description of Artificial Sequence: Synthetic coding sequence

SEQ ID NO: 144897 - DNA, 585 bp, Artificial Sequence
  Description of Artificial Sequence: Synthetic coding sequence
atgagccagaatggagcccctggcatgcaggaggagagcctgcagggctcctgggtggagctgcacttcagcaacaatggaaatggaggctctgtgcctgcctctgtgtccatctacaacggggacatggagaagatcctgctggatgcccagcacgagagcggccgcagcagcagcaagagcagccactgtgacagccccccaagaagccagaccccccaggacaccaacagagccagcgagacagacacccacagcattggagagaagaacagcagccagagtgaagaagatgacatcgagaggaggaaggaggtggagagcatcctgaagaagaacagcgactggatctgggactggagcagcaggcctgagaacatcccccccaaggagttcctgttcaagcaccccaagaggacagccaccctgtccatgaggaacacctctgtgatgaagaagggcggcatcttctctgctgagttcctgaaggtgttcctgcccagcctgctgctgagccacctgctggccatcggcctgggcatctacatcggccgccgcctgaccaccagcaccagcaccttctag

SEQ ID NO: 144898 - DNA, 543 bp, Artificial Sequence
  Description of Artificial Sequence: Synthetic coding sequence
atgagccagaatggagcccctggcatgcaggaggagagcctgcagggctcctgggtggagctgcacttcagcaacaatggaaatggaggctctgtgcctgcctctgtgtccatctacaacggggacatggagaagatcctgctggatgcccagcacgagagcggccgcagcagcagcaagagcagccactgtgacagccccccaagaagccagaccccccaggacaccaacagagccagcgagacagacacccacagcattggagagaagaacagcagccagagtgaagaagatgacatcgagaggaggaaggaggtggagagcatcctgaagaagaacagcgactggatctgggactggagcagcaggcctgagaacatcccccccaaggagttcctgttcaagcaccccaagaggacagccaccctgtccatgaggaacacctctgtgatgaagaagggcggcatcttctctgctgagttcctgaaggtgttcctgcccagcctgctgctgagccacctgctggccatcggcctgggctag

SEQ ID NO: 144899 - DNA, 1071 bp, Artificial Sequence
  Description of Artificial Sequence: Synthetic coding sequence
atgagccggcccctgctgatcaccttcaccccagccacagaccccagcgacctgtggaaggatggccagcagcagccccagcctgagaagccagagagcaccctggatggagctgctgccctggccttctatgaggccctgattggagatgagagcagcgccccagacagccagaggagccagacagagcccgcccgggagaggaagaggaagaagaggcgcatcatgaaggccccagctgctgaggccgtggccgagggcgccagcggccgccacggccagggccgcagcctggaggccgaggacaagatgacccaccgcatcctgcgggccgcccaggagggggacctgcctgagctgcggcggctgctggagccccatgaagctggaggagctgggggcaacatcaatgccagagatgccttctggtggacccccctgatgtgtgccgcccgggccggccagggcgctgctgtgtcctacctgctgggcagaggagctgcctgggtgggcgtgtgtgagctgagcggcagagatgctgcccagctggccgaggaggccggcttccctgaggtggccaggatggtgcgggagagccacggggagaccaggagcccagaaaatagaagccccacccccagcctgcagtactgtgagaactgtgacacccacttccaggacagcaaccacaggaccagcacagcccacctgctgagcctgagccagggcccccagccccccaacctgcccctgggcgtgcccatcagcagccctggcttcaagctgctgctgcggggcggctgggagcccggcatgggcctgggccccagaggagagggccgggccaaccccatccccaccgtgctgaagagggaccaggagggcctgggctaccgcagcgccccccagccccgggtgacccacttccctgcctgggacaccagggctgtggccggccgggagaggcctccccgggtggccaccctgtcctggagggaggagcggcggcgggaggagaaggaccgggcctgggagcgggacctgcggacctacatgaacctggagttctag

SEQ ID NO: 144900 - DNA, 3399 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagaccctgccctacctgcagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagaccatgcagggcgagggcccccagctgctgctgtctgaggccgtgtcccgggccgccaaggccgccggggcccggcccctgaccagccctgagagcctgagccgggacctggaggcccctgaggtgcaggagagctaccggcagcagctgcggagtgacatccagaagaggctgcaggaggaccccaactacagcccccagcgcttccccaatgcccagagggcctttgctgatgacccctag

SEQ ID NO: 144901 - DNA, 3234 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagctgcggagtgacatccagaagaggctgcaggaggaccccaactacagcccccagcgcttccccaatgcccagagggcctttgctgatgacccctag

SEQ ID NO: 144902 - DNA, 3399 bp, Artificial Sequence; identical to SEQ ID NO: 144900
  Description of Artificial Sequence: Synthetic coding sequence

SEQ ID NO: 144903 - DNA, 3381 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagaccatgcagggcgagggcccccagctgctgctgtctgaggccgtgtcccgggccgccaaggccgccggggcccggcccctgaccagccctgagagcctgagccgggacctggaggcccctgaggtgcaggagagctaccggcagcagctgcggagtgacatccagaagaggctgcaggaggaccccaactacagcccccagcgcttccccaatgcccagagggcctttgctgatgacccctag

SEQ ID NO: 144904 - DNA, 3381 bp, Artificial Sequence; identical to SEQ ID NO: 144903
  Description of Artificial Sequence: Synthetic coding sequence

SEQ ID NO: 144905 - DNA, 3381 bp, Artificial Sequence; identical to SEQ ID NO: 144903
  Description of Artificial Sequence: Synthetic coding sequence

SEQ ID NO: 144906 - DNA, 3489 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggcagcaccctcatccagctgcccagcctgcccccagagttcatgcatgctgtggcccaccagatcacccaccaggccatggtggccgctgtggccagcgctgctgctggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagaccatgcagggcgagggcccccagctgctgctgtctgaggccgtgtcccgggccgccaaggccgccggggcccggcccctgaccagccctgagagcctgagccgggacctggaggcccctgaggtgcaggagagctaccggcagcagctgcggagtgacatccagaagaggctgcaggaggaccccaactacagcccccagcgcttccccaatgcccagagggcctttgctgatgacccctag

SEQ ID NO: 144907 - DNA, 738 bp, Artificial Sequence
  Description of Artificial Sequence: Synthetic coding sequence
cctcccaggcacctgcacgtggtgcggcccatgagccactacaccacccccatggtgctgcagcaggccgccatccccatccagatcaacgtgggcaccaccgtgaccatgacaggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgccctag

SEQ ID NO: 144908 - DNA, 3381 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagaccatgcagggcgagggcccccagctgctgctgtctgaggccgtgtcccgggccgccaaggccgccggggcccggcccctgaccagccctgagagcctgagccgggacctggaggcccctgaggtgcaggagagctaccggcagcagctgcggagtgacatccagaagaggctgcaggaggaccccaactacagcccccagcgcttccccaatgcccagagggcctttgctgatgacccctag

SEQ ID NO: 144909 - DNA, 789 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgccccctag

SEQ ID NO: 144910 - DNA, 717 bp, Artificial Sequence
  Description of Artificial Sequence: Synthetic coding sequence
agcagcgctgagggcgcccctcctcctggccctgcccctcctccagccaccagccaccccagggtcatccgcatcagccaccagagcgtggagcctgtggtgatgatgcacatgaacatccagggccccctgagcctgagcccctgcccagacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgcctggggtgcctgccttcctgcagggcatgacagacttcctgtag

SEQ ID NO: 144911 - DNA, 3381 bp, Artificial Sequence; identical to SEQ ID NO: 144908
  Description of Artificial Sequence: Synthetic coding sequence

SEQ ID NO: 144912 - DNA, 648 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtgtag

SEQ ID NO: 144913 - DNA, 789 bp, Artificial Sequence; identical to SEQ ID NO: 144909
  Description of Artificial Sequence: Synthetic coding sequence

SEQ ID NO: 144914 - DNA, 2232 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggcagcaccctcatccagctgcccagcctgcccccagagttcatgcatgctgtggcccaccagatcacccaccaggccatggtggccgctgtggccagcgctgctgctggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgtag

SEQ ID NO: 144915 - DNA, 3381 bp, Artificial Sequence; identical to SEQ ID NO: 144908
  Description of Artificial Sequence: Synthetic coding sequence

SEQ ID NO: 144916 - DNA, 3381 bp, Artificial Sequence; identical to SEQ ID NO: 144908
  Description of Artificial Sequence: Synthetic coding sequence

SEQ ID NO: 144917 - DNA, 411 bp, Artificial Sequence
  Description of Artificial Sequence: Synthetic coding sequence
tgaagaatgagccggggcgtgaaccccagcctggtgtcctggctgaccaccatgatgggcctgcggctgcaggtggtgctggagcacatgcctgtgggcccagatgccatcctgcgctacgtgcggcgggtgggggaccccccccagcccctgcctgaggagcccatggaggtgcagggcgctgagcgggccagccctgagccccaggagtgggtgcccatcatccagcaggacatccagagccagaggaaggtgaagccccagccccccctgagtgatgcctacctgagcggcatgcctgccaagaggaggaagctgcggagtgacatccagaagaggctgcaggaggaccccaactacagcccccagcgcttccccaatgcccagagggcctttgctgatgacccctag

SEQ ID NO: 144918 - DNA, 789 bp, Artificial Sequence; identical to SEQ ID NO: 144909
  Description of Artificial Sequence: Synthetic coding sequence

SEQ ID NO: 144919 - DNA, 735 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgccccctag

SEQ ID NO: 144920 - DNA, 594 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccatag

SEQ ID NO: 144921 - DNA, 621 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggcccctccttag

SEQ ID NO: 144922 - DNA, 735 bp, Artificial Sequence; identical to SEQ ID NO: 144919
  Description of Artificial Sequence: Synthetic coding sequence

SEQ ID NO: 144923 - DNA, 3381 bp, Artificial Sequence; identical to SEQ ID NO: 144903
  Description of Artificial Sequence: Synthetic coding sequence

SEQ ID NO: 144924 - DNA, 735 bp, Artificial Sequence; identical to SEQ ID NO: 144919
  Description of Artificial Sequence: Synthetic coding sequence

SEQ ID NO: 144925 - DNA, 717 bp, Artificial Sequence
  Description of Artificial Sequence: Synthetic coding sequence
agcagcgctgagggcgcccctcctcctggccctgcccctcctccagccaccagccaccccagggtcatccgcatcagccaccagagcgtggagcctgtggtgatgatgcacatgaacatccagggccccctgagcctgagcccctgcccagacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgcctggggtgcctgccttcctgcagggcatgacagacttcctgtag

SEQ ID NO: 144926 - DNA, 735 bp, Artificial Sequence; identical to SEQ ID NO: 144919
  Description of Artificial Sequence: Synthetic coding sequence

SEQ ID NO: 144927 - DNA, 2232 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggcagcaccctcatccagctgcccagcctgcccccagagttcatgcatgctgtggcccaccagatcacccaccaggccatggtggccgctgtggccagcgctgctgctggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggcagcggcgtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgtag

SEQ ID NO: 144928 - DNA, 477 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatctag

SEQ ID NO: 144929 - DNA, 681 bp, Artificial Sequence
  Description of Artificial Sequence: Synthetic coding sequence
tgaagcggctttggagcccggctgctggagctgtgcaaccagggcctgtttgagtgcctggccctgaacctgcactgcctgggcggccagcagatggagctggccgccgtcatcaatggccgcatccggaggatgagccggggcgtgaaccccagcctggtgtcctggctgaccaccatgatgggcctgcggctgcaggtggtgctggagcacatgcctgtgggcccagatgccatcctgcgctacgtgcggcgggtgggggaccccccccagcccctgcctgaggagcccatggaggtgcagggcgctgagcgggccagccctgagccccagagagaaaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagctgcggagtgacatccagaagaggctgcaggaggaccccaactacagcccccagcgcttccccaatgcccagagggcctttgctgatgacccctag

SEQ ID NO: 144930 - DNA, 717 bp, Artificial Sequence; identical to SEQ ID NO: 144910
  Description of Artificial Sequence: Synthetic coding sequence

SEQ ID NO: 144931 - DNA, 3381 bp, Artificial Sequence; identical to SEQ ID NO: 144903
  Description of Artificial Sequence: Synthetic coding sequence

SEQ ID NO: 144932 - DNA, 789 bp, Artificial Sequence; identical to SEQ ID NO: 144909
  Description of Artificial Sequence: Synthetic coding sequence

SEQ ID NO: 144933 - DNA, 477 bp, Artificial Sequence; identical to SEQ ID NO: 144928
  Description of Artificial Sequence: Synthetic coding sequence

SEQ ID NO: 144934 - DNA, 777 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagtag

SEQ ID NO: 144935 - DNA, 735 bp, Artificial Sequence; identical to SEQ ID NO: 144919
  Description of Artificial Sequence: Synthetic coding sequence

SEQ ID NO: 144936 - DNA, 1548 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggcagcaccctcatccagctgcccagcctgcccccagagttcatgcatgctgtggcccaccagatcacccaccaggccatggtggccgctgtggccagctag

SEQ ID NO: 144937 - DNA, 702 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagaccctgccctacctgcagtgccggggcggcccccagccccagcacagccagcccccaccccagcccccagctgtgaccccagagcctgtggccctgagcagccagaccagcgagcctgtggagagcgaggccccaccccgggagccctag

SEQ ID NO: 144938 - DNA, 3381 bp, Artificial Sequence; identical to SEQ ID NO: 144908
  Description of Artificial Sequence: Synthetic coding sequence

SEQ ID NO: 144939 - DNA, 789 bp, Artificial Sequence; identical to SEQ ID NO: 144909
  Description of Artificial Sequence: Synthetic coding sequence

SEQ ID NO: 144940 - DNA, 411 bp, Artificial Sequence; identical to SEQ ID NO: 144917
  Description of Artificial Sequence: Synthetic coding sequence

SEQ ID NO: 144941 - DNA, 558 bp, Artificial Sequence
  Description of Artificial Sequence: Synthetic coding sequence
tgactggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccagggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcctag

SEQ ID NO: 144942 - DNA, 681 bp, Artificial Sequence; identical to SEQ ID NO: 144929
  Description of Artificial Sequence: Synthetic coding sequence

SEQ ID NO: 144943 - DNA, 594 bp, Artificial Sequence; identical to SEQ ID NO: 144920
  Description of Artificial Sequence: Synthetic coding sequence

SEQ ID NO: 144944 - DNA, 648 bp, Artificial Sequence; identical to SEQ ID NO: 144912
  Description of Artificial Sequence: Synthetic coding sequence

SEQ ID NO: 144945 - DNA, 702 bp, Artificial Sequence; identical to SEQ ID NO: 144937
  Description of Artificial Sequence: Synthetic coding sequence

SEQ ID NO: 144946 - DNA, 777 bp, Artificial Sequence; identical to SEQ ID NO: 144934
  Description of Artificial Sequence: Synthetic coding sequence

SEQ ID NO: 144947 - DNA, 411 bp, Artificial Sequence; identical to SEQ ID NO: 144917
  Description of Artificial Sequence: Synthetic coding sequence

SEQ ID NO: 144948 - DNA, 780 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagacctag

SEQ ID NO: 144949 - DNA, 2232 bp, Artificial Sequence; identical to SEQ ID NO: 144927
  Description of Artificial Sequence: Synthetic coding sequence

SEQ ID NO: 144950 - DNA, 3399 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagaccctgccctacctgcagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagaccatgcagggcgagggcccccagctgctgctgtctgaggccgtgtcccgggccgccaaggccgccggggcccggcccctgaccagccctgagagcctgagccgggacctggaggcccctgaggtgcaggagagctaccggcagcagctgcggagtgacatccagaagaggctgcaggaggaccccaactacagcccccagcgcttccccaatgcccagagggcctttgctgatgacccctag

SEQ ID NO: 144951 - DNA, 594 bp, Artificial Sequence; identical to SEQ ID NO: 144920
  Description of Artificial Sequence: Synthetic coding sequence

SEQ ID NO: 144952 - DNA, 735 bp, Artificial Sequence; identical to SEQ ID NO: 144919
  Description of Artificial Sequence: Synthetic coding sequence

SEQ ID NO: 144953 - DNA, 594 bp, Artificial Sequence; identical to SEQ ID NO: 144920
  Description of Artificial Sequence: Synthetic coding sequence

SEQ ID NO: 144954 - DNA, 1548 bp, Artificial Sequence; identical to SEQ ID NO: 144936
  Description of Artificial Sequence: Synthetic coding sequence

SEQ ID NO: 144955 - DNA, 735 bp, Artificial Sequence; identical to SEQ ID NO: 144919
  Description of Artificial Sequence: Synthetic coding sequence

SEQ ID NO: 144956 - DNA, 789 bp, Artificial Sequence; identical to SEQ ID NO: 144909
  Description of Artificial Sequence: Synthetic coding sequence

SEQ ID NO: 144957 - DNA, 789 bp, Artificial Sequence; identical to SEQ ID NO: 144909
  Description of Artificial Sequence: Synthetic coding sequence

SEQ ID NO: 144958 - DNA, 717 bp, Artificial Sequence; identical to SEQ ID NO: 144925
  Description of Artificial Sequence: Synthetic coding sequence

SEQ ID NO: 144959 - DNA, 735 bp, Artificial Sequence; identical to SEQ ID NO: 144919
  Description of Artificial Sequence: Synthetic coding sequence

SEQ ID NO: 144960 - DNA, 621 bp, Artificial Sequence; identical to SEQ ID NO: 144921
  Description of Artificial Sequence: Synthetic coding sequence

SEQ ID NO: 144961 - DNA, 735 bp, Artificial Sequence; identical to SEQ ID NO: 144919
  Description of Artificial Sequence: Synthetic coding sequence

SEQ ID NO: 144962 - DNA, 780 bp, Artificial Sequence; identical to SEQ ID NO: 144948
  Description of Artificial Sequence: Synthetic coding sequence

SEQ ID NO: 144963 - DNA, 558 bp, Artificial Sequence; identical to SEQ ID NO: 144941
  Description of Artificial Sequence: Synthetic coding sequence

SEQ ID NO: 144964 - DNA, 621 bp, Artificial Sequence; identical to SEQ ID NO: 144921
  Description of Artificial Sequence: Synthetic coding sequence

SEQ ID NO: 144965 - DNA, 735 bp, Artificial Sequence; identical to SEQ ID NO: 144919
  Description of Artificial Sequence: Synthetic coding sequence

SEQ ID NO: 144966 - DNA, 1548 bp, Artificial Sequence; identical to SEQ ID NO: 144936
  Description of Artificial Sequence: Synthetic coding sequence

SEQ ID NO: 144967 - DNA, 717 bp, Artificial Sequence; identical to SEQ ID NO: 144910
  Description of Artificial Sequence: Synthetic coding sequence

SEQ ID NO: 144968 - DNA, 648 bp, Artificial Sequence; identical to SEQ ID NO: 144912
  Description of Artificial Sequence: Synthetic coding sequence

SEQ ID NO: 144969 - DNA, 477 bp, Artificial Sequence; identical to SEQ ID NO: 144928
  Description of Artificial Sequence: Synthetic coding sequence

SEQ ID NO: 144970 - DNA, 702 bp, Artificial Sequence; identical to SEQ ID NO: 144937
  Description of Artificial Sequence: Synthetic coding sequence

SEQ ID NO: 144971 - DNA, 780 bp, Artificial Sequence; identical to SEQ ID NO: 144948
  Description of Artificial Sequence: Synthetic coding sequence

SEQ ID NO: 144972 - DNA, 411 bp, Artificial Sequence; identical to SEQ ID NO: 144917
  Description of Artificial Sequence: Synthetic coding sequence

SEQ ID NO: 144973 - DNA, 735 bp, Artificial Sequence; identical to SEQ ID NO: 144919
  Description of Artificial Sequence: Synthetic coding sequence

SEQ ID NO: 144974 - DNA, 3381 bp, Artificial Sequence; identical to SEQ ID NO: 144908
  Description of Artificial Sequence: Synthetic coding sequence

SEQ ID NO: 144975 - DNA, 411 bp, Artificial Sequence; identical to SEQ ID NO: 144917
  Description of Artificial Sequence: Synthetic coding sequence

SEQ ID NO: 144976 - DNA, 648 bp, Artificial Sequence; identical to SEQ ID NO: 144912
  Description of Artificial Sequence: Synthetic coding sequence

SEQ ID NO: 144977 - DNA, 594 bp, Artificial Sequence; identical to SEQ ID NO: 144920
  Description of Artificial Sequence: Synthetic coding sequence

SEQ ID NO: 144978 - DNA, 1548 bp, Artificial Sequence; identical to SEQ ID NO: 144936
  Description of Artificial Sequence: Synthetic coding sequence

SEQ ID NO: 144979 - DNA, 738 bp, Artificial Sequence
  Description of Artificial Sequence: Synthetic coding sequence
cctcccaggcacctgcacgtggtgcggcccatgagccactacaccacccccatggtgctgcagcaggccgccatccccatccagatcaacgtgggcaccaccgtgaccatgacaggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgccctag

SEQ ID NO: 144980 - DNA, 738 bp, Artificial Sequence; identical to SEQ ID NO: 144907
  Description of Artificial Sequence: Synthetic coding sequence

SEQ ID NO: 144981 - DNA, 777 bp, Artificial Sequence; identical to SEQ ID NO: 144934
  Description of Artificial Sequence: Synthetic coding sequence

SEQ ID NO: 144982 - DNA, 789 bp, Artificial Sequence; identical to SEQ ID NO: 144909
  Description of Artificial Sequence: Synthetic coding sequence

SEQ ID NO: 144983 - DNA, 2232 bp, Artificial Sequence; identical to SEQ ID NO: 144927
  Description of Artificial Sequence: Synthetic coding sequence

SEQ ID NO: 144984 - DNA, 777 bp, Artificial Sequence; identical to SEQ ID NO: 144934
  Description of Artificial Sequence: Synthetic coding sequence

SEQ ID NO: 144985 - DNA, 558 bp, Artificial Sequence; identical to SEQ ID NO: 144941
  Description of Artificial Sequence: Synthetic coding sequence

SEQ ID NO: 144986 - DNA, 648 bp, Artificial Sequence; identical to SEQ ID NO: 144912
  Description of Artificial Sequence: Synthetic coding sequence

SEQ ID NO: 144987 - DNA, 780 bp, Artificial Sequence; identical to SEQ ID NO: 144948
  Description of Artificial Sequence: Synthetic coding sequence

SEQ ID NO: 144988 - DNA, 477 bp, Artificial Sequence; identical to SEQ ID NO: 144928
  Description of Artificial Sequence: Synthetic coding sequence

SEQ ID NO: 144989 - DNA, 621 bp, Artificial Sequence; identical to SEQ ID NO: 144921
  Description of Artificial Sequence: Synthetic coding sequence

SEQ ID NO: 144990 - DNA, 2232 bp, Artificial Sequence; identical to SEQ ID NO: 144927
  Description of Artificial Sequence: Synthetic coding sequence

SEQ ID NO: 144991 - DNA, 681 bp, Artificial Sequence; identical to SEQ ID NO: 144929
  Description of Artificial Sequence: Synthetic coding sequence

SEQ ID NO: 144992 - DNA, 594 bp, Artificial Sequence; identical to SEQ ID NO: 144920
  Description of Artificial Sequence: Synthetic coding sequence

SEQ ID NO: 144993 - DNA, 717 bp, Artificial Sequence; identical to SEQ ID NO: 144925
  Description of Artificial Sequence: Synthetic coding sequence

SEQ ID NO: 144994 - DNA, 735 bp, Artificial Sequence; identical to SEQ ID NO: 144919
  Description of Artificial Sequence: Synthetic coding sequence

SEQ ID NO: 144995 - DNA, 789 bp, Artificial Sequence; identical to SEQ ID NO: 144909
  Description of Artificial Sequence: Synthetic coding sequence

SEQ ID NO: 144996 - DNA, 2232 bp, Artificial Sequence; identical to SEQ ID NO: 144914
  Description of Artificial Sequence: Synthetic coding sequence

SEQ ID NO: 144997 - DNA, 735 bp, Artificial Sequence; identical to SEQ ID NO: 144919
  Description of Artificial Sequence: Synthetic coding sequence

SEQ ID NO: 144998 - DNA, 789 bp, Artificial Sequence; identical to SEQ ID NO: 144909
  Description of Artificial Sequence: Synthetic coding sequence

SEQ ID NO: 144999 - DNA, 2712 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgggcgccggcctgggcaccaatgccagcctggcccagatggtgtctggcctggtgggccagctgctgatgcagcctgtgctggtggcccagggcaccccaggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccaggagtgggtgcccatcatccagcaggacatccagagccagaggaaggtgaagccccagccccccctgagtgatgcctacctgagcggcatgcctgccaagaggaggaagctgcggagtgacatccagaagaggctgcaggaggaccccaactacagcccccagcgcttccccaatgcccagagggcctttgctgatgacccctag

SEQ ID NO: 145000 - DNA, 558 bp, Artificial Sequence; identical to SEQ ID NO: 144941
  Description of Artificial Sequence: Synthetic coding sequence

SEQ ID NO: 145001 - DNA, 789 bp, Artificial Sequence; identical to SEQ ID NO: 144909
  Description of Artificial Sequence: Synthetic coding sequence

SEQ ID NO: 145002 - DNA, 621 bp, Artificial Sequence; identical to SEQ ID NO: 144921
  Description of Artificial Sequence: Synthetic coding sequence

SEQ ID NO: 145003 - DNA, 681 bp, Artificial Sequence; identical to SEQ ID NO: 144929
  Description of Artificial Sequence: Synthetic coding sequence

SEQ ID NO: 145004 - DNA, 780 bp, Artificial Sequence; identical to SEQ ID NO: 144948
  Description of Artificial Sequence: Synthetic coding sequence

SEQ ID NO: 145005 - DNA, 777 bp, Artificial Sequence; identical to SEQ ID NO: 144934
  Description of Artificial Sequence: Synthetic coding sequence

SEQ ID NO: 145006 - DNA, 477 bp, Artificial Sequence; identical to SEQ ID NO: 144928
  Description of Artificial Sequence: Synthetic coding sequence

SEQ ID NO: 145007 - DNA, 735 bp, Artificial Sequence; identical to SEQ ID NO: 144919
  Description of Artificial Sequence: Synthetic coding sequence

SEQ ID NO: 145008 - DNA, 3381 bp, Artificial Sequence; identical to SEQ ID NO: 144903
  Description of Artificial Sequence: Synthetic coding sequence

SEQ ID NO: 145009 - DNA, 735 bp, Artificial Sequence; identical to SEQ ID NO: 144919
  Description of Artificial Sequence: Synthetic coding sequence

SEQ ID NO: 145010 - DNA, 1548 bp, Artificial Sequence; identical to SEQ ID NO: 144936
  Description of Artificial Sequence: Synthetic coding sequence

SEQ ID NO: 145011 - DNA, 3381 bp, Artificial Sequence; identical to SEQ ID NO: 144903
  Description of Artificial Sequence: Synthetic coding sequence

SEQ ID NO: 145012 - DNA, 411 bp, Artificial Sequence; identical to SEQ ID NO: 144917
  Description of Artificial Sequence: Synthetic coding sequence

SEQ ID NO: 145013 - DNA, 3399 bp, Artificial Sequence; identical to SEQ ID NO: 144950
  Description of Artificial Sequence: Synthetic coding sequence

SEQ ID NO: 145014 - DNA, 702 bp, Artificial Sequence; identical to SEQ ID NO: 144937
  Description of Artificial Sequence: Synthetic coding sequence

SEQ ID NO: 145015 - DNA, 558 bp, Artificial Sequence; identical to SEQ ID NO: 144941
  Description of Artificial Sequence: Synthetic coding sequence

SEQ ID NO: 145016 - DNA, 738 bp, Artificial Sequence; identical to SEQ ID NO: 144979
  Description of Artificial Sequence: Synthetic coding sequence

SEQ ID NO: 145017 - DNA, 702 bp, Artificial Sequence; identical to SEQ ID NO: 144937
  Description of Artificial Sequence: Synthetic coding sequence

SEQ ID NO: 145018 - DNA, 780 bp, Artificial Sequence; identical to SEQ ID NO: 144948
  Description of Artificial Sequence: Synthetic coding sequence

SEQ ID NO: 145019 - DNA, 702 bp, Artificial Sequence; identical to SEQ ID NO: 144937
  Description of Artificial Sequence: Synthetic coding sequence

SEQ ID NO: 145020 - DNA, 1548 bp, Artificial Sequence; identical to SEQ ID NO: 144936
  Description of Artificial Sequence: Synthetic coding sequence

SEQ ID NO: 145021 - DNA, 477 bp, Artificial Sequence; identical to SEQ ID NO: 144928
  Description of Artificial Sequence: Synthetic coding sequence

SEQ ID NO: 145022 - DNA, 702 bp, Artificial Sequence; identical to SEQ ID NO: 144937
  Description of Artificial Sequence: Synthetic coding sequence

SEQ ID NO: 145023 - DNA, 735 bp, Artificial Sequence; identical to SEQ ID NO: 144919
  Description of Artificial Sequence: Synthetic coding sequence

SEQ ID NO: 145024 - DNA, 3399 bp, Artificial Sequence; identical to SEQ ID NO: 144900
  Description of Artificial Sequence: Synthetic coding sequence

SEQ ID NO: 145025 - DNA, 1548 bp, Artificial Sequence; identical to SEQ ID NO: 144936
  Description of Artificial Sequence: Synthetic coding sequence

SEQ ID NO: 145026 - DNA, 735 bp, Artificial Sequence; identical to SEQ ID NO: 144919
  Description of Artificial Sequence: Synthetic coding sequence

SEQ ID NO: 145027 - DNA, 2232 bp, Artificial Sequence; identical to SEQ ID NO: 144914
  Description of Artificial Sequence: Synthetic coding sequence

SEQ ID NO: 145028 - DNA, 735 bp, Artificial Sequence; identical to SEQ ID NO: 144919
  Description of Artificial Sequence: Synthetic coding sequence

SEQ ID NO: 145029 - DNA, 735 bp, Artificial Sequence; identical to SEQ ID NO: 144919
  Description of Artificial Sequence: Synthetic coding sequence

SEQ ID NO: 145030 - DNA, 3399 bp, Artificial Sequence; identical to SEQ ID NO: 144900
  Description of Artificial Sequence: Synthetic coding sequence

SEQ ID NO: 145031 - DNA, 738 bp, Artificial Sequence; identical to SEQ ID NO: 144979
  Description of Artificial Sequence: Synthetic coding sequence

SEQ ID NO: 145032 - DNA, 777 bp, Artificial Sequence; identical to SEQ ID NO: 144934
  Description of Artificial Sequence: Synthetic coding sequence

SEQ ID NO: 145033 - DNA, 789 bp, Artificial Sequence; identical to SEQ ID NO: 144909
  Description of Artificial Sequence: Synthetic coding sequence

SEQ ID NO: 145034 - DNA, 789 bp, Artificial Sequence; identical to SEQ ID NO: 144909
  Description of Artificial Sequence: Synthetic coding sequence

SEQ ID NO: 145035 - DNA, 738 bp, Artificial Sequence; identical to SEQ ID NO: 144907
  Description of Artificial Sequence: Synthetic coding sequence

SEQ ID NO: 145036 - DNA, 648 bp, Artificial Sequence; identical to SEQ ID NO: 144912
  Description of Artificial Sequence: Synthetic coding sequence

SEQ ID NO: 145037 - DNA, 735 bp, Artificial Sequence; identical to SEQ ID NO: 144919
  Description of Artificial Sequence: Synthetic coding sequence

SEQ ID NO: 145038 - DNA, 558 bp, Artificial Sequence; identical to SEQ ID NO: 144941
  Description of Artificial Sequence: Synthetic coding sequence

SEQ ID NO: 145039 - DNA, 780 bp, Artificial Sequence; identical to SEQ ID NO: 144948
  Description of Artificial Sequence: Synthetic coding sequence

SEQ ID NO: 145040 - DNA, 477 bp, Artificial Sequence; identical to SEQ ID NO: 144928
  Description of Artificial Sequence: Synthetic coding sequence

SEQ ID NO: 145041 - DNA, 621 bp, Artificial Sequence; identical to SEQ ID NO: 144921
  Description of Artificial Sequence: Synthetic coding sequence

SEQ ID NO: 145042 - DNA, 3399 bp, Artificial Sequence; identical to SEQ ID NO: 144950
  Description of Artificial Sequence: Synthetic coding sequence

SEQ ID NO: 145043 - DNA, 717 bp, Artificial Sequence; identical to SEQ ID NO: 144925
  Description of Artificial Sequence: Synthetic coding sequence

SEQ ID NO: 145044 - DNA, 621 bp, Artificial Sequence; identical to SEQ ID NO: 144921
  Description of Artificial Sequence: Synthetic coding sequence

SEQ ID NO: 145045 - DNA, 558 bp, Artificial Sequence; identical to SEQ ID NO: 144941
  Description of Artificial Sequence: Synthetic coding sequence

SEQ ID NO: 145046 - DNA, 648 bp, Artificial Sequence; identical to SEQ ID NO: 144912
  Description of Artificial Sequence: Synthetic coding sequence

SEQ ID NO: 145047 - DNA, 789 bp, Artificial Sequence; identical to SEQ ID NO: 144909
  Description of Artificial Sequence: Synthetic coding sequence

SEQ ID NO: 145048 - DNA, 594 bp, Artificial Sequence; identical to SEQ ID NO: 144920
  Description of Artificial Sequence: Synthetic coding sequence

SEQ ID NO: 145049 - DNA, 735 bp, Artificial Sequence; identical to SEQ ID NO: 144919
  Description of Artificial Sequence: Synthetic coding sequence

SEQ ID NO: 145050 - DNA, 681 bp, Artificial Sequence; identical to SEQ ID NO: 144929
  Description of Artificial Sequence: Synthetic coding sequence

SEQ ID NO: 145051 - DNA, 738 bp, Artificial Sequence; identical to SEQ ID NO: 144907
  Description of Artificial Sequence: Synthetic coding sequence

SEQ ID NO: 145052 - DNA, 681 bp, Artificial Sequence; identical to SEQ ID NO: 144929
  Description of Artificial Sequence: Synthetic coding sequence

SEQ ID NO: 145053 - DNA, 681 bp, Artificial Sequence; identical to SEQ ID NO: 144929
  Description of Artificial Sequence: Synthetic coding sequence

SEQ ID NO: 145054 - DNA, 777 bp, Artificial Sequence; identical to SEQ ID NO: 144934
  Description of Artificial Sequence: Synthetic coding sequence

SEQ ID NO: 145055 - DNA, 411 bp, Artificial Sequence; identical to SEQ ID NO: 144917
  Description of Artificial Sequence: Synthetic coding sequence

SEQ ID NO: 145056 - DNA, 3489 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggcagcaccctcatccagctgcccagcctgcccccagagttcatgcatgctgtggcccaccagatcacccaccaggccatggtggccgctgtggccagcgctgctgctggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagaccatgcagggcgagggcccccagctgctgctgtctgaggccgtgtcccgggccgccaaggccgccggggcccggcccctgaccagccctgagagcctgagccgggacctggaggcccctgaggtgcaggagagctaccggcagcagctgcggagtgacatccagaagaggctgcaggaggaccccaactacagcccccagcgcttccccaatgcccagagggcctttgctgatgacccctag

SEQ ID NO: 145057 - DNA, 2712 bp, Artificial Sequence; identical to SEQ ID NO: 144999
  Description of Artificial Sequence: Synthetic coding sequence

SEQ ID NO: 145058 - DNA, 2712 bp, Artificial Sequence; identical to SEQ ID NO: 144999
  Description of Artificial Sequence: Synthetic coding sequence

SEQ ID NO: 145059 - DNA, 3234 bp, Artificial Sequence; identical to SEQ ID NO: 144901
  Description of Artificial Sequence: Synthetic coding sequence

SEQ ID NO: 145060 - DNA, 3234 bp, Artificial Sequence
  Description of Artificial Sequence: Synthetic coding sequence
atggagcccaatgacagcaccagcacagctgtggaggagccagacagcctggaggtgctggtgaagaccctggacagccagaccaggaccttcatcgtgggcgcccagatgaatgtgaaggagttcaaggagcacatcgccgcctctgtgtccatccccagcgagaagcagaggctcatctaccagggccgggtgctgcaggatgacaagaagctgcaggagtacaacgtgggcggcaaggtgatccacctggtggagcgggccccaccccagacccacctgcccagcggggccagcagcggcaccggcagcgccagcgccacccatggaggcggcagccccccaggcacccggggccctggggcctctgtgcatgacagaaatgccaacagctatgtgatggtgggcaccttcaacctgcccagtgatggcagcgctgtggatgtgcacatcaacatggagcaggcccccatccagagcgagccccgggtgcggctggtgatggcccagcacatgatccgggacatccagaccctgctgagcaggatggagtgccggggcggcccccagccccagcacagccagcccccaccccagcccccagctgtgaccccagagcctgtggccctgagcagccagaccagcgagcctgtggagagcgaggccccaccccgggagcccatggaggccgaggaggtggaggagcgggccccagcccagaaccctgagctgaccccaggccctgccccagctggccccaccccagcccctgagaccaatgcccccaaccaccccagccctgcagaatatgtggaggtgctgcaggagctgcagaggctggagagccggctgcagcccttcctgcagcgctactatgaggtgctgggcgccgccgccaccacagactacaacaacaaccacgagggccgggaggaggaccagaggctcatcaacctggtgggggagagcctgcggctgctgggcaacacctttgtggccctgagtgacctgcgctgcaacctggcctgcaccccacccaggcacctgcacgtggtgcggcccatgagccactacaccacccccatggtgctgcagcaggccgccatccccatccagatcaacgtgggcaccaccgtgaccatgactggaaatggcacccggcccccacccaccccaaatgctgaggcccctcctcctggccctggccaggccagctctgtggcccccagcagcaccaacgtggagagcagcgctgagggcgcccctcctcctggccctgcccctcctccagccaccagccaccccagggtcatccgcatcagccaccagagcgtggagcctgtggtgatgatgcacatgaacatccaggacagcggcacccagcccggcggcgtgcccagcgcccccaccggccccctgggccccccaggccacggccagaccctgggccagcaggtgcccggcttccccacagcccccaccagggtggtgattgcccggcccaccccaccccaggcccggcccagccaccctgggggcccccctgtgtctggcaccctgcagggcgccggcctgggcaccaatgccagcctggcccagatggtgtctggcctggtgggccagctgctgatgcagcctgtgctggtggcccagggcaccccaggcatggcccctcctccagccccagccacagccagcgccagcgctggcaccaccaacacagccaccacagctggccctgcccctgggggccctgcccagcccccacccaccccccagcccagcatggctgacctgcagttcagccagctgctgggcaacctgctgggccctgctggccctggggccggcggccctggggtggccagccccaccatcaccgtggccatgcctggggtgcctgccttcctgcagggcatgacagacttcctgcaggccacccagacagcccctcctcctcctcctcctcctcctcctcctcctccagcccctgagcagcagaccatgcctcctcctggcagccccagcggcggggccggcagccctgggggcctgggcctggagagcctgagccctgagttcttcacctctgtggtgcagggcgtgctgagcagcctgctgggcagcctgggcgcccgggccggcagcagcgagagcattgctgccttcatccagaggctgagcggcagcagcaacatctttgagcccggggctgatggagccctgggcttctttggagccctgctgagcctgctgtgccagaacttctccatggtggatgtggtgatgctgctgcacggccacttccagcccctgcagaggctgcagccccagctgcgctccttcttccaccagcactacctgggcggccaggagcccacccccagcaacatccgcatggccacccacaccctcatcaccggcctggaggagtatgtgcgggagagcttcagcctggtgcaggtgcagcccggggtggacatcatccgcaccaacctggagttcctgcaggagcagttcaacagcattgctgcccacgtgctgcactgcacagattctggctttggagcccggctgctggagctgtgcaaccagggcctgtttgaatgtctggccctgaacctgcactgcctgggcggccagcagatggagctggccgctgtgatcaatggccgcatccggaggatgagcagaggagtgaaccccagcctggtgtcctggctgaccaccatgatgggcctgcggctgcaggtggtgctggagcacatgcctgtgggcccagatgccatcctgcgctacgtgagaagagtgggggaccccccccagcccctgcctgaggagcccatggaggtgcagggcgctgagcgggccagccctgagccccagcgggagaatgccagccctgcccctggcaccacagctgaggaggccatgagccggggccccccaccagcccctgagggcggcagcagagatgagcaggatggagccagcgctgagacagagccctgggccgctgctgtgcccccagagtgggtgcccatcatccagcaggacatccagagccagaggaaggtgaagccccagccccccctgagtgatgcctacctgagcggcatgcctgccaagaggaggaagctgcggagtgacatccagaagaggctgcaggaggaccccaactacagcccccagcgcttccccaatgcccagagggcctttgctgatgacccctag

SEQ ID NO: 145061 - DNA, 3489 bp, Artificial Sequence; identical to SEQ ID NO: 145056
  Description of Artificial Sequence: Synthetic coding sequence

SEQ ID NO: 145062 - DNA, 3234 bp, Artificial Sequence; identical to SEQ ID NO: 144901
  Description of Artificial Sequence: Synthetic coding sequence

SEQ ID NO: 145063 - DNA, 2712 bp, Artificial Sequence; identical to SEQ ID NO: 144999
  Description of Artificial Sequence: Synthetic coding sequence

SEQ ID NO: 145064 - DNA, 3489 bp, Artificial Sequence; identical to SEQ ID NO: 144906
  Description of Artificial Sequence: Synthetic coding sequence

SEQ ID NO: 145065 - DNA, 3234 bp, Artificial Sequence; identical to SEQ ID NO: 145060
  Description of Artificial Sequence: Synthetic coding sequence

SEQ ID NO: 145066 - DNA, 2712 bp, Artificial Sequence; identical to SEQ ID NO: 144999
  Description of Artificial Sequence: Synthetic coding sequence

SEQ ID NO: 145067 - DNA, 2712 bp, Artificial Sequence; identical to SEQ ID NO: 144999
  Description of Artificial Sequence: Synthetic coding sequence

SEQ ID NO: 145068 - DNA, 3489 bp, Artificial Sequence; identical to SEQ ID NO: 144906
  Description of Artificial Sequence: Synthetic coding sequence

SEQ ID NO: 145069 - DNA, 3489 bp, Artificial Sequence; identical to SEQ ID NO: 145056
  Description of Artificial Sequence: Synthetic coding sequence

SEQ ID NO: 145070 - DNA, 3489 bp, Artificial Sequence; identical to SEQ ID NO: 144906
  Description of Artificial Sequence: Synthetic coding sequence

SEQ ID NO: 145071 - DNA, 3234 bp, Artificial Sequence; identical to SEQ ID NO: 145060
  Description of Artificial Sequence: Synthetic coding sequence

SEQ ID NO: 145072 - DNA, 3234 bp, Artificial Sequence; identical to SEQ ID NO: 144901
  Description of Artificial Sequence: Synthetic coding sequence

SEQ ID NO: 145073 - DNA, 2712 bp, Artificial Sequence; identical to SEQ ID NO: 144999
  Description of Artificial Sequence: Synthetic coding sequence

SEQ ID NO: 145074 - DNA, 417 bp, Artificial Sequence
  Description of Artificial Sequence: Synthetic coding sequence
atgaaggagtacagcggctttgctggggtgtcccggccccggggcaccttcttccgcatccggggccggggccgggcccggggcgtgtttgctggcaccaacacaggccccaacaacagcaacaccaccttccagaagaggcccaaggaggaggagtgggaccctgagtacacccccaagagcaagaagtacttcctgcatgatgacagagatgatggagtggactactgggccaagaggggccggggccggggcaccttccagaggggccggggccgcttcaacttcaagaagagcggcagcagccccaagtggacccatgacaagtaccagggagatggcatcgtggaggatgaggaggagaccatggagaacaatgaggagaagaaggacaggaggaaggaggagaaggagtag

SEQ ID NO: 145075 - DNA, 2610 bp, Artificial Sequence
  Description of Artificial Sequence: Synthetic coding sequence
atgggccgcagcaacagccgcagccacagcagccgcagcaagagccgcagccagagcagcagccgcagccgcagccgcagccacagcaggaagaagcgctaccgcagccgcagcaggacctacagccgcagccgcagccgggacaggatgtacagccgggactaccgccgggactacagaaacaacagaggcatgaggcggccctacggctaccggggccggggccggggctactaccagggcggcggcggccgctaccacagaggaggctacagacctgtgtggaacagaagacacagccgcagcccccggcggggccgcagccgcagccgcagccccaagagaagatctgtgagcagccagaggagccgcagccgcagccgccgcagctaccgcagcagccgcagccccaggagcagcagcagccgcagcagcagcccctacagcaagagccctgtgtccaagaggcggggcagccaggagaagcagaccaagaaggccgagggggagccccaggaggagagccccctgaagagcaagagccaggaggagcccaaggacacctttgaacatgaccccagcgagagcattgatgagttcaacaagagcagcgccaccagcggggacatctggccaggcctgagcgcctatgacaacagccccaggagcccccacagccccagccccatcgccaccccacccagccagagcagcagctgcagtgatgcccccatgctgagcacagtgcacagcgccaagaacacccccagccagcacagccacagcatccagcacagccctgagaggagcggcagcggctctgtgggcaatggcagcagccgctacagccccagccagaacagccccatccaccacatccccagccgccgcagccctgccaagaccatcgccccccagaatgcccccagagatgagagccggggccgcagcagcttctacccagatggaggagaccaggagacagccaagacaggcaagttcctgaagcgcttcacagatgaggagagcagggtcttcctgctggaccggggcaacacccgggacaaggaggccagcaaggagaagggcagcgagaagggccgggcagagggggagtgggaggaccaggaggccctggactacttcagtgacaaggagagcggcaagcagaagttcaatgattctgaaggagatgacacagaggagacagaggactaccggcagttcaggaagtctgtgctggccgaccagggcaagagctttgccacagccagccacaggaacacagaggaggagggcctgaagtacaagagcaaggtgtccctgaagggcaaccgggagagtgatggcttccgggaggagaagaactacaagctgaaggagaccggctacgtggtggagcggcccagcaccaccaaggacaagcacaaggaggaggacaagaacagcgagcgcatcaccgtgaagaaggagacccagagccctgagcaggtgaagtctgagaagctgaaggacctgtttgactacagcccccccctgcacaagaacctggatgcccgggagaagagcaccttccgggaggagagccccctgcgcatcaagatgattgccagtgacagccacaggcctgaggtgaagctgaagatggcccctgtgcccctggatgacagcaacagacctgccagcctgaccaaggaccggctgctggccagcaccctggtgcacagcgtgaagaaggagcaggagttccgcagcatctttgaccacatcaagctgccccaggccagcaagagcaccagcgagagcttcatccagcacatcgtgtccctggtgcaccacgtgaaggagcagtacttcaagtctgctgccatgaccctgaatgaacgcttcaccagctaccagaaggccacagaggagcacagcacccggcagaagagccctgagatccacagaagaattgacatcagccccagcaccctgaggaagcacacccggctggccggggaggagagggtcttcaaggaggagaaccagaagggggacaagaagctgcgctgtgacagcgctgacctgcggcatgacatcgacagaagaaggaaggagaggagcaaggagcggggggacagcaagggcagccgggagagcagcggcagcaggaagcaggagaagacccccaaggactacaaggagtacaagagctacaaggatgacagcaagcacaagcgggagcaggaccacagccgcagcagcagcagcagcgccagccccagcagccccagcagccgggaggagaaggagagcaagaaggagcgggaggaggagttcaagacccaccacgagatgaaggagtacagcggctttgctggggtgtcccggccccggggcaccttccatgatgacagagatgatggagtggactactgggccaagaggggccggggccggggcaccttccagaggggccggggccgcttcaacttcaagaagagcggcagcagccccaagtggacccatgacaagtaccagggagatggcatcgtggaggatgaggaggagaccatggagaacaatgaggagaagaaggacaggaggaaggaggagaaggagtag

SEQ ID NO: 145076 - DNA, 2610 bp, Artificial Sequence; identical to SEQ ID NO: 145075
  Description of Artificial Sequence: Synthetic coding sequence

SEQ ID NO: 145077 - DNA, 2757 bp, Artificial Sequence
  Description of Artificial Sequence: Synthetic coding sequence
atgggccgcagcaacagccgcagccacagcagccgcagcaagagccgcagccagagcagcagccgcagccgcagccgcagccacagcaggaagaagcgctaccgcagccgcagcaggacctacagccgcagccgcagccgggacaggatgtacagccgggactaccgccgggactacagaaacaacagaggcatgaggcggccctacggctaccggggccggggccggggctactaccagggcggcggcggccgctaccacagaggaggctacagacctgtgtggaacagaagacacagccgcagcccccggcggggccgcagccgcagccgcagccccaagagaagatctgtgagcagccagaggagccgcagccgcagccgccgcagctaccgcagcagccgcagccccaggagcagcagcagccgcagcagcagcccctacagcaagagccctgtgtccaagaggcggggcagccaggagaagcagaccaagaaggccgagggggagccccaggaggagagccccctgaagagcaagagccaggaggagcccaaggacacctttgaacatgaccccagcgagagcattgatgagttcaacaagagcagcgccaccagcggggacatctggccaggcctgagcgcctatgacaacagccccaggagcccccacagccccagccccatcgccaccccacccagccagagcagcagctgcagtgatgcccccatgctgagcacagtgcacagcgccaagaacacccccagccagcacagccacagcatccagcacagccctgagaggagcggcagcggctctgtgggcaatggcagcagccgctacagccccagccagaacagccccatccaccacatccccagccgccgcagccctgccaagaccatcgccccccagaatgcccccagagatgagagccggggccgcagcagcttctacccagatggaggagaccaggagacagccaagacaggcaagttcctgaagcgcttcacagatgaggagagcagggtcttcctgctggaccggggcaacacccgggacaaggaggccagcaaggagaagggcagcgagaagggccgggcagagggggagtgggaggaccaggaggccctggactacttcagtgacaaggagagcggcaagcagaagttcaatgattctgaaggagatgacacagaggagacagaggactaccggcagttcaggaagtctgtgctggccgaccagggcaagagctttgccacagccagccacaggaacacagaggaggagggcctgaagtacaagagcaaggtgtccctgaagggcaaccgggagagtgatggcttccgggaggagaagaactacaagctgaaggagaccggctacgtggtggagcggcccagcaccaccaaggacaagcacaaggaggaggacaagaacagcgagcgcatcaccgtgaagaaggagacccagagccctgagcaggtgaagtctgagaagctgaaggacctgtttgactacagcccccccctgcacaagaacctggatgcccgggagaagagcaccttccgggaggagagccccctgcgcatcaagatgattgccagtgacagccacaggcctgaggtgaagctgaagatggcccctgtgcccctggatgacagcaacagacctgccagcctgaccaaggaccggctgctggccagcaccctggtgcacagcgtgaagaaggagcaggagttccgcagcatctttgaccacatcaagctgccccaggccagcaagagcaccagcgagagcttcatccagcacatcgtgtccctggtgcaccacgtgaaggagcagtacttcaagtctgctgccatgaccctgaatgaacgcttcaccagctaccagaaggccacagaggagcacagcacccggcagaagagccctgagatccacagaagaattgacatcagccccagcaccctgaggaagcacacccggctggccggggaggagagggtcttcaaggaggagaaccagaagggggacaagaagctgcgctgtgacagcgctgacctgcggcatgacatcgacagaagaaggaaggagaggagcaaggagcggggggacagcaagggcagccgggagagcagcggcagcaggaagcaggagaagacccccaaggactacaaggagtacaagagctacaaggatgacagcaagcacaagcgggagcaggaccacagccgcagcagcagcagcagcgccagccccagcagccccagcagccgggaggagaaggagagcaagaaggagcgggaggaggagttcaagacccaccacgagatgaaggagtacagcggctttgctggggtgtcccggccccggggcaccttcttccgcatccggggccggggccgggcccggggcgtgtttgctggcaccaacacaggccccaacaacagcaacaccaccttccagaagaggcccaaggaggaggagtgggaccctgagtacacccccaagagcaagaagtacttcctgcatgatgacagagatgatggagtggactactgggccaagaggggccggggccggggcaccttccagaggggccggggccgcttcaacttcaagaagagcggcagcagccccaagtggacccatgacaagtaccagggagatggcatcgtggaggatgaggaggagaccatggagaacaatgaggagaagaaggacaggaggaaggaggagaaggagtag

SEQ ID NO: 145078 - DNA, 2244 bp, Artificial Sequence
  Description of Artificial Sequence: Synthetic coding sequence
atgggccgcagcaacagccgcagccacagcagccgcagcaagagccgcagccagagcagcagccgcagccgcagccgcagccacagcaggaagaagcgctacagcagccgcagccgcagcaggacctacagccgcagccgcagccgggacaggatgtacagccgggactaccgccgggactacagaaacaacagaggcatgaggcggccctacggctaccggggccggggccggggctactaccagggcggcggcggccgctaccacagaggaggctacagacctgtgtggaacagaagacacagccgcagcccccggcggggccgcagccgcagccgcagccccaagagaagatctgtgagcagccagaggagccgcagccgcagccgccgcagctaccgcagcagccgcagccccaggagcagcagcagccgcagcagcagcccctacagcaagagccctgtgtccaagaggcggggcagccaggagaagcagaccaagaaggccgagggggagccccaggaggagagccccctgaagagcaagagccaggaggagcccaaggacacctttgaacatgaccccagcgagagcattgatgagttcaacaagagcagcgccaccagcggggacatctggccaggcctgagcgcctatgacaacagccccaggagcccccacagccccagccccatcgccaccccacccagccagagcagcagctgcagtgatgcccccatgctgagcacagtgcacagcgccaagaacacccccagccagcacagccacagcatccagcacagccctgagaggagcggcagcggctctgtgggcaatggcagcagccgctacagccccagccagaacagccccatccaccacatccccagccgccgcagccctgccaagaccatcgccccccagaatgcccccagagatgagagccggggccgcagcagcttctacccagatggaggagaccaggagacagccaagacaggcaagttcctgaagagcccccccctgcacaagaacctggatgcccgggagaagagcaccttccgggaggagagccccctgcgcatcaagatgattgccagtgacagccacaggcctgaggtgaagctgaagatggcccctgtgcccctggatgacagcaacagacctgccagcctgaccaaggaccggctgctggccagcaccctggtgcacagcgtgaagaaggagcaggagttccgcagcatctttgaccacatcaagctgccccaggccagcaagagcaccagcgagagcttcatccagcacatcgtgtccctggtgcaccacgtgaaggagcagtacttcaagtctgctgccatgaccctgaatgaacgcttcaccagctaccagaaggccacagaggagcacagcacccggcagaagagccctgagatccacagaagaattgacatcagccccagcaccctgaggaagcacacccggctggccggggaggagagggtcttcaaggaggagaaccagaagggggacaagaagctgcgctgtgacagcgctgacctgcggcatgacatcgacagaagaaggaaggagaggagcaaggagcggggggacagcaagggcagccgggagagcagcggcagcaggaagcaggagaagacccccaaggactacaaggagtacaagagctacaaggatgacagcaagcacaagcgggagcaggaccacagccgcagcagcagcagcagcgccagccccagcagccccagcagccgggaggagaaggagagcaagaaggagcgggaggaggagttcaagacccaccacgagatgaaggagtacagcggctttgctggggtgtcccggccccggggcaccttcttccgcatccggggccggggccgggcccggggcgtgtttgctggcaccaacacaggccccaacaacagcaacaccaccttccagaagaggcccaaggaggaggagtgggaccctgagtacacccccaagagcaagaagtacttcctgcatgatgacagagatgatggagtggactactgggccaagaggggccggggccggggcaccttccagaggggccggggccgcttcaacttcaagaagagcggcagcagccccaagtggacccatgacaagtaccagggagatggcatcgtggaggatgaggaggagaccatggagaacaatgaggagaagaaggacaggaggaaggaggagaaggagtag

SEQ ID NO: 145079 - DNA, 2763 bp, Artificial Sequence
  Description of Artificial Sequence: Synthetic coding sequence
atgggccgcagcaacagccgcagccacagcagccgcagcaagagccgcagccagagcagcagccgcagccgcagccgcagccacagcaggaagaagcgctacagcagccgcagccgcagcaggacctacagccgcagccgcagccgggacaggatgtacagccgggactaccgccgggactacagaaacaacagaggcatgaggcggccctacggctaccggggccggggccggggctactaccagggcggcggcggccgctaccacagaggaggctacagacctgtgtggaacagaagacacagccgcagcccccggcggggccgcagccgcagccgcagccccaagagaagatctgtgagcagccagaggagccgcagccgcagccgccgcagctaccgcagcagccgcagccccaggagcagcagcagccgcagcagcagcccctacagcaagagccctgtgtccaagaggcggggcagccaggagaagcagaccaagaaggccgagggggagccccaggaggagagccccctgaagagcaagagccaggaggagcccaaggacacctttgaacatgaccccagcgagagcattgatgagttcaacaagagcagcgccaccagcggggacatctggccaggcctgagcgcctatgacaacagccccaggagcccccacagccccagccccatcgccaccccacccagccagagcagcagctgcagtgatgcccccatgctgagcacagtgcacagcgccaagaacacccccagccagcacagccacagcatccagcacagccctgagaggagcggcagcggctctgtgggcaatggcagcagccgctacagccccagccagaacagccccatccaccacatccccagccgccgcagccctgccaagaccatcgccccccagaatgcccccagagatgagagccggggccgcagcagcttctacccagatggaggagaccaggagacagccaagacaggcaagttcctgaagcgcttcacagatgaggagagcagggtcttcctgctggaccggggcaacacccgggacaaggaggccagcaaggagaagggcagcgagaagggccgggcagagggggagtgggaggaccaggaggccctggactacttcagtgacaaggagagcggcaagcagaagttcaatgattctgaaggagatgacacagaggagacagaggactaccggcagttcaggaagtctgtgctggccgaccagggcaagagctttgccacagccagccacaggaacacagaggaggagggcctgaagtacaagagcaaggtgtccctgaagggcaaccgggagagtgatggcttccgggaggagaagaactacaagctgaaggagaccggctacgtggtggagcggcccagcaccaccaaggacaagcacaaggaggaggacaagaacagcgagcgcatcaccgtgaagaaggagacccagagccctgagcaggtgaagtctgagaagctgaaggacctgtttgactacagcccccccctgcacaagaacctggatgcccgggagaagagcaccttccgggaggagagccccctgcgcatcaagatgattgccagtgacagccacaggcctgaggtgaagctgaagatggcccctgtgcccctggatgacagcaacagacctgccagcctgaccaaggaccggctgctggccagcaccctggtgcacagcgtgaagaaggagcaggagttccgcagcatctttgaccacatcaagctgccccaggccagcaagagcaccagcgagagcttcatccagcacatcgtgtccctggtgcaccacgtgaaggagcagtacttcaagtctgctgccatgaccctgaatgaacgcttcaccagctaccagaaggccacagaggagcacagcacccggcagaagagccctgagatccacagaagaattgacatcagccccagcaccctgaggaagcacacccggctggccggggaggagagggtcttcaaggaggagaaccagaagggggacaagaagctgcgctgtgacagcgctgacctgcggcatgacatcgacagaagaaggaaggagaggagcaaggagcggggggacagcaagggcagccgggagagcagcggcagcaggaagcaggagaagacccccaaggactacaaggagtacaagagctacaaggatgacagcaagcacaagcgggagcaggaccacagccgcagcagcagcagcagcgccagccccagcagccccagcagccgggaggagaaggagagcaagaaggagcgggaggaggagttcaagacccaccacgagatgaaggagtacagcggctttgctggggtgtcccggccccggggcaccttcttccgcatccggggccggggccgggcccggggcgtgtttgctggcaccaacacaggccccaacaacagcaacaccaccttccagaagaggcccaaggaggaggagtgggaccctgagtacacccccaagagcaagaagtacttcctgcatgatgacagagatgatggagtggactactgggccaagaggggccggggccggggcaccttccagaggggccggggccgcttcaacttcaagaagagcggcagcagccccaagtggacccatgacaagtaccagggagatggcatcgtggaggatgaggaggagaccatggagaacaatgaggagaagaaggacaggaggaaggaggagaaggagtag

SEQ ID NO: 145080 - DNA, 531 bp, Artificial Sequence
  Description of Artificial Sequence: Synthetic coding sequence
atgggccggcctgctggcctcttcccccccctgtgccccttcctgggcttccggcctgaggcctgctgggagcggcacatgcagatcgagcgggcccccagcgtgccccccttcctgcgctgggccggctaccggcccggccctgtgagaagaagaggcaaggtggagctgatcaagtttgtgcgggtgcagtggaggcggccccaggtggagtggaggagaagacgctggggccctggccctggggcctccatggccggcagcgaggagctgggcctgcgggaggacaccctgcgggtgctggccgccttcctgcggcggggggaggccgccggcagccctgtgcccaccccaccccggcccagctacagccggctgctgtgctttggaggccctgctgctggaacagctggccccagggctgctgagatcagcgcccagccccgcatcaccggcagccccatcgaccgggagggcagccacacagctgaggccggcggccctgctgggggcggcggccgcagccactag

SEQ ID NO: 145081 - DNA, 1005 bp, Artificial Sequence
  Description of Artificial Sequence: Synthetic coding sequence
atgggccggcctgctggcctcttcccccccctgtgccccttcctgggcttccggcctgaggcctgctgggagcggcacatgcagatcgagcgggcccccagcgtgccccccttcctgcgctgggccggctaccggcccggccctgtgagaagaagaggcaaggtggagctgatcaagtttgtgcgggtgcagtggaggcggccccaggtggagtggaggagaagacgctggggccctggccctggggcctccatggccggcagcgaggagctgggcctgcgggaggacaccctgcgggtgctggccgccttcctgcggcggggggaggccgccggcagccctgtgcccaccccacccaggagccctgcccaggaggagcccacagacttcctgagccggctgcggcgctgcctgccctgcagcctgggccgcggggccgcccccagcgagagcccccggccctgcagcctgcccatccggccctgctacggcctggagcccggccctgccaccccagacttctacgccctggtggcccagaggctggagcagctggtgcaggagcagctgaagagcccccccagccctgagctgcagggcccccccagcacagagaaggaggccatcctgcggcggctggtggccctgctggaggaggaggccgaggtgatcaaccagaagctggccagtgaccctgccctgcggagcaagctggtgcggctgagcagtgacagctttgcccggctggtggagctgttctgcagcagagatgacagcagccggcccagccgggcctgccccggccccccaccacccagccctgagcccctggcccggctggccctggccatggagctgagccggcgggtggccggcctgggcggcaccctggccggcctgtctgtggagcacgtgcacagcttcaccccctggatccaggcccatggaggctgggagggcatcctggccgtgtcccctgtggacctgaacctgcccctggactag

SEQ ID NO: 145082 - DNA, 1002 bp, Artificial Sequence
  Description of Artificial Sequence: Synthetic coding sequence
atgggccggcctgctggcctcttcccccccctgtgccccttcctgggcttccggcctgaggcctgctgggagcggcacatgcagatcgagcgggcccccagcgtgccccccttcctgcgctgggccggctaccggcccggccctgtgagaagaagaggcaaggtggagctgatcaagtttgtgcgggtgcagtggaggcggccccaggtggagtggaggagaagacgctggggccctggccctggggcctccatggccggcagcgaggagctgggcctgcgggaggacaccctgcgggtgctggccgccttcctgcggcggggggaggccgccggcagccctgtgcccaccccacccagccctgcccaggaggagcccacagacttcctgagccggctgcggcgctgcctgccctgcagcctgggcagaggagctgcccccagcgagagcccccggccctgcagcctgcccatccggccctgctacggcctggagcccggccctgccaccccagacttctacgccctggtggcccagaggctggagcagctggtgcaggagcagctgaagagcccccccagccctgagctgcagggcccccccagcacagagaaggaggccatcctgcggcggctggtggccctgctggaggaggaggccgaggtgatcaaccagaagctggccagtgaccctgccctgcggagcaagctggtgcggctgagcagtgacagctttgcccggctggtggagctgttctgcagcagagatgacagcagccggcccagccgggcctgccccggccccccaccacccagccctgagcccctggcccggctggccctggccatggagctgagcagaagagtggccggcctgggcggcaccctggccggcctgtctgtggagcacgtgcacagcttcaccccctggatccaggcccacggcggctgggagggcatcctggccgtgtcccctgtggacctgaacctgcccctggactag

SEQ ID NO: 145083 - DNA, 5166 bp, Artificial Sequence
  Description of Artificial Sequence: Synthetic coding sequence
atgctgagcgccacccccctgtatggaaatgtgcacagctggatgaacagcgagcgggtgaggatgtgtggggccagcgaggacaggaagatcctggtgaatgatggagatgccagcaaggcccggctggagctgcgggaggagaaccccctgaaccacaacgtggtggatgccagcacagcccacagaattgatggcctggccgccctgtccatggacagaacaggcctcatccgggagggcctgcgggtgcccggcaacatcgtgtacagcagcctgtgtggcctgggcagcgagaagggccgggaggccgccaccagcaccctgggcggcctgggcttcagcagcgagaggaaccctgagatgcagttcaagcccaacaccccagagaccgtggaggccagcgctgtgtctgggaagcccccaaatggcttcagcgccatctacaagaccccacctggcatccagaagtctgctgtggccacagctgaggccctgggcctggacaggcctgccagtgacaagcagagccccctgaacatcaacggggccagctacctgcggctgccctgggtgaacccctacatggagggcgccaccccagccatctaccccttcctggacagccccaacaagtacagcctgaacatgtacaaggccctgctgccccagcagagctacagcctggcccagcccctgtacagccctgtgtgcaccaacggggagcgcttcctgtacctgcccccaccccactacgtgggcccccacatccccagcagcctggccagccccatgaggctgagcaccccatctgccagccctgccatcccccccctggtgcactgtgccgacaagagcctgccctggaagatgggcgtgtccccaggcaaccctgtggacagccacgcctacccccacatccagaacagcaagcagccccgggtgcccagcgccaaggctgtgaccagcggcctgcccggggacacagccctgctgctgccccccagcccccggcccagcccccgggtgcacctgcccacccagcctgctgctgacacctacagcgagttccacaagcactacgcccgcatcagcaccagccccagcgtggccctgagcaagccctacatgacagtgtcctctgagttccctgctgcccggctgagcaatggcaagtaccccaaggcccctgagggcggggagggcgcccagcctgtgcccggccacgccaggaagacagctgtgcaggacaggaaggatggcagcagcccccccctgctggagaagcagacagtgaccaaggatgtgacagacaagcccctggacctgagcagcaaggtggtggatgtggatgccagcaaggctgaccacatgaagaagatggcccccaccgtgctggtgcacagcagagctggcagcggcctggtgctgagcggcagcgagatccccaaggagaccctgagccccccaggaaatggctgtgccatctacagaagtgagatcatcagcacagcccccagctcctgggtggtgcccggccccagccccaatgaagaaaataatggcaagtccatgagcctgaagaacaaggccctggactgggccatcccccagcagaggagcagcagctgccccaggatgggcggcacagatgctgtgatcaccaacgtgtctggctctgtgtcctctgctggccgcccagccagcgccagccctgccccaaatgccaatgctgatggcaccaagaccagccgcagctctgtggagaccaccccatctgtcatccagcacgtgggccagcccccagccaccccagccaagcacagcagcagcaccagcagcaaaggagccaaggccagcaaccctgagcccagcttcaaggccaatgaaaatggcctgccccccagcagcatcttcctgagccccaatgaggccttccgcagcccccccatcccctaccccaggagctacctgccctacccagcccctgagggcattgctgtgagccccctgagcctgcacggcaagggccctgtgtacccccaccctgtgctgctgcccaacggcagcctcttccctggccacctggcccccaagccaggcctgccctacggcctgcccaccggccggcctgagtttgtgacctaccaggatgccctgggcctgggcatggtgcaccccatgctgatcccccacacccccatcgagatcaccaaggaggagaagccagagaggaggagccgcagccatgagcgggcccgctatgaggaccccaccctgaggaaccgcttcagcgagatcctggagaccagcagcaccaagctgcacccagatgtgcccacagacaagaacctgaagcccaaccccaactggaaccagggcaagacagtggtgaagagtgacaagctggtgtatgtggacctgctgcgggaggagccagatgccaagacagacaccaacgtgtccaagcccagctttgctgctgagagcgtgggccagagcgctgagccccccaagcccagcgtggagcccgccctgcagcagcaccgggacttcatcgccctgcgggaggagctgggccgcatcagtgacttccacgagacctacaccttcaagcagcccgtcttcaccgtgtccaaggacagcgtgctggccggcaccaacaaggagaacctgggcctgcctgtgtccacccccttcctggagccccccctgggcagtgatggccctgctgtgaccttcggcaagacccaggaggaccccaagcccttctgtgtgggcagcgccccacccagcgtggatgtgacccccacctacaccaaggatggagcagatgaagctgagagcaatgatggcaaggtgctgaagcccaagcccagcaagctggccaagagaattgccaacagcgctggctacgtgggggaccgcttcaagtgtgtgaccacagagctgtatgctgacagcagccagctgagccgggagcagagggccctgcagatggagggcctgcaggaggacagcatcctgtgcctgcctgctgcctactgtgagcgggccatgatgaggttcagcgagctggagatgaaggagcgggagggcggccacccagccaccaaggacagcgagatgtgcaagttcagccctgctgactgggagcggctgaagggcaaccaggacaagaagcccaagtctgtgaccctggaggaggccatcgccgagcagaatgaaagtgagcgctgtgagtacagcgtgggcaacaagcaccgggacccctttgaggcccctgaggacaaggacctgcctgtggagaagtactttgtggagcggcagcctgtgtctgagcccccagctgaccaggtggccagtgacatgccccacagccccaccctgcgggtggacaggaagaggaaggtgtctggggacagcagccacacagagaccacagctgaggaggtgcctgaggaccccctgctgaaggccaagagaagaagagtgtccaagggcctgcaccccaagaagcagaggcacctgctgcacctgcgggagcgctgggagcagcaggtgtctgctgctgatggcaagccaggccggcagagcaggaaggaggtgacccaggccacccagcctgaggccatcccccagggcaccaacatcacagaggagaagccaggcaggaagagagctgaggccaagggcaacagatcctggagcgaggagagcctgaagcccagcgacaatgagcagggcctgcctgtgttcagcggcagcccccccatgaagagcctgagcagcaccagcgctgggggcaagaagcaggcccagcccagctgtgccccagccagccggcccccagccaagcagcagaagatcaaggagaaccagaagacagatgtgctgtgtgctgatgaggaggaggactgccaggccgccagcctgctgcagaagtacacagacaacagcgagaagcccagcggcaagaggctgtgcaagaccaagcacctgatcccccaggagagccggcggggcctgcccctgaccggggagtactacgtggagaatgctgatggcaaggtgacagtgcggcgcttcaggaagaggcctgagcccagcagtgactatgacctgagccctgccaagcaggagcccaagccctttgaccggctgcagcagctgctgcctgccagccagagcacccagctgccctgcagcagcagcccccaggagaccacccagagccggcccatgcctcctgaggcccggcggctgattgtgaacaagaatgctggggagaccctgctgcagagagctgcccggctgggctatgaggaggtggtgctgtactgcctggagaacaagatctgtgatgtgaaccaccgggacaatgccggctactgtgccctgcacgaggcctgtgcccggggctggctgaacatcgtgcgccacctgctggagtatggagcagatgtgaactgcagcgcccaggacggcacccggcccctgcatgatgctgtggagaatgaccacctggagatcgtgcggctgctgctgtcctatggagctgaccccaccctggccacctacagcggccgcaccatcatgaagatgacccacagcgagctgatggagaagttcctgacagactacctgaatgacctgcagggcagaaatgatgatgatgccagcggcacctgggacttctacggcagctctgtgtgtgagccagatgatgagagcggctatgatgtgctggccaaccccccaggccctgaggaccaggatgatgatgatgatgcctacagtgatgtgtttgaatttgagttcagcgagacccccctgctgccctgctacaacatccaggtgtctgtggcccagggccccaggaactggctgctgctgagtgatgtgctgaagaagctgaagatgagcagccgcatcttccgctgcaacttccccaacgtggagatcgtgaccatcgccgaggccgagttctaccggcaggtgtctgccagcctgctcttcagctgcagcaaggacctggaggccttcaaccctgagagcaaggagctgctggacctggtggagttcaccaatgagatccagaccctgctgggcagctctgtggagtggctgcaccccagcgacctggccagtgacaactactggtag

SEQ ID NO: 145084 - DNA, 5268 bp, Artificial Sequence
  Description of Artificial Sequence: Synthetic coding sequence
atgctgagcgccacccccctgtatggaaatgtgcacagctggatgaacagcgagcgggtgaggatgtgtggggccagcgaggacaggaagatcctggtgaatgatggagatgccagcaaggcccggctggagctgcgggaggagaaccccctgaaccacaacgtggtggatgccagcacagcccacagaattgatggcctggccgccctgtccatggacagaacaggcctcatccgggagggcctgcgggtgcccggcaacatcgtgtacagcagcctgtgtggcctgggcagcgagaagggccgggaggccgccaccagcaccctgggcggcctgggcttcagcagcgagaggaaccctgagatgcagttcaagcccaacaccccagagaccgtggaggccagcgctgtgtctgggaagcccccaaatggcttcagcgccatctacaagaccccacctggcatccagaagtctgctgtggccacagctgaggccctgggcctggacaggcctgccagtgacaagcagagccccctgaacatcaacggggccagctacctgcggctgccctgggtgaacccctacatggagggcgccaccccagccatctaccccttcctggacagccccaacaagtacagcctgaacatgtacaaggccctgctgccccagcagagctacagcctggcccagcccctgtacagccctgtgtgcaccaacggggagcgcttcctgtacctgcccccaccccactacgtgggcccccacatccccagcagcctggccagccccatgaggctgagcaccccatctgccagccctgccatcccccccctggtgcactgtgccgacaagagcctgccctggaagatgggcgtgtccccaggcaaccctgtggacagccacgcctacccccacatccagaacagcaagcagccccgggtgcccagcgccaaggctgtgaccagcggcctgcccggggacacagccctgctgctgccccccagcccccggcccagcccccgggtgcacctgcccacccagcctgctgctgacacctacagcgagttccacaagcactacgcccgcatcagcaccagccccagcgtggccctgagcaagccctacatgacagtgtcctctgagttccctgctgcccggctgagcaatggcaagtaccccaaggcccctgagggcggggagggcgcccagcctgtgcccggccacgccaggaagacagctgtgcaggacaggaaggatggcagcagcccccccctgctggagaagcagacagtgaccaaggatgtgacagacaagcccctggacctgagcagcaaggtggtggatgtggatgccagcaaggctgaccacatgaagaagatggcccccaccgtgctggtgcacagcagagctggcagcggcctggtgctgagcggcagcgagatccccaaggagaccctgagccccccaggaaatggctgtgccatctacagaagtgagatcatcagcacagcccccagctcctgggtggtgcccggccccagccccaatgaagaaaataatggcaagtccatgagcctgaagaacaaggccctggactgggccatcccccagcagaggagcagcagctgccccaggatgggcggcacagatgctgtgatcaccaacgtgtctggctctgtgtcctctgctggccgcccagccagcgccagccctgccccaaatgccaatgctgatggcaccaagaccagccgcagctctgtggagaccaccccatctgtcatccagcacgtgggccagcccccagccaccccagccaagcacagcagcagcaccagcagcaaaggagccaaggccagcaaccctgagcccagcttcaaggccaatgaaaatggcctgccccccagcagcatcttcctgagccccaatgaggccttccgcagcccccccatcccctaccccaggagctacctgccctacccagcccctgagggcattgctgtgagccccctgagcctgcacggcaagggccctgtgtacccccaccctgtgctgctgcccaacggcagcctcttccctggccacctggcccccaagccaggcctgccctacggcctgcccaccggccggcctgagtttgtgacctaccaggatgccctgggcctgggcatggtgcaccccatgctgatcccccacacccccatcgagatcaccaaggaggagaagccagagaggaggagccgcagccatgagcgggcccgctatgaggaccccaccctgaggaaccgcttcagcgagatcctggagaccagcagcaccaagctgcacccagatgtgcccacagacaagaacctgaagcccaaccccaactggaaccagggcaagacagtggtgaagagtgacaagctggtgtatgtggacctgctgcgggaggagccagatgccaagacagacaccaacgtgtccaagcccagctttgctgctgagagcgtgggccagagcgctgagccccccaagcccagcgtggagcccgccctgcagcagcaccgggacttcatcgccctgcgggaggagctgggccgcatcagtgacttccacgagacctacaccttcaagcagcccgtcttcaccgtgtccaaggacagcgtgctggccggcaccaacaaggagaacctgggcctgcctgtgtccacccccttcctggagccccccctgggcagtgatggccctgctgtgaccttcggcaagacccaggaggaccccaagcccttctgtgtgggcagcgccccacccagcgtggatgtgacccccacctacaccaaggatggagcagatgaagctgagagcaatgatggcaaggtgctgaagcccaagcccagcaagctggccaagagaattgccaacagcgctggctacgtgggggaccgcttcaagtgtgtgaccacagagctgtatgctgacagcagccagctgagccgggagcagagggccctgcagatggagggcctgcaggaggacagcatcctgtgcctgcctgctgcctactgtgagcgggccatgatgaggttcagcgagctggagatgaaggagcgggagggcggccacccagccaccaaggacagcgagatgtgcaagttcagccctgctgactgggagcggctgaagggcaaccaggacaagaagcccaagtctgtgaccctggaggaggccatcgccgagcagaatgaaagtgagcgctgtgagtacagcgtgggcaacaagcaccgggacccctttgaggcccctgaggacaaggacctgcctgtggagaagtactttgtggagcggcagcctgtgtctgagcccccagctgaccaggtggccagtgacatgccccacagccccaccctgcgggtggacaggaagaggaaggtgtctggggacagcagccacacagagaccacagctgaggaggtgcctgaggaccccctgctgaaggccaagagaagaagagtgtccaaggatgactggccagagcgggagatgaccaacagcagcagcaaccacctggaggacccccactacagcgagctgaccaacctgaaggtgtgcatcgagctgaccggcctgcaccccaagaagcagaggcacctgctgcacctgcgggagcgctgggagcagcaggtgtctgctgctgatggcaagccaggccggcagagcaggaaggaggtgacccaggccacccagcctgaggccatcccccagggcaccaacatcacagaggagaagccaggcaggaagagagctgaggccaagggcaacagatcctggagcgaggagagcctgaagcccagcgacaatgagcagggcctgcctgtgttcagcggcagcccccccatgaagagcctgagcagcaccagcgctgggggcaagaagcaggcccagcccagctgtgccccagccagccggcccccagccaagcagcagaagatcaaggagaaccagaagacagatgtgctgtgtgctgatgaggaggaggactgccaggccgccagcctgctgcagaagtacacagacaacagcgagaagcccagcggcaagaggctgtgcaagaccaagcacctgatcccccaggagagccggcggggcctgcccctgaccggggagtactacgtggagaatgctgatggcaaggtgacagtgcggcgcttcaggaagaggcctgagcccagcagtgactatgacctgagccctgccaagcaggagcccaagccctttgaccggctgcagcagctgctgcctgccagccagagcacccagctgccctgcagcagcagcccccaggagaccacccagagccggcccatgcctcctgaggcccggcggctgattgtgaacaagaatgctggggagaccctgctgcagagagctgcccggctgggctatgaggaggtggtgctgtactgcctggagaacaagatctgtgatgtgaaccaccgggacaatgccggctactgtgccctgcacgaggcctgtgcccggggctggctgaacatcgtgcgccacctgctggagtatggagcagatgtgaactgcagcgcccaggacggcacccggcccctgcatgatgctgtggagaatgaccacctggagatcgtgcggctgctgctgtcctatggagctgaccccaccctggccacctacagcggccgcaccatcatgaagatgacccacagcgagctgatggagaagttcctgacagactacctgaatgacctgcagggcagaaatgatgatgatgccagcggcacctgggacttctacggcagctctgtgtgtgagccagatgatgagagcggctatgatgtgctggccaaccccccaggccctgaggaccaggatgatgatgatgatgcctacagtgatgtgtttgaatttgagttcagcgagacccccctgctgccctgctacaacatccaggtgtctgtggcccagggccccaggaactggctgctgctgagtgatgtgctgaagaagctgaagatgagcagccgcatcttccgctgcaacttccccaacgtggagatcgtgaccatcgccgaggccgagttctaccggcaggtgtctgccagcctgctcttcagctgcagcaaggacctggaggccttcaaccctgagagcaaggagctgctggacctggtggagttcaccaatgagatccagaccctgctgggcagctctgtggagtggctgcaccccagcgacctggccagtgacaactactggtag

SEQ ID NO: 145085 - DNA, 5112 bp, Artificial Sequence
  Description of Artificial Sequence: Synthetic coding sequence
atgctgagcgccacccccctgtatggaaatgtgcacagctggatgaacagcgagcgggtgaggatgtgtggggccagcgaggacaggaagatcctggtgaatgatggagatgccagcaaggcccggctggagctgcgggaggagaaccccctgaaccacaacgtggtggatgccagcacagcccacagaattgatggcctggccgccctgtccatggacagaacaggcctcatccgggagggcctgcgggtgcccggcaacatcgtgtacagcagcctgtgtggcctgggcagcgagaagggccgggaggccgccaccagcaccctgggcggcctgggcttcagcagcgagaggaaccctgagatgcagttcaagcccaacaccccagagaccgtggaggccagcgctgtgtctgggaagcccccaaatggcttcagcgccatctacaagaccccacctggcatccagaagtctgctgtggccacagctgaggccctgggcctggacaggcctgccagtgacaagcagagccccctgaacatcaacggggccagctacctgcggctgccctgggtgaacccctacatggagggcgccaccccagccatctaccccttcctggacagccccaacaagtacagcctgaacatgtacaaggccctgctgccccagcagagctacagcctggcccagcccctgtacagccctgtgtgcaccaacggggagcgcttcctgtacctgcccccaccccactacgtgggcccccacatccccagcagcctggccagccccatgaggctgagcaccccatctgccagccctgccatcccccccctggtgcactgtgccgacaagagcctgccctggaagatgggcgtgtccccaggcaaccctgtggacagccacgcctacccccacatccagaacagcaagcagccccgggtgcccagcgccaaggctgtgaccagcggcctgcccggggacacagccctgctgctgccccccagcccccggcccagcccccgggtgcacctgcccacccagcctgctgctgacacctacagcgagttccacaagcactacgcccgcatcagcaccagccccagcgtggccctgagcaagccctacatgacagtgtcctctgagttccctgctgcccggctgagcaatggcaagtaccccaaggcccctgagggcggggagggcgcccagcctgtgcccggccacgccaggaagacagctgtgcaggacaggaaggatggcagcagcccccccctgctggagaagcagacagtgaccaaggatgtgacagacaagcccctggacctgagcagcaaggtggtggatgtggatgccagcaaggctgaccacatgaagaagatggcccccaccgtgctggtgcacagcagagctggcagcggcctggtgctgagcggcagcgagatccccaaggagaccctgagccccccaggaaatggctgtgccatctacagaagtgagatcatcagcacagcccccagctcctgggtggtgcccggccccagccccaatgaagaaaataatggcaagtccatgagcctgaagaacaaggccctggactgggccatcccccagcagaggagcagcagctgccccaggatgggcggcacagatgctgtgatcaccaacgtgtctggctctgtgtcctctgctggccgcccagccagcgccagccctgccccaaatgccaatgctgatggcaccaagaccagccgcagctctgtggagaccaccccatctgtcatccagcacgtgggccagcccccagccaccccagccaagcacagcagcagcaccagcagcaaaggagccaaggccagcaaccctgagcccagcttcaaggccaatgaaaatggcctgccccccagcagcatcttcctgagccccaatgaggccttccgcagcccccccatcccctaccccaggagctacctgccctacccagcccctgagggcattgctgtgagccccctgagcctgcacggcaagggccctgtgtacccccaccctgtgctgctgcccaacggcagcctcttccctggccacctggcccccaagccaggcctgccctacggcctgcccaccggccggcctgagtttgtgacctaccaggatgccctgggcctgggcatggtgcaccccatgctgatcccccacacccccatcgagatcaccaaggaggagaagccagagaggaggagccgcagccatgagcgggcccgctatgaggaccccaccctgaggaaccgcttcagcgagatcctggagaccagcagcaccaagctgcacccagatgtgcccacagacaagaacctgaagcccaaccccaactggaaccagggcaagacagtggtgaagagtgacaagctggtgtatgtggacctgctgcgggaggagccagatgccaagacagacaccaacgtgtccaagcccagctttgctgctgagagcgtgggccagagcgctgagccccccaagcccagcgtggagcccgccctgcagcagcaccgggacttcatcgccctgcgggaggagctgggccgcatcagtgacttccacgagacctacaccttcaagcagcccgtcttcaccgtgtccaaggacagcgtgctggccggcaccaacaaggagaacctgggcctgcctgtgtccacccccttcctggagccccccctgggcagtgatggccctgctgtgaccttcggcaagacccaggaggaccccaagcccttctgtgtgggcagcgccccacccagcgtggatgtgacccccacctacaccaaggatggagcagatgaagctgagagcaatgatggcaaggtgctgaagcccaagcccagcaagctggccaagagaattgccaacagcgctggctacgtgggggaccgcttcaagtgtgtgaccacagagctgtatgctgacagcagccagctgagccgggagcagagggccctgcagagggccatgatgaggttcagcgagctggagatgaaggagcgggagggcggccacccagccaccaaggacagcgagatgtgcaagttcagccctgctgactgggagcggctgaagggcaaccaggacaagaagcccaagtctgtgaccctggaggaggccatcgccgagcagaatgaaagtgagcgctgtgagtacagcgtgggcaacaagcaccgggacccctttgaggcccctgaggacaaggacctgcctgtggagaagtactttgtggagcggcagcctgtgtctgagcccccagctgaccaggtggccagtgacatgccccacagccccaccctgcgggtggacaggaagaggaaggtgtctggggacagcagccacacagagaccacagctgaggaggtgcctgaggaccccctgctgaaggccaagagaagaagagtgtccaagggcctgcaccccaagaagcagaggcacctgctgcacctgcgggagcgctgggagcagcaggtgtctgctgctgatggcaagccaggccggcagagcaggaaggaggtgacccaggccacccagcctgaggccatcccccagggcaccaacatcacagaggagaagccaggcaggaagagagctgaggccaagggcaacagatcctggagcgaggagagcctgaagcccagcgacaatgagcagggcctgcctgtgttcagcggcagcccccccatgaagagcctgagcagcaccagcgctgggggcaagaagcaggcccagcccagctgtgccccagccagccggcccccagccaagcagcagaagatcaaggagaaccagaagacagatgtgctgtgtgctgatgaggaggaggactgccaggccgccagcctgctgcagaagtacacagacaacagcgagaagcccagcggcaagaggctgtgcaagaccaagcacctgatcccccaggagagccggcggggcctgcccctgaccggggagtactacgtggagaatgctgatggcaaggtgacagtgcggcgcttcaggaagaggcctgagcccagcagtgactatgacctgagccctgccaagcaggagcccaagccctttgaccggctgcagcagctgctgcctgccagccagagcacccagctgccctgcagcagcagcccccaggagaccacccagagccggcccatgcctcctgaggcccggcggctgattgtgaacaagaatgctggggagaccctgctgcagagagctgcccggctgggctatgaggaggtggtgctgtactgcctggagaacaagatctgtgatgtgaaccaccgggacaatgccggctactgtgccctgcacgaggcctgtgcccggggctggctgaacatcgtgcgccacctgctggagtatggagcagatgtgaactgcagcgcccaggacggcacccggcccctgcatgatgctgtggagaatgaccacctggagatcgtgcggctgctgctgtcctatggagctgaccccaccctggccacctacagcggccgcaccatcatgaagatgacccacagcgagctgatggagaagttcctgacagactacctgaatgacctgcagggcagaaatgatgatgatgccagcggcacctgggacttctacggcagctctgtgtgtgagccagatgatgagagcggctatgatgtgctggccaaccccccaggccctgaggaccaggatgatgatgatgatgcctacagtgatgtgtttgaatttgagttcagcgagacccccctgctgccctgctacaacatccaggtgtctgtggcccagggccccaggaactggctgctgctgagtgatgtgctgaagaagctgaagatgagcagccgcatcttccgctgcaacttccccaacgtggagatcgtgaccatcgccgaggccgagttctaccggcaggtgtctgccagcctgctcttcagctgcagcaaggacctggaggccttcaaccctgagagcaaggagctgctggacctggtggagttcaccaatgagatccagaccctgctgggcagctctgtggagtggctgcaccccagcgacctggccagtgacaactactggtag

SEQ ID NO: 145086 - DNA, 1869 bp, Artificial Sequence
  Description of Artificial Sequence: Synthetic coding sequence
atgccccacagccccaccctgcgggtggacaggaagaggaaggtgtctggggacagcagccacacagagaccacagctgaggaggtgcctgaggaccccctgctgaaggccaagagaagaagagtgtccaagggcctgcaccccaagaagcagaggcacctgctgcacctgcgggagcgctgggagcagcaggtgtctgctgctgatggcaagccaggccggcagagcaggaaggaggtgacccaggccacccagcctgaggccatcccccagggcaccaacatcacagaggagaagccaggcaggaagagagctgaggccaagggcaacagatcctggagcgaggagagcctgaagcccagcgacaatgagcagggcctgcccgtcttcagcggcagcccccccatgaagagcctgagcagcaccagcgctgggggcaagaagcaggcccagcccagctgtgccccagccagccggcccccagccaagcagcagaagatcaaggagaaccagaagacagatgtgctgtgtgctgatgaggaggaggactgccaggccgccagcctgctgcagaagtacacagacaacagcgagaagcccagcggcaagaggctgtgcaagaccaagcacctgatcccccaggagagcagaagaggcctgcccctgactggagagtactacgtggagaatgctgatggcaaggtgacagtgcggcgcttcaggaagaggcctgagcccagcagtgactatgacctgagccctgccaagcaggagcccaagccctttgaccggctgcagcagctgctgcctgccagccagagcacccagctgccctgcagcagcagcccccaggagaccacccagagccggcccatgcctcctgaggcccggcggctcatcgtgaacaagaatgctggggagaccctgctgcagagagctgcccggctgggctatgaggaggtggtgctgtactgcctggagaacaagatctgtgatgtgaaccaccgggacaatgccggctactgtgccctgcacgaggcctgtgcccggggctggctgaacatcgtgcgccacctgctggagtatggagcagatgtgaactgcagcgcccaggacggcacccggcccctgcatgatgctgtggagaatgaccacctggagatcgtgcggctgctgctgtcctatggagctgaccccaccctggccacctacagcggccgcaccatcatgaagatgacccacagcgagctgatggagaagttcctgacagactacctgaatgacctgcagggcagaaatgatgatgatgccagcggcacctgggacttctacggcagctctgtgtgtgagccagatgatgaaagtggctatgatgtgctggccaaccccccaggccctgaggaccaggatgatgatgatgatgcctacagtgatgtgtttgaatttgagttcagcgagacccccctgctgccctgctacaacatccaggtgtctgtggcccagggccccaggaactggctgctgctgagtgatgtgctgaagaagctgaagatgagcagccgcatcttccgctgcaacttccccaacgtggagatcgtgaccatcgccgaggccgagttctaccggcaggtgtctgccagcctgctcttcagctgcagcaaggacctggaggccttcaaccctgagagcaaggagctgctggacctggtggagttcaccaatgagatccagaccctgctgggcagctctgtggagtggctgcaccccagcgacctggccagtgacaactactggaagagcccccagatcgcccggggctctgtggagggcaagaagacagatgacaagaccagcaagacagacctgtag

SEQ ID NO: 145087 - DNA, 5166 bp, Artificial Sequence; identical to SEQ ID NO: 145083
  Description of Artificial Sequence: Synthetic coding sequence

SEQ ID NO: 145088 - DNA, 87 bp, Artificial Sequence
  Description of Artificial Sequence: Synthetic coding sequence
atgctgagcgccacccccctgtatggaaatgtgcacagctggatgaacagcgagcgggtgaggatgtgtggggcctctgaagattag

SEQ ID NO: 145089 - DNA, 1236 bp, Artificial Sequence
  Description of Artificial Sequence: Synthetic coding sequence
atgaccaggcctgccttccagcccccagccaccccagccaagcacagcagcagcaccagcagcaagggggccaaggccagcaaccctgagcccagcttcaaggccaatgaaaatggcctgccccccagcagcatcttcctgagccccaatgaggccttccgcagcccccccatcccctaccccaggagctacctgccctacccagcccctgagggcattgctgtgagccccctgagcctgcatggaaaaggacctgtgtacccccaccctgtgctgctgcccaacggcagcctcttccctggccacctggcccccaagccaggcctgccctacggcctgcccaccggccggcctgagtttgtgacctaccaggatgccctgggcctgggcatggtgcaccccatgctgatcccccacacccccatcgagatcaccaaggaggagaagccagagcggcgcagccgcagccatgagcgggcccgctatgaggaccccaccctgaggaaccgcttcagcgagatcctggagaccagcagcaccaagctgcacccagatgtgcccacagacaagaacctgaagcccaaccccaactggaaccagggcaagacagtggtgaagagtgacaagctggtgtatgtggacctgctgcgggaggagccagatgccaagacagacaccaacgtgtccaagcccagctttgctgctgagagcgtgggccagagcgctgagccccccaagcccagcgtggagcccgccctgcagcagcaccgggacttcatcgccctgcgggaggagctgggccgcatcagtgacttccacgagacctacaccttcaagcagcctgtgttcaccgtgtccaaggacagcgtgctggccggcaccaacaaggagaacctgggcctgcctgtgtccacccccttcctggagccccccctgggcagtgatggccctgctgtgaccttcggcaagacccaggaggaccccaagcccttctgtgtgggcagcgcccctccttctgtggatgtgacccccacctacaccaaggatggagcagatgaggccgagagcaatgatggcaaggtgctgaagcccaagcccagcaagctggccaagagaattgccaacagcgctggctacgtgggggaccgcttcaagtgtgtgaccacagagctgtatgctgacagcagccagctgagccgggagcagagggccctgcaggtgtccccacccacctag

SEQ ID NO: 145090 - DNA, 2238 bp, Artificial Sequence
  Description of Artificial Sequence: Synthetic coding sequence
atgcctgtgctgagccggccccggccctggaggggcaacaccctgaagaggacagctgtgctgctggccctggccgcctatggagcccacaaggtgtaccccctggtgcggcagtgcctggccccagcccggggcctgcaggccccagctggggagcccacccaggaggccagcggcgtggccgccgccaaggccggcatgaacagagtcttcctgcagaggctgctgtggctgctgcggctgctcttcccccgggtgctgtgccgggagaccggcctgctggccctgcacagcgctgccctggtgtccaggaccttcctgtctgtgtatgtggcccggctggatggccgcctggcccgctgcatcgtgaggaaggacccccgggccttcggctggcagctgctgcagtggctgctgattgccctgcctgccacctttgtgaacagcgccatccgctacctggagggccagctggccctgtccttccgcagccggctggtggcccacgcctaccgcctgtacttcagccagcagacctactacagagtgagcaacatggatggccgcctgagaaatccagaccagagcctgacagaagatgtggtggcctttgctgcctctgtggcccacctgtacagcaacctgaccaagcccctgctggatgtggccgtgaccagctacaccctgctgcgggccgcccggagcagaggagctggaacagcctggcccagcgccatcgccggcctggtggtgttcctgacagccaacgtgctgcgggccttcagccccaagtttggagagctggtggccgaggaggcccggaggaagggggagctgcgctacatgcacagccgggtggtggccaacagcgaggagatcgccttctacggcggccacgaggtggagctggccctgctgcagaggagctaccaggacctggccagccagatcaacctgatcctgctggagcggctgtggtacgtgatgctggagcagttcctgatgaagtatgtgtggagcgccagcggcctgctgatggtggccgtgcccatcatcacagccaccggctacagcgagagtgatgctgaggccgtgaagaaggccgccctggagaagaaggaggaggagctggtgtctgagaggacagaggccttcaccatcgccaggaacctgctgacagctgctgctgatgccatcgagcgcatcatgagcagctacaaggaggtgacagagctggccggctacacagcccgggtgcatgagatgttccaggtgtttgaagatgtgcagcgctgccacttcaagaggccccgggagctggaggatgcccaggccggcagcggcaccatcggccgctctggagtgcgggtggagggccccctgaagatccggggccaggtggtggatgtggagcagggcatcatctgtgagaacatccccatcgtgaccccatctggagaggtggtggtggccagcctgaacatccgggtggaggagggcatgcacctgctgatcaccggccccaacggctgcggcaagagcagcctcttccgcatcctgggcggcctgtggcccacctatggaggagtgctgtacaagcccccaccccagaggatgttctacatcccccagaggccctacatgtctgtgggcagcctgcgggaccaggtgatctacccagacagcgtggaggacatgcagaggaagggctacagcgagcaggacctggaggccatcctggatgtggtgcacctgcaccacatcctgcagcgggagggcggctgggaggccatgtgtgactggaaggatgtgctgagcggcggggagaagcagagaattggcatggccaggatgttctaccaccggcccaagtatgccctgctggatgagtgcaccagcgctgtgtccattgatgtggagggcaagatcttccaggccgccaaggatgctggcatcgccctgctgagcatcacccaccggcccagcctgtggaagtaccacacccacctgctgcagtttgatggagagggcggctggaagtttgagaagctggacagcgctgcccggctgagcctgacagaggagaagcagaggctggagcagcagctggccggcatccccaagatgcagaggcggctgcaggagctgtgccagatcctgggggaggccgtggccccagcccacgtgcctgcccccagcccccagggccctgggggcctgcagggcgccagcacctag

SEQ ID NO: 145091 - DNA, 5358 bp, Artificial Sequence
  Description of Artificial Sequence: Synthetic coding sequence
atgatcagcacagcccccctgtacagcggcgtgcacaactggaccagcagtgaccgcatccgcatgtgtggcatcaatgaggagcggcgggcccccctgagtgatgaggagagcaccaccggggactgccagcacttcggcagccaggagttctgtgtgagcagcagcttcagcaaggtggagctgacagctgtgggcagcggcagcaatgcccggggagctgaccctgatggcagcgccacagagaagctgggccacaagtctgaggacaagccagatgacccccagcccaagatggactatgctggaaatgtggccgaggccgagggcttcctggtgcccctgagcagccctggagatggcctgaagctgcctgccagtgacagcgctgaggccagcaacagcagagctgactgctcctggacccccctgaacacccagatgagcaagcaggtggactgcagccctgctggggtgaaggccctggacagccggcagggcgtgggggagaagaacaccttcatcctggccaccctgggcactggagtgcctgtggagggcaccctgcccctggtgaccaccaacttcagccccctgcctgcccccatctgccccccagcccctggcagcgcctctgtgccccacagcgtgcctgatgccttccaggtgcccctgtctgtgcctgcccctgtgccccacagcggcctggtgcctgtgcaggtggccacctctgtgcctgcccccagcccccccctggcccctgtgcctgccctggccccagccccacccagcgtgcccaccctcatcagtgacagcaaccccctgtctgtgtctgcctctgtgctggtgcctgtgcctgccagcgccccacccagcggccctgtgcccctgagcgccccagccccagcccccctgtctgtgcctgtgtctgccccacccctggccctgatccaggcccctgtgccccccagcgcccccaccctggtgctggcccctgtgcccacccctgtgctggcccccatgcctgccagcaccccacctgctgccccagccccacccagcgtgcccatgcccacccccacccccagcagcggcccccccagcacccccaccctcatcccagcctttgcccccacccctgtgcctgcccccaccccagcccccatcttcaccccagcccccacccccatgcctgctgccaccccagctgccatccccaccagcgcccccatcccagccagcttcagcctgagccgggtgtgcttccctgctgcccaggccccagccatgcagaaggtgcccctgtccttccagcccggcaccgtgctgacccccagccagcccctggtgtacatccccccacccagctgtggccagcccctgtctgtggccaccctgcccaccaccctgggcgtgagcagcaccctgaccctgcctgtgctgcccagctacctgcaggaccgctgcctgcccggggtgctggccagccctgagctgcggagctacccctatgccttctctgtggcccggcccctgaccagtgacagcaagctggtgtccctggaggtgaaccggctgccctgcaccagccccagcggcagcaccaccacccagcctgccccagatggagtgcccggccccctggccgacaccagcctggtgacagccagcgccaaggtgctgcccaccccccagcccctgctgcctgcccccagcggcagcagcgccccaccccacccagccaagatgcccagcggcacagagcagcagacagagggcacctctgtgaccttcagccccctgaagagccccccccagctggagcgggagatggccagccccccagagtgcagcgagatgcccctggacctgagcagcaagagcaaccggcagaagctgcccctgcccaaccagaggaagaccccacccatgcctgtgctgacccctgtgcacaccagcagcaaggccctgctgagcacagtgctgagccgcagccagaggaccacccaggccgccggcggcaatgtgaccagctgcctgggcagcaccagcagcccctttgtgatcttccctgagatcgtgagaaatggagaccccagcacctgggtgaagaacagcacagccctgatcagcaccatccctggcacctacgtgggcgtggccaaccctgtgcctgccagcctgctgctgaacaaggaccccaacctgggcctgaacagagaccccaggcacctgcccaagcaggagcccatcagcatcatcgaccagggcgagcccaagggcaccggggccacctgtgggaagaagggcagccaggccggggctgagggccagcccagcacagtgaagcgctacaccccagcccgcatcgcccctggcctgcccggctgccagaccaaggagctgagcctgtggaagcccaccggccctgccaacatctacccccgctgcagcgtgaatggcaagcccaccagcacccaggtgctgcctgtgggctggagcccctaccaccaggccagcctgctgagcatcggcatcagcagcgctggccagctgacccccagccagggcgcccccatccggcccacctctgtggtgtctgagttcagcggcgtgcccagcctgagcagcagcgaggccgtgcacggcctgcctgagggccagcccaggcctgggggcagctttgtgcctgagcaggaccctgtgaccaagaacaagacctgcagaattgctgccaagccctatgaggagcaggtgaaccctgtgctgctgaccctgagcccccagacaggcaccctggccctgtctgtgcagcccagcggcggggacatccgcatgaaccagggccctgaggagagcgagagccacctgtgcagcgacagcacccccaagatggagggcccccagggcgcctgtggcctgaagctggccggggacaccaagcccaagaaccaggtgctggccacctacatgagccatgagctggtgctggccaccccccagaacctgcccaagatgcctgagctgcccctgctgccccatgacagccaccccaaggagctgatcctggatgtggtgcccagcagccggcggggcagcagcacagagcggccccagctgggcagccaggtggacctgggccgggtgaagatggagaaggtggatggagatgtggtgttcaacctggccacctgcttccgggcagatggcctgcctgtggccccccagaggggccaggccgaggtgcgggccaaggccggccaggcccgggtgaagcaggagagcgtgggcgtgtttgcctgcaagaacaagtggcagccagatgatgtgacagagagcctgccccccaagaagatgaagtgtgggaaggagaaggacagcgaggagcagcagctgcagccccaggccaaggctgtggtgcgcagcagccaccggcccaagtgcaggaagctgcccagcgacccccaggagagcaccaagaagagccccaggggggccagtgacagcggcaaggagcacaacggggtgcggggcaagcacaagcacaggaagcccaccaagccagagagccagagccctgggaagagagctgacagccatgaggagggcagcctggagaagaaggccaagagcagcttccgggacttcatccctgtggtgctgagcaccaggaccaggagccagagcggcagcatctgcagcagctttgctggcatggctgacagcgacatgggcagccaggaggtgttccccacagaggaggaggaggaggtgacccccaccccagccaagaggaggaaggtgaggaagacccagagggacacccagtaccgcagccaccacgcccaggacaagagcctgctgagccagggccgccgccacctgtggagggcccgggagatgccctggaggacagaagctgcccggcagatgtgggacaccaatgaggaggaggaggaggaggaggaggagggcctgctgaagaggaagaagagaagacggcagaagagcaggaagtaccagacaggagagtacctgacagagcaggaggatgagcagaggaggaagggccgggctgacctgaaggccaggaagcagaagaccagcagcagccagagcctggagcaccggctgaggaacagaaacctgctgctgcccaacaaggtgcagggcatcagtgacagccccaacggcttcctgcccaacaacctggaggagcccgcctgcctggagaacagcgagaagcccagcggcaagaggaagtgcaagaccaagcacatggccaccgtgtctgaggaggccaagggcaagggccgctggagccagcagaagaccaggagccccaagagccccacccctgtgaagcccacagagccctgcacccccagcaagagccgcagcgccagcagcgaggaggccagcgagagccccacagcccggcagatccccccagaggcccggcggctcatcgtgaacaagaatgctggggagaccctgctgcagagagctgcccggctgggctacaaggatgtggtgctgtactgcctgcagaaggacagtgaagatgtgaaccaccgggacaatgccggctacacagccctgcacgaggcctgcagccggggctggacagacatcctgaacatcctgctggagcacggggccaacgtgaactgcagcgcccaggacggcaccaggcctgtgcatgatgctgtggtgaatgacaacctggagaccatctggctgctgctgtcctatggagctgaccccaccctggccacctacagcggccagacagccatgaagctggccagcagtgacaccatgaagcgcttcctgagtgaccacctgagtgacctgcagggccgggcagagggggaccccggggtgtcctgggacttctacagcagctctgtgctggaggagaaggatggctttgcctgtgacctgctgcacaaccccccaggcagcagtgaccaggagggagatgaccccatggaggaggatgacttcatgtttgagctgagtgacaagcccctgctgccctgctacaacctgcaggtgtctgtgtcccggggcccctgcaactggttcctgttcagtgatgtgctgaagaggctgaagctgagcagccgcatcttccaggcccgcttcccccactttgagatcaccaccatgcccaaggccgagttctaccggcaggtggccagcagccagctgctgaccccagctgagaggcctgggggcctggatgacaggagccccccaggcagcagcgagaccgtggagctggtgcgctatgagccagacctgctgcggctgctgggcagcgaggtggagttccagagctgcaacagctag

SEQ ID NO: 145092 - DNA, 4746 bp, Artificial Sequence
  Description of Artificial Sequence: Synthetic coding sequence
atgatcagcacagcccccctgtacagcggcgtgcacaactggaccagcagtgaccgcatccgcatgtgtggcatcaatgaggagcggcgggcccccctgagtgatgaggagagcaccaccggggactgccagcacttcggcagccaggagttctgtgtgagcagcagcttcagcaaggtggagctgacagctgtgggcagcggcagcaatgcccggggagctgaccctgatggcagcgccacagagaagctgggccacaagtctgaggacaagccagatgacccccagcccaagatggactatgctggaaatgtggccgaggccgagggcttcctggtgcccctgagcagccctggagatggcctgaagctgcctgccagtgacagcgctgaggccagcaacagcagagctgactgctcctggacccccctgaacacccagatgagcaagcaggtggactgcagccctgctggggtgaaggccctggacagccggcagggcgtgggggagaagaacaccttcatcctggccaccctgggcactggagtgcctgtggagggcaccctgcccctggtgaccaccaacttcagccccctgcctgcccccatctgccccccagcccctggcagcgcctctgtgccccacagcgtgcctgatgccttccaggtgcccctgtctgtgcctgcccctgtgccccacagcggcctggtgcctgtgcaggtggccacctctgtgcctgcccccagcccccccctggcccctgtgcctgccctggccccagccccacccagcgtgcccaccctcatcagtgacagcaaccccctgtctgtgtctgcctctgtgctggtgcctgtgcctgccagcgccccacccagcggccctgtgcccctgagcgccccagccccagcccccctgtctgtgcctgtgtctgccccacccctggccctgatccaggcccctgtgccccccagcgcccccaccctggtgctggcccctgtgcccacccctgtgctggcccccatgcctgccagcaccccacctgctgccccagccccacccagcgtgcccatgcccacccccacccccagcagcggcccccccagcacccccaccctcatcccagcctttgcccccacccctgtgcctgcccccaccccagcccccatcttcaccccagcccccacccccatgcctgctgccaccccagctgccatccccaccagcgcccccatcccagccagcttcagcctgagccgggtgtgcttccctgctgcccaggccccagccatgcagaaggtgcccctgtccttccagcccggcaccgtgctgacccccagccagcccctggtgtacatccccccacccagctgtggccagcccctgtctgtggccaccctgcccaccaccctgggcgtgagcagcaccctgaccctgcctgtgctgcccagctacctgcaggaccgctgcctgcccggggtgctggccagccctgagctgcggagctacccctatgccttctctgtggcccggcccctgaccagtgacagcaagctggtgtccctggaggtgaaccggctgccctgcaccagccccagcggcagcaccaccacccagcctgccccagatggagtgcccggccccctggccgacaccagcctggtgacagccagcgccaaggtgctgcccaccccccagcccctgctgcctgcccccagcggcagcagcgccccaccccacccagccaagatgcccagcggcacagagcagcagacagagggcacctctgtgaccttcagccccctgaagagccccccccagctggagcgggagatggccagccccccagagtgcagcgagatgcccctggacctgagcagcaagagcaaccggcagaagctgcccctgcccaaccagaggaagaccccacccatgcctgtgctgacccctgtgcacaccagcagcaaggccctgctgagcacagtgctgagccgcagccagaggaccacccaggccgccggcggcaatgtgaccagctgcctgggcagcaccagcagcccctttgtgatcttccctgagatcgtgagaaatggagaccccagcacctgggtgaagaacagcacagccctgatcagcaccatccctggcacctacgtgggcgtggccaaccctgtgcctgccagcctgctgctgaacaaggaccccaacctgggcctgaacagagaccccaggcacctgcccaagcaggagcccatcagcatcatcgaccagggcgagcccaagggcaccggggccacctgtgggaagaagggcagccaggccggggctgagggccagcccagcacagtgaagcgctacaccccagcccgcatcgcccctggcctgcccggctgccagaccaaggagctgagcctgtggaagcccaccggccctgccaacatctacccccgctgcagcgtgaatggcaagcccaccagcacccaggtgctgcctgtgggctggagcccctaccaccaggccagcctgctgagcatcggcatcagcagcgctggccagctgacccccagccagggcgcccccatccggcccacctctgtggtgtctgagttcagcggcgtgcccagcctgagcagcagcgaggccgtgcacggcctgcctgagggccagcccaggcctgggggcagctttgtgcctgagcaggaccctgtgaccaagaacaagacctgcagaattgctgccaagccctatgaggagcaggtgaaccctgtgctgctgaccctgagcccccagacaggcaccctggccctgtctgtgcagcccagcggcggggacatccgcatgaaccagggccctgaggagagcgagagccacctgtgcagcgacagcacccccaagatggagggcccccagggcgcctgtggcctgaagctggccggggacaccaagcccaagaaccaggtgctggccacctacatgagccatgagctggtgctggccaccccccagaacctgcccaagatgcctgagctgcccctgctgccccatgacagccaccccaaggagctgatcctggatgtggtgcccagcagccggcggggcagcagcacagagcggccccagctgggcagccaggtggacctgggccgggtgaagatggagaaggtggatggagatgtggtgttcaacctggccacctgcttccgggcagatggcctgcctgtggccccccagaggggccaggccgaggtgcgggccaaggccggccaggcccgggtgaagcaggagagcgtgggcgtgtttgcctgcaagaacaagtggcagccagatgatgtgacagagagcctgccccccaagaagatgaagtgtgggaaggagaaggacagcgaggagcagcagctgcagccccaggccaaggctgtggtgcgcagcagccaccggcccaagtgcaggaagctgcccagcgacccccaggagagcaccaagaagagccccaggggggccagtgacagcggcaaggagcacaacggggtgcggggcaagcacaagcacaggaagcccaccaagccagagagccagagccctgggaagagagctgacagccatgaggagggcagcctggagaagaaggccaagagcagcttccgggacttcatccctgtggtgctgagcaccaggaccaggagccagagcgacctgaaggccaggaagcagaagaccagcagcagccagagcctggagcaccggctgaggaacagaaacctgctgctgcccaacaaggtgcagggcatcagtgacagccccaacggcttcctgcccaacaacctggaggagcccgcctgcctggagaacagcgagaagcccagcggcaagaggaagtgcaagaccaagcacatggccaccgtgtctgaggaggccaaggatgtggtgctgtactgcctgcagaaggacagtgaagatgtgaaccaccgggacaatgccggctacacagccctgcacgaggcctgcagccggggctggacagacatcctgaacatcctgctggagcacggggccaacgtgaactgcagcgcccaggacggcaccaggcctgtgcatgatgctgtggtgaatgacaacctggagaccatctggctgctgctgtcctatggagctgaccccaccctggccacctacagcggccagacagccatgaagctggccagcagtgacaccatgaagcgcttcctgagtgaccacctgagtgacctgcagggccgggcagagggggaccccggggtgtcctgggacttctacagcagctctgtgctggaggagaaggatggctttgcctgtgacctgctgcacaaccccccaggcagcagtgaccaggagggagatgaccccatggaggaggatgacttcatgtttgagctgagtgacaagcccctgctgccctgctacaacctgcaggtgtctgtgtcccggggcccctgcaactggttcctgttcagtgatgtgctgaagaggctgaagctgagcagccgcatcttccaggcccgcttcccccactttgagatcaccaccatgcccaaggccgagttctaccggcaggtggccagcagccagctgctgaccccagctgagaggcctgggggcctggatgacaggagccccccaggcagcagcgagaccgtggagctggtgcgctatgagccagacctgctgcggctgctgggcagcgaggtggagttccagagctgcaacagctag

SEQ ID NO: 145093 - DNA, 2226 bp, Artificial Sequence
  Description of Artificial Sequence: Synthetic coding sequence
tgacccctgctgcctgcccccagcggcagcagcgccccaccccacccagccaagatgcccagcggcacagagcagcagacagagggcacctctgtgaccttcagccccctgaagagccccccccagctggagcgggagatggccagccccccagagtgcagcgagatgcccctggacctgagcagcaagagcaaccggcagaagctgcccctgcccaaccagaggaagaccccacccatgcctgtgctgacccctgtgcacaccagcagcaaggccctgctgagcacagtgctgagccgcagccagaggaccacccaggccgccggcggcaatgtgaccagctgcctgggcagcaccagcagcccctttgtgatcttccctgagatcgtgagaaatggagaccccagcacctgggtgaagaacagcacagccctgatcagcaccatccctggcacctacgtgggcgtggccaaccctgtgcctgccagcctgctgctgaacaaggaccccaacctgggcctgaacagagaccccaggcacctgcccaagcaggagcccatcagcatcatcgaccagggcgagcccaagggcaccggggccacctgtgggaagaagggcagccaggccggggctgagggccagcccagcacagtgaagcgctacaccccagcccgcatcgcccctggcctgcccggctgccagaccaaggagctgagcctgtggaagcccaccggccctgccaacatctacccccgctgcagcgtgaatggcaagcccaccagcacccaggtgctgcctgtgggctggagcccctaccaccaggccagcctgctgagcatcggcatcagcagcgctggccagctgacccccagccagggcgcccccatccggcccacctctgtggtgtctgagttcagcggcgtgcccagcctgagcagcagcgaggccgtgcacggcctgcctgagggccagcccaggcctgggggcagctttgtgcctgagcaggaccctgtgaccaagaacaagacctgcagaattgctgccaagccctatgaggagcaggtgaaccctgtgctgctgaccctgagcccccagacaggcaccctggccctgtctgtgcagcccagcggcggggacatccgcatgaaccagggccctgaggagagcgagagccacctgtgcagcgacagcacccccaagatggagggcccccagggcgcctgtggcctgaagctggccggggacaccaagcccaagaaccaggtgctggccacctacatgagccatgagctggtgctggccaccccccagaacctgcccaagatgcctgagctgcccctgctgccccatgacagccaccccaaggagctgatcctggatgtggtgcccagcagccggcggggcagcagcacagagcggccccagctgggcagccaggtggacctgggccgggtgaagatggagaaggtggatggagatgtggtgttcaacctggccacctgcttccgggcagatggcctgcctgtggccccccagaggggccaggccgaggtgcgggccaaggccggccaggcccgggtgaagcaggagagcgtgggcgtgtttgcctgcaagaacaagtggcagccagatgatgtgacagagagcctgccccccaagaagatgaagtgtgggaaggagaaggacagcgaggagcagcagctgcagccccaggccaaggctgtggtgcgcagcagccaccggcccaagtgcaggaagctgcccagcgacccccaggagagcaccaagaagagccccaggggggccagtgacagcggcaaggagcacaacggggtgcggggcaagcacaagcacaggaagcccaccaagccagagagccagagccctgggaagagagctgacagccatgaggagggcagcctggagaagaaggccaagagcagcttccgggacttcatccctgtggtgctgagcaccaggaccaggagccagagcgacctgaaggccaggaagcagaagaccagcagcagccagagcctggagcaccggctgaggaacagaaacctgctgctgcccaacaaggtgcagggcatcagtgacagccccaacggcttcctgcccaacaacctggaggagcccgcctgcctggagaacagcgagaagcccagcggcaagaggaagtgcaagaccaagcacatggccaccgtgtctgaggaggccaagtag

SEQ ID NO: 145094 - DNA, 4158 bp, Artificial Sequence
  Description of Artificial Sequence: Synthetic coding sequence
accccagctgccatccccaccagcgcccccatcccagccagcttcagcctgagccgggtgtgcttccctgctgcccaggccccagccatgcagaaggtgcccctgtccttccagcccggcaccgtgctgacccccagccagcccctggtgtacatccccccacccagctgtggccagcccctgtctgtggccaccctgcccaccaccctgggcgtgagcagcaccctgaccctgcctgtgctgcccagctacctgcaggaccgctgcctgcccggggtgctggccagccctgagctgcggagctacccctatgccttctctgtggcccggcccctgaccagtgacagcaagctggtgtccctggaggtgaaccggctgccctgcaccagccccagcggcagcaccaccacccagcctgccccagatggagtgcccggccccctggccgacaccagcctggtgacagccagcgccaaggtgctgcccaccccccagcccctgctgcctgcccccagcggcagcagcgccccaccccacccagccaagatgcccagcggcacagagcagcagacagagggcacctctgtgaccttcagccccctgaagagccccccccagctggagcgggagatggccagccccccagagtgcagcgagatgcccctggacctgagcagcaagagcaaccggcagaagctgcccctgcccaaccagaggaagaccccacccatgcctgtgctgacccctgtgcacaccagcagcaaggccctgctgagcacagtgctgagccgcagccagaggaccacccaggccgccggcggcaatgtgaccagctgcctgggcagcaccagcagcccctttgtgatcttccctgagatcgtgagaaatggagaccccagcacctgggtgaagaacagcacagccctgatcagcaccatccctggcacctacgtgggcgtggccaaccctgtgcctgccagcctgctgctgaacaaggaccccaacctgggcctgaacagagaccccaggcacctgcccaagcaggagcccatcagcatcatcgaccagggcgagcccaagggcaccggggccacctgtgggaagaagggcagccaggccggggctgagggccagcccagcacagtgaagcgctacaccccagcccgcatcgcccctggcctgcccggctgccagaccaaggagctgagcctgtggaagcccaccggccctgccaacatctacccccgctgcagcgtgaatggcaagcccaccagcacccaggtgctgcctgtgggctggagcccctaccaccaggccagcctgctgagcatcggcatcagcagcgctggccagctgacccccagccagggcgcccccatccggcccacctctgtggtgtctgagttcagcggcgtgcccagcctgagcagcagcgaggccgtgcacggcctgcctgagggccagcccaggcctgggggcagctttgtgcctgagcaggaccctgtgaccaagaacaagacctgcagaattgctgccaagccctatgaggagcaggtgaaccctgtgctgctgaccctgagcccccagacaggcaccctggccctgtctgtgcagcccagcggcggggacatccgcatgaaccagggccctgaggagagcgagagccacctgtgcagcgacagcacccccaagatggagggcccccagggcgcctgtggcctgaagctggccggggacaccaagcccaagaaccaggtgctggccacctacatgagccatgagctggtgctggccaccccccagaacctgcccaagatgcctgagctgcccctgctgccccatgacagccaccccaaggagctgatcctggatgtggtgcccagcagccggcggggcagcagcacagagcggccccagctgggcagccaggtggacctgggccgggtgaagatggagaaggtggatggagatgtggtgttcaacctggccacctgcttccgggcagatggcctgcctgtggccccccagaggggccaggccgaggtgcgggccaaggccggccaggcccgggtgaagcaggagagcgtgggcgtgtttgcctgcaagaacaagtggcagccagatgatgtgacagagagcctgccccccaagaagatgaagtgtgggaaggagaaggacagcgaggagcagcagctgcagccccaggccaaggctgtggtgcgcagcagccaccggcccaagtgcaggaagctgcccagcgacccccaggagagcaccaagaagagccccaggggggccagtgacagcggcaaggagcacaacggggtgcggggcaagcacaagcacaggaagcccaccaagccagagagccagagccctgggaagagagctgacagccatgaggagggcagcctggagaagaaggccaagagcagcttccgggacttcatccctgtggtgctgagcaccaggaccaggagccagagcggcagcatctgcagcagctttgctggcatggctgacagcgacatgggcagccaggaggtgttccccacagaggaggaggaggaggtgacccccaccccagccaagaggaggaaggtgaggaagacccagagggacacccagtaccgcagccaccacgcccaggacaagagcctgctgagccagggccgccgccacctgtggagggcccgggagatgccctggaggacagaagctgcccggcagatgtgggacaccaatgaggaggaggaggaggaggaggaggagggcctgctgaagaggaagaagagaagacggcagaagagcaggaagtaccagacaggagagtacctgacagagcaggaggatgagcagaggaggaagggccgggctgacctgaaggccaggaagcagaagaccagcagcagccagagcctggagcaccggctgaggaacagaaacctgctgctgcccaacaaggtgcagggcatcagtgacagccccaacggcttcctgcccaacaacctggaggagcccgcctgcctggagaacagcgagaagcccagcggcaagaggaagtgcaagaccaagcacatggccaccgtgtctgaggaggccaagggcaagggccgctggagccagcagaagaccaggagccccaagagccccacccctgtgaagcccacagagccctgcacccccagcaagagccgcagcgccagcagcgaggaggccagcgagagccccacagcccggcagatccccccagaggcccggcggctcatcgtgaacaagaatgctggggagaccctgctgcagagagctgcccggctgggctacaaggatgtggtgctgtactgcctgcagaaggacagtgaagatgtgaaccaccgggacaatgccggctacacagccctgcacgaggcctgcagccggggctggacagacatcctgaacatcctgctggagcacggggccaacgtgaactgcagcgcccaggacggcaccaggcctgtgcatgatgctgtggtgaatgacaacctggagaccatctggctgctgctgtcctatggagctgaccccaccctggccacctacagcggccagacagccatgaagctggccagcagtgacaccatgaagcgcttcctgagtgaccacctgagtgacctgcagggccgggcagagggggaccccggggtgtcctgggacttctacagcagctctgtgctggaggagaaggatggctttgcctgtgacctgctgcacaaccccccaggcagcagtgaccaggagggagatgaccccatggaggaggatgacttcatgtttgagctgagtgacaagcccctgctgccctgctacaacctgcaggtgtctgtgtcccggggcccctgcaactggttcctgttcagtgatgtgctgaagaggctgaagctgagcagccgcatcttccaggcccgcttcccccactttgagatcaccaccatgcccaaggccgagttctaccggcaggtggccagcagccagctgctgaccccagctgagaggcctgggggcctggatgacaggagccccccaggcagcagcgagaccgtggagctggtgcgctatgagccagacctgctgcggctgctgggcagcgaggtggagttccagagctgcaacagctag

SEQ ID NO: 145095 - DNA, 5136 bp, Artificial Sequence
  Description of Artificial Sequence: Synthetic coding sequence
atgatcagcacagcccccctgtacagcggcgtgcacaactggaccagcagtgaccgcatccgcatgtgtggcatcaatgaggagcggcgggcccccctgagtgatgaggagagcaccaccggggactgccagcacttcggcagccaggagttctgtgtgagcagcagcttcagcaaggtggagctgacagctgtgggcagcggcagcaatgcccggggagctgaccctgatggcagcgccacagagaagctgggccacaagtctgaggacaagccagatgacccccagcccaagatggactatgctggaaatgtggccgaggccgagggcttcctggtgcccctgagcagccctggagatggcctgaagctgcctgccagtgacagcgctgaggccagcaacagcagagctgactgctcctggacccccctgaacacccagatgagcaagcaggtggactgcagccctgctggggtgaaggccctggacagccggcagggcgtgggggagaagaacaccttcatcctggccaccctgggcactggagtgcctgtggagggcaccctgcccctggtgaccaccaacttcagccccctgcctgcccccatctgccccccagcccctggcagcgcctctgtgccccacagcgtgcctgatgccttccaggtgcccctgtctgtgcctgcccctgtgccccacagcggcctggtgcctgtgcaggtggccacctctgtgcctgcccccagcccccccctggcccctgtgcctgccctggccccagccccacccagcgtgcccaccctcatcagtgacagcaaccccctgtctgtgtctgcctctgtgctggtgcctgtgcctgccagcgccccacccagcggccctgtgcccctgagcgccccagccccagcccccctgtctgtgcctgtgtctgccccacccctggccctgatccaggcccctgtgccccccagcgcccccaccctggtgctggcccctgtgcccacccctgtgctggcccccatgcctgccagcaccccacctgctgccccagccccacccagcgtgcccatgcccacccccacccccagcagcggcccccccagcacccccaccctcatcccagcctttgcccccacccctgtgcctgcccccaccccagcccccatcttcaccccagcccccacccccatgcctgctgccaccccagctgccatccccaccagcgcccccatcccagccagcttcagcctgagccgggtgtgcttccctgctgcccaggccccagccatgcagaaggtgcccctgtccttccagcccggcaccgtgctgacccccagccagcccctggtgtacatccccccacccagctgtggccagcccctgtctgtggccaccctgcccaccaccctgggcgtgagcagcaccctgaccctgcctgtgctgcccagctacctgcaggaccgctgcctgcccggggtgctggccagccctgagctgcggagctacccctatgccttctctgtggcccggcccctgaccagtgacagcaagctggtgtccctggaggtgaaccggctgccctgcaccagccccagcggcagcaccaccacccagcctgccccagatggagtgcccggccccctggccgacaccagcctggtgacagccagcgccaaggtgctgcccaccccccagcccctgctgcctgcccccagcggcagcagcgccccaccccacccagccaagatgcccagcggcacagagcagcagacagagggcacctctgtgaccttcagccccctgaagagccccccccagctggagcgggagatggccagccccccagagtgcagcgagatgcccctggacctgagcagcaagagcaaccggcagaagctgcccctgcccaaccagaggaagaccccacccatgcctgtgctgacccctgtgcacaccagcagcaaggccctgctgagcacagtgctgagccgcagccagaggaccacccaggccgccggcggcaatgtgaccagctgcctgggcagcaccagcagcccctttgtgatcttccctgagatcgtgagaaatggagaccccagcacctgggtgaagaacagcacagccctgatcagcaccatccctggcacctacgtgggcgtggccaaccctgtgcctgccagcctgctgctgaacaaggaccccaacctgggcctgaacagagaccccaggcacctgcccaagcaggagcccatcagcatcatcgaccagggcgagcccaagggcaccggggccacctgtgggaagaagggcagccaggccggggctgagggccagcccagcacagtgaagcgctacaccccagcccgcatcgcccctggcctgcccggctgccagaccaaggagctgagcctgtggaagcccaccggccctgccaacatctacccccgctgcagcgtgaatggcaagcccaccagcacccaggtgctgcctgtgggctggagcccctaccaccaggccagcctgctgagcatcggcatcagcagcgctggccagctgacccccagccagggcgcccccatccggcccacctctgtggtgtctgagttcagcggcgtgcccagcctgagcagcagcgaggccgtgcacggcctgcctgagggccagcccaggcctgggggcagctttgtgcctgagcaggaccctgtgaccaagaacaagacctgcagaattgctgccaagccctatgaggagcaggtgaaccctgtgctgctgaccctgagcccccagacaggcaccctggccctgtctgtgcagcccagcggcggggacatccgcatgaaccagggccctgaggagagcgagagccacctgtgcagcgacagcacccccaagatggagggcccccagggcgcctgtggcctgaagctggccggggacaccaagcccaagaaccaggtgctggccacctacatgagccatgagctggtgctggccaccccccagaacctgcccaagatgcctgagctgcccctgctgccccatgacagccaccccaaggagctgatcctggatgtggtgcccagcagccggcggggcagcagcacagagcggccccagctgggcagccaggtggacctgggccgggtgaagatggagaaggtggatggagatgtggtgttcaacctggccacctgcttccgggcagatggcctgcctgtggccccccagaggggccaggccgaggtgcgggccaaggccggccaggcccgggtgaagcaggagagcgtgggcgtgtttgcctgcaagaacaagtggcagccagatgatgtgacagagagcctgccccccaagaagatgaagtgtgggaaggagaaggacagcgaggagcagcagctgcagccccaggccaaggctgtggtgcgcagcagccaccggcccaagtgcaggaagctgcccagcgacccccaggagagcaccaagaagagccccaggggggccagtgacagcggcaaggagcacaacggggtgcggggcaagcacaagcacaggaagcccaccaagccagagagccagagccctgggaagagagctgacagccatgaggagggcagcctggagaagaaggccaagagcagcttccgggacttcatccctgtggtgctgagcaccaggaccaggagccagagcggcagcatctgcagcagctttgctggcatggctgacagcgacatgggcagccaggaggtgttccccacagaggaggaggaggaggtgacccccaccccagccaagaggaggaaggtgaggaagacccagagggacacccagtaccgcagccaccacgcccaggacaagagcctgctgagccagggccgccgccacctgtggagggcccgggagatgccctggaggacagaagctgcccggcagatgtgggacaccaatgaggaggaggaggaggaggaggaggagggcctgctgaagaggaagaagagaagacggcagaagagcaggaagtaccagacaggagagtacctgacagagcaggaggatgagcagaggaggaagggccgggctgacctgaaggccaggaagcagaagaccagcagcagccagagcctggagcaccggctgaggaacagaaacctgctgctgcccaacaaggtgcagggcatcagtgacagccccaacggcttcctgcccaacaacctggaggagcccgcctgcctggagaacagcgagaagcccagcggcaagaggaagtgcaagaccaagcacatggccaccgtgtctgaggaggccaaggatgtggtgctgtactgcctgcagaaggacagtgaagatgtgaaccaccgggacaatgccggctacacagccctgcacgaggcctgcagccggggctggacagacatcctgaacatcctgctggagcacggggccaacgtgaactgcagcgcccaggacggcaccaggcctgtgcatgatgctgtggtgaatgacaacctggagaccatctggctgctgctgtcctatggagctgaccccaccctggccacctacagcggccagacagccatgaagctggccagcagtgacaccatgaagcgcttcctgagtgaccacctgagtgacctgcagggccgggcagagggggaccccggggtgtcctgggacttctacagcagctctgtgctggaggagaaggatggctttgcctgtgacctgctgcacaaccccccaggcagcagtgaccaggagggagatgaccccatggaggaggatgacttcatgtttgagctgagtgacaagcccctgctgccctgctacaacctgcaggtgtctgtgtcccggggcccctgcaactggttcctgttcagtgatgtgctgaagaggctgaagctgagcagccgcatcttccaggcccgcttcccccactttgagatcaccaccatgcccaaggccgagttctaccggcaggtggccagcagccagctgctgaccccagctgagaggcctgggggcctggatgacaggagccccccaggcagcagcgagaccgtggagctggtgcgctatgagccagacctgctgcggctgctgggcagcgaggtggagttccagagctgcaacagctag

SEQ ID NO: 145096 - DNA, 1260 bp, Artificial Sequence
  Description of Artificial Sequence: Synthetic coding sequence
atgcccctgagtgacttcatcctggccctgaaggacaacccctactttggagctggcttcggcctggtgggcgtgggcacagccctggccctggccaggaagggcgtgcagctgggcctggtggccttccgccgccactacatgatcaccctggaggtgcctgcccgggacaggagctatgcctggctgctgtcctggctgaccaggcacagcaccaggacccagcacctgtctgtggagaccagctacctgcagcacgagagcggccgcatcagcaccaagtttgaatttgtgcccagccctggcaaccacttcatctggtaccggggcaagtggatccgggtggagaggagccgggagatgcagatgattgacctgcagacaggcaccccctgggagagcgtgaccttcaccgccctgggcacagacaggaaggtgttcttcaacatcctggaggaggcccgggagctggccctgcagcaggaggagggcaagacagtgatgtacacagctgtgggcagcgagtggaggcccttcggctaccccaggagaagaagacccctgaacagcgtggtgctgcagcagggcctggccgacagaattgtgagagatgtgcaggagttcatcgacaaccccaagtggtacacagaccggggcatcccctacagaagaggctacctgctgtatggccccccaggctgtgggaagagcagcttcatcacagccctggccggggagctggagcacagcatctgcctgctgagcctgacagacagcagcctgagtgatgaccggctgaaccacctgctgtctgtggccccccagcagagcctggtgctgctggaggatgtggatgctgccttcctgagccgggacctggccgtggagaaccctgtgaagtaccagggcctgggccgcctgaccttcagcggcctgctgaatgccctggatggagtggccagcacagaggcccgcatcgtgttcatgaccaccaaccacgtggaccggctggaccctgccctgatccggcccggccgggtggacctgaaggagtatgtgggctactgcagccactggcagctgacccagatgttccagcgcttctacccaggccaggcccccagcctggccgagaactttgctgagcacgtgctgcgggccaccaaccagatcagccctgcccaggtgcagggctacttcatgctgtacaagaatgaccctgtgggcgccatccacaatgctgagagcctgcggaggtag

SEQ ID NO: 145097 - DNA, 1260 bp, Artificial Sequence; identical to SEQ ID NO: 145096
  Description of Artificial Sequence: Synthetic coding sequence

SEQ ID NO: 145098 - DNA, 1260 bp, Artificial Sequence; identical to SEQ ID NO: 145096
  Description of Artificial Sequence: Synthetic coding sequence

SEQ ID NO: 145099 - DNA, 1260 bp, Artificial Sequence; identical to SEQ ID NO: 145096
  Description of Artificial Sequence: Synthetic coding sequence

SEQ ID NO: 145100 - DNA, 1260 bp, Artificial Sequence; identical to SEQ ID NO: 145096
  Description of Artificial Sequence: Synthetic coding sequence

SEQ ID NO: 145101 - DNA, 333 bp, Artificial Sequence
  Description of Artificial Sequence: Synthetic coding sequence
atgcccctgagtgacttcatcctggccctgaaggacaacccctactttggagctggcttcggcctggtgggcgtgggcacagccctggccctggccaggaagggcgtgcagctgggcctggtggccttccgccgccactacatgatcaccctggaggtgcctgcccgggacaggagctatgcctggctgctgtcctggctgaccaggcacagcaccaggacccagcacctgtctgtggagaccagctacctgcagcacgagagcggccgcatcagcaccaagtttgaatttgtgcccagccctggcaaccacttcatctggtaccggggctag

SEQ ID NO: 145102 - DNA, 234 bp, Artificial Sequence
  Description of Artificial Sequence: Synthetic coding sequence
atgcccctgagtgacttcatcctggccctgaaggacaacccctactttggagctggcttcggcctggtgggcgtgggcacagccctggccctggccaggaagggcgtgcagctgggcctggtggccttccgccgccactacatgatcaccctggaggtgcctgcccgggacaggagctatgcctggctgctgtcctggctgaccaggcacagcaccaggacccagcacctgtag

SEQ ID NO: 145103 - DNA, 621 bp, Artificial Sequence
  Description of Artificial Sequence: Synthetic coding sequence
atgcccctgagtgacttcatcctggccctgaaggacaacccctactttggagctggcttcggcctggtgggcgtgggcacagccctggccctggccaggaagggcgtgcagctgggcctggtggccttccgccgccactacatgatcaccctggaggtgcctgcccgggacaggagctatgcctggctgctgtcctggctgaccaggcacagcaccaggacccagcacctgtctgtggagaccagctacctgcagcacgagagcggccgcatcagcaccaagtttgaatttgtgcccagccctggcaaccacttcatctggtaccggggcaagtggatccgggtggagaggagccgggagatgcagatgattgacctgcagacaggcaccccctgggagagcgtgaccttcaccgccctgggcacagacaggaaggtgttcttcaacatcctggaggaggcccgggagctggccctgcagcaggaggagggcaagacagtgatgtacacagctgtgggcagcgagtggaggcccttcggctaccccaggagaagaagacccctgaacagcgtggtgctgcagcagggcctggccgacagaattgtgagagatgtgcagtag

SEQ ID NO: 145104 - DNA, 1260 bp, Artificial Sequence; identical to SEQ ID NO: 145096
  Description of Artificial Sequence: Synthetic coding sequence

SEQ ID NO: 145105 - DNA, 1260 bp, Artificial Sequence; identical to SEQ ID NO: 145096
  Description of Artificial Sequence: Synthetic coding sequence

SEQ ID NO: 145106 - DNA, 621 bp, Artificial Sequence; identical to SEQ ID NO: 145103
  Description of Artificial Sequence: Synthetic coding sequence

SEQ ID NO: 145107 - DNA, 1623 bp, Artificial Sequence
  Description of Artificial Sequence: Synthetic coding sequence
atgtatgaaaatgaatgtgagtgccagctgctgctgaaggagatgctggagcggctgaacaaggaggctgatgaggccctgctgcacaacctgcggctgcagctggaggcccagttcctgcaggatgacatctctgctgccaaggacagacacaagaagaacctgctggaggtgcagacctacatcagcatcctgcagcagatcatccacaccaccccaccagccagcatcgtgaccagcggcatgagggaggagaagctgctgacagagcgggaggtggccgccctgcggagccagctggaggagggccgggaggtgctgagccacctgcaggcccagagggtggagctgcaggcccagaccaccaccctggagcaggccatcaagagcgcccatgaatgttatgatgatgagatccagctgtacaatgagcagatcgagaccctgaggaaggagattgaggagacagagcgggtgctggagaagagcagctatgactgccggcagctggccgtggcccagcagaccctgaagaatgagctggaccgctaccaccgcatcatcgagattgagggcaaccggctgaccagcgccttcatcgagacccccatccccctcttcacccagagccatggagtgtccctgagcactggaagtggcggcaaggacctgacccgggccctgcaggacatcacagctgccaagccccggcagaaggccctgcccaagaatgtgcccaggaggaaggagatcatcaccaaggacaagaccaacggggccctggaggatgcccccctgaagggcctggaggacaccaagctggtgcaggtggtgctgaaggaggagagcgagagcaagtttgaaagtgagagcaaggaggtgagccccctgacccaggagggcgccccagaagatgtgcctgatggcggccagatcagcaagggctttgggaagctgtacaggaaggtgaaggagaaggtgcgcagccccaaggagcctgagacccccacagagctgtacaccaaggagagacatgtgctggtgactggagatgccaactacgtggacccccgcttctacgtgagcagcatcacagccaagggcggcgtggccgtgtctgtggccgaggacagcgtgctgtatgatggccaggtggagcccagccctgagagccccaagccacccctggagaatggccaggtgggcctgcaggagaaggaggatggccagcccatcgaccagcagcccatcgacaaggagattgaaccagatggagctgagctggagggccctgaggagaagcgggagggggaggagagagatgaggagagcagaagaccctgtgccatggtgaccccaggagctgaggagcccagcatccctgagccccccaagccagctgctgaccaggatggagctgaggtgctgggcaccaggagccgcagcctgcctgagaagggcccccccaaggccctggcctacaagacagtggaggtggtggagagcattgagaagatcagcacagagagcatccagacctatgaggagacagctgtgattgtggagaccatgattggcaagaccaagagtgacaagaagaagtctggagagaagagcagctag

SEQ ID NO: 145108 - DNA, 1998 bp, Artificial Sequence
  Description of Artificial Sequence: Synthetic coding sequence
atgtacagaagaagctatgtgttccagaccaggaaggagcagtatgaacatgctgatgaggccagcagagctgctgagcctgagaggcctgcagatgagggctgggccggggccaccagcctggccgccctgcagggcctgggggagcgggtggccgcccacgtgcagagggcccgggccctggagcagagacatgctggcctgcggcggcagctggatgccttccagaggctgggggagctggccggcccagaagatgccctggcccggcaggtggagagcaaccggcagagggtgcgggacctggaggccgagcgggcccggctggagcggcagggcacagaggcccagagggccctggatgagttccgcagcaaatatgaaaatgaatgtgagtgccagctgctgctgaaggagatgctggagcggctgaacaaggaggctgatgaggccctgctgcacaacctgcggctgcagctggaggcccagttcctgcaggatgacatctctgctgccaaggacagacacaagaagaacctgctggaggtgcagacctacatcagcatcctgcagcagatcatccacaccaccccaccagccagcatcgtgaccagcggcatgagggaggagaagctgctgacagagcgggaggtggccgccctgcggagccagctggaggagggccgggaggtgctgagccacctgcaggcccagagggtggagctgcaggcccagaccaccaccctggagcaggccatcaagagcgcccacgagtgctatgatgatgagatccagctgtacaatgagcagatcgagaccctgaggaaggagattgaggagacagagcgggtgctggagaagagcagctatgactgccggcagctggccgtggcccagcagaccctgaagaatgagctggaccgctaccaccgcatcattgaaattgagggcaaccggctgaccagcgccttcatcgagacccccatccccctcttcacccagagccacggcgtgtccctgagcacaggcagcggcggcaaggacctgacccgggccctgcaggacatcacagctgccaagccccggcagaaggccctgcccaagaatgtgcccaggaggaaggagatcatcaccaaggacaagaccaatggagccctggaggatgcccccctgaagggcctggaggacaccaagctggtgcaggtggtgctgaaggaggagagcgagagcaagtttgagagcgagagcaaggaggtgagccccctgacccaggagggcgccccagaagatgtgcctgatggcggccagatcagcaaaggatttgggaagctgtacaggaaggtgaaggagaaggtgcgcagccccaaggagcctgagacccccacagagctgtacaccaaggagcggcacgtgctggtgactggagatgccaactacgtggacccccgcttctacgtgagcagcatcacagccaagggcggcgtggccgtgtctgtggctgaagattctgtgctgtatgatggccaggtggagcccagccctgagagccccaagccacccctggagaatggccaggtgggcctgcaggagaaggaggatggccagcccatcgaccagcagcccatcgacaaggagattgaaccagatggagctgagctggagggccctgaggagaagcgggagggggaggagagagatgaggagagccggcggccctgtgccatggtgaccccaggagctgaggagcccagcatccctgagccccccaagccagctgctgaccaggatggagctgaggtgctgggcaccaggagccgcagcctgcctgagaagggcccccccaaggccctggcctacaagacagtggaggtggtggagagcattgagaagatcagcacagagagcatccagacctatgaggagacagctgtgattgtggagaccatgattggcaagaccaagagtgacaagaagaagagcggggagaagagcagctag

SEQ ID NO: 145109 - DNA, 1581 bp, Artificial Sequence
  Description of Artificial Sequence: Synthetic coding sequence
atgctggagcggctgaacaaggaggctgatgaggccctgctgcacaacctgcggctgcagctggaggcccagttcctgcaggatgacatctctgctgccaaggacagacacaagaagaacctgctggaggtgcagacctacatcagcatcctgcagcagatcatccacaccaccccaccagccagcatcgtgaccagcggcatgagggaggagaagctgctgacagagcgggaggtggccgccctgcggagccagctggaggagggccgggaggtgctgagccacctgcaggcccagagggtggagctgcaggcccagaccaccaccctggagcaggccatcaagagcgcccatgaatgttatgatgatgagatccagctgtacaatgagcagatcgagaccctgaggaaggagattgaggagacagagcgggtgctggagaagagcagctatgactgccggcagctggccgtggcccagcagaccctgaagaatgagctggaccgctaccaccgcatcatcgagattgagggcaaccggctgaccagcgccttcatcgagacccccatccccctcttcacccagagccatggagtgtccctgagcactggaagtggcggcaaggacctgacccgggccctgcaggacatcacagctgccaagccccggcagaaggccctgcccaagaatgtgcccaggaggaaggagatcatcaccaaggacaagaccaacggggccctggaggatgcccccctgaagggcctggaggacaccaagctggtgcaggtggtgctgaaggaggagagcgagagcaagtttgaaagtgagagcaaggaggtgagccccctgacccaggagggcgccccagaagatgtgcctgatggcggccagatcagcaagggctttgggaagctgtacaggaaggtgaaggagaaggtgcgcagccccaaggagcctgagacccccacagagctgtacaccaaggagagacatgtgctggtgactggagatgccaactacgtggacccccgcttctacgtgagcagcatcacagccaagggcggcgtggccgtgtctgtggccgaggacagcgtgctgtatgatggccaggtggagcccagccctgagagccccaagccacccctggagaatggccaggtgggcctgcaggagaaggaggatggccagcccatcgaccagcagcccatcgacaaggagattgaaccagatggagctgagctggagggccctgaggagaagcgggagggggaggagagagatgaggagagcagaagaccctgtgccatggtgaccccaggagctgaggagcccagcatccctgagccccccaagccagctgctgaccaggatggagctgaggtgctgggcaccaggagccgcagcctgcctgagaagggcccccccaaggccctggcctacaagacagtggaggtggtggagagcattgagaagatcagcacagagagcatccagacctatgaggagacagctgtgattgtggagaccatgattggcaagaccaagagtgacaagaagaagtctggagagaagagcagctag

SEQ ID NO: 145110 - DNA, 1581 bp, Artificial Sequence; identical to SEQ ID NO: 145109
  Description of Artificial Sequence: Synthetic coding sequence

SEQ ID NO: 145111 - DNA, 1248 bp, Artificial Sequence
  Description of Artificial Sequence: Synthetic coding sequence
atgtctgagcggcgggtggtggtggacctgcccaccagcgccagcagctccatgcccctgcagaggagaagagccagcttccggggccccaggagcagcagcagcctggagagccccccagccagcaggaccaatgccatgagcggcctggtgcgggcccctggggtgtatgtgggcacagcccccagcggctgcatcggcggcctgggcgcccgggtgacccggcgggccctgggcatcagcagcgtcttcctgcagggcctgcggagcagcggcctggccaccgtgcctgcccctggcctggagcgggaccatggagctgtggaggacctgggcggctgcctggtggagtacatggccaaggtgcacgccctggagcaggtgtcccaggagctggagacccagctgaggatgcacctggagagcaaggccaccaggagcggcaactggggcgccctgcgggcctcctgggccagcagctgccagcaggtgggggaggccgtgctggagaatgcccggctgatgctgcagacagagaccatccaggccggggctgatgacttcaaggagagatatgaaaatgagcagcccttcaggaaggctgctgaggaggagatcaacagcctgtacaaggtgattgatgaggccaacctgaccaagatggacctggagagccagatcgagagcctgaaggaggagctgggcagcctgagcagaaattatgaagaagatgtgaagctgctgcacaagcagctggccggctgtgagctggagcagatggatgcccccatcggcaccggcctggatgacatcctggagaccatccgcatccagtgggagagagatgtggagaagaacagagtggaggccggggccctgctgcaggccaagcagcaggccgaggtggcccacatgagccagacccaggaggagaagctggccgccgccctgcgggtggagctgcacaacaccagctgccaggtgcagagcctgcaggccgagacagagagcctgcgggccctgaagaggggcctggagaacaccctgcatgatgccaagcactggcatgacatggagctgcagaacctgggcgctgtggtgggccgcctggaggccgagctgcgggagatccgggcagaggccgagcagcagcagcaggagcgggcccacctgctggccaggaagtgccagctgcagaaggatgtggccagctaccacgccctgctggaccgggaggagagcggctag

SEQ ID NO: 145112 - DNA, 1353 bp, Artificial Sequence
  Description of Artificial Sequence: Synthetic coding sequence
atggagggcagcaagaccagcaacaacagcaccatgcaggtgtcctttgtgtgccagcgctgcagccagcccctgaagctggacaccagcttcaagatcctggacagagtgaccatccaggagctgacagcccccctgctgaccacagcccaggccaagccaggagagacccaggaggaggagaccaacagcggggaggagcccttcatcgagaccccccggcaggatggagtgagccgccgcttcatccccccagccaggatgatgagcacagaaagtgccaacagcttcaccctcatcggggaggccagtgatggcggcaccatggagaacctgagccggcggctgaaggtgactggagacctgtttgacatcatgagcggccagacagatgtggaccaccccctgtgtgaagaatgtacagacaccctgctggaccagctggacacccagctgaatgtgacagaaaatgaatgccagaactacaagcgctgcctggagatcctggagcagatgaatgaagatgattctgagcagctgcagatggagctgaaggagctggccctggaggaggagcggctcatccaggagctggaggatgtggagaagaacaggaagatcgtggccgagaacctggagaaggtgcaggccgaggccgagcggctggaccaggaggaggcccagtaccagcgggagtacagcgagttcaagaggcagcagctggagctggatgatgagctgaagtctgtggagaaccagatgagatatgcccagacccagctggacaagctgaagaagaccaacgtgttcaatgccaccttccacatctggcacagcggccagtttggcaccatcaacaacttccggctgggccgcctgcccagcgtgcctgtggagtggaatgagatcaatgctgcctggggccagacagtgctgctgctgcacgccctggccaacaagatgggcctgaagttccagcgctaccgcctggtgccctacggcaaccacagctacctggagagcctgacagacaagagcaaggagctgcccctgtactgcagcggcggcctgcgcttcttctgggacaacaagtttgaccacgccatggtggccttcctggactgtgtgcagcagttcaaggaggaggtggagaagggggagacccgcttctgcctgccctacaggatggatgtggagaagggcaagattgaggacaccggcggcagcggcggcagctacagcatcaagacccagttcaacagcgaggagcagtggaccaaggccctgaagttcatgctgaccaacctgaagtggggcctggcctgggtgagcagccagttctacaacaagtag

SEQ ID NO: 145113 - DNA, 840 bp, Artificial Sequence
  Description of Artificial Sequence: Synthetic coding sequence
atggagggcagcaagaccagcaacaacagcaccatgcaggtgtcctttgtgtgccagcgctgcagccagcccctgaagctggacaccagcttcaagatcctggacagagtgaccatccaggagctgacagcccccctgctgaccacagcccaggccaagccaggagagacccaggaggaggagaccaacagcggggaggagcccttcatcgagaccccccggcaggatggagtgagccgccgcttcatccccccagcccggcgctgcctggagatcctggagcagatgaatgaagatgattctgagcagctgcagatggagctgaaggagctggccctggaggaggagcggctcatccaggagctggaggatgtggagaagaacaggaagatcgtggccgagaacctggagaaggtgcaggccgaggccgagcggctggaccaggaggaggcccagtaccagcgggagtacagcgagttcaagaggcagcagctggagctggatgatgagctgaagtctgtggagaaccagatgagatatgcccagacccagctggacaagctgaagaagaccaacgtgttcaatgccaccttccacatctggcacagcggccagtttggcaccatcaacaacttccggctgggccgcctgcccagcgtgcctgtggagtggaatgagatcaatgctgcctggggccagacagtgctgctgctgcacgccctggccaacaagatgggcctgaagttccagcgctaccgcctggtgccctacggcaaccacagctacctggagagcctgacagacaagagcaaggatggctgtggggagcggcaggactag

SEQ ID NO: 145114 - DNA, 1092 bp, Artificial Sequence
  Description of Artificial Sequence: Synthetic coding sequence
atgatgagcacagagagcgccaacagcttcaccctgattggagaggccagtgatggcggcaccatggagaacctgagccggcggctgaaggtgactggagacctgtttgacatcatgagcggccagacagatgtggaccaccccctgtgtgaggagtgcacagacaccctgctggaccagctggacacccagctgaatgtgacagaaaatgaatgccagaactacaagcgctgcctggagatcctggagcagatgaatgaagatgacagcgagcagctgcagatggagctgaaggagctggccctggaggaggagcggctcatccaggagctggaggatgtggagaagaacaggaagatcgtggccgagaacctggagaaggtgcaggccgaggccgagcggctggaccaggaggaggcccagtaccagcgggagtacagcgagttcaagaggcagcagctggagctggatgatgagctgaagtctgtggagaaccagatgagatatgcccagacccagctggacaagctgaagaagaccaacgtgttcaatgccaccttccacatctggcacagcggccagtttggcaccatcaacaacttccggctgggccgcctgcccagcgtgcctgtggagtggaatgagatcaatgctgcctggggccagacagtgctgctgctgcacgccctggccaacaagatgggcctgaagttccagcgctaccgcctggtgccctacggcaaccacagctacctggagagcctgacagacaagagcaaggagctgcccctgtactgcagcggcggcctgcgcttcttctgggacaacaagtttgaccacgccatggtggccttcctggactgtgtgcagcagttcaaggaggaggtggagaagggggagacccgcttctgcctgccctacaggatggatgtggagaagggcaagattgaagatactggaggcagcggcggcagctacagcatcaagacccagttcaacagcgaggagcagtggaccaaggccctgaagttcatgctgaccaacctgaagtggggcctggcctgggtgagcagccagttctacaacaagtag

SEQ ID NO: 145115 - DNA, 5394 bp, Artificial Sequence
  Description of Artificial Sequence: Synthetic coding sequence
atggagcagctgaccaccctgcccaggcctggggaccccggggccatggagccctgggccctgcccacctggcacagctggaccccaggccggggcggggagcccagcagcgctgcccccagcattgctgacaccccacctgctgccctgcagctgcaggagctgcggtctgaggagagcagcaagcccaagggagatggcagcagcaggcctgtgggcggcacagatcctgagggcgctgaggcctgcctgcccagcctgggccagcaggccagcagcagcggccctgcctgccagaggccagaagatgaggaggtggaggccttcctgaaggccaagctgaacatgagctttggagaccggcccaacctggagctgctgcgggccctgggggagctgcggcagagatgtgccatcctgaaggaggagaaccagatgctgaggaagagcagcttccctgagacagaggagaaggtgcggcggctgaagaggaagaatgctgagctggccgtcatcgccaagaggctggaggagcgggccaggaagctgcaggagaccaacctgcgggtggagggcccccagtggctgcacgtgcgggactttgaccggctgctgcgggagagccagcgggaggtgctgcggctgcagaggcagatcgccctgaggaaccagcgggagaccctgcccctgcccccatcctggcccccaggccctgccctgcaggcccgggccggggccccagcccctggggcccctggagaggccaccccccaggaggatgctgacaacctgcctgtgatcctgggggagcctgagaaggagcagagggtgcagcagctggagagcgagctgagcaagaagaggaagaagtgtgagagcctggagcaggaggccaggaagaagcagaggcgctgtgaggagctggagctgcagctgcggcaggcccagaatgaaaatgcccggctggtggaggagaacagccggctgagcggccgggccacagagaaggagcaggtggagtgggagaatgctgagctgcggggccagctgctgggcgtgacccaggagcgggacagcgccctgaggaagagccagggcctgcagagcaagctggagagcctggagcaggtgctgaagcacatgagggaggtggcccagaggcggcagcagctggaggtggagcacgagcaggcccggctgagcctgcgggagaagcaggaggaggtgcggcggctgcagcaggcccaggccgaggcccagcgggagcatgaaggagctgtgcagctgctggagagcaccctggacagcatgcaggcccgggtgcgggagctggaggagcagtgccgcagccagacagagcagttcagcctgctggcccaggagctgcaggccttccggctgcaccctggccccctggacctgctgaccagcgccctggactgtggcagcctgggggactgccccccaccaccctgctgctgcagcatcccccagccctgccggggcagcggccccaaggacctggacctgcccccaggcagccctggccgctgcacccccaagagcagcgagcccgccccagccaccctgactggagtgcccaggagaacagccaagaaggccgagagcctgagcaacagcagccacagcgagagcatccacaacagccccaagagctgccccaccccagaggtggacacagccagcgaggtggaggagctggaggccgacagcgtgtccctgctgcctgctgcccctgagggcagcagaggaggagcccgcatccaggtgttcctggcccgctacagctacaacccctttgagggccccaatgaaaatcctgaggccgagctgcccctgacagctggggagtacatctacatctacggcaacatggatgaagatggcttctttgaaggagagctgatggatggccggcggggcctggtgcccagcaactttgtggagcgggtgtctgatgatgacctgctgaccagcctgcccccagagctggccgacctgagccacagcagcggccctgagctgtccttcctgtctgtgggcggcggcggcagcagcagcggcggccagagctctgtgggccgcagccagcccaggcctgaggaggaggatgctggagatgagctgagcctgagccccagccctgagggcctgggggagcccccagctgtgccctacccccggcggctggtggtgctgaagcagctggcccacagcgtggtgctggcctgggagcccccacctgagcaggtggagctgcacggcttccacatctgtgtgaatggagagctgcggcaggccctgggccctggggccccacccaaggctgtgctggagaacctggacctgtgggccggccccctgcacatctctgtgcaggccctgaccagccggggcagcagtgaccccctgcgctgctgcctggccgtgggcgcccgggccggcgtggtgcccagccagctgcgggtgcaccggctgacagccaccagcgctgagatcacctgggtgcccggcaacagcaacctggcccacgccatctacctgaatggagaagaatgtcctccagccagccccagcacctactgggccaccttctgccacctgcggcccggcaccccctaccaggcccaggtggaggcccagctgcccccccagggcccctgggagcccggctgggagcggctggagcagagagctgccaccctgcagttcaccaccctgcctgctggccccccagatgcccccctggatgtgcagatcgagcccggccccagccctggcatcctgatcatctcctggctgcctgtgaccattgatgctgctggcaccagcaatggagtgcgggtgacaggctacgccatctatgcagatggccagaagatcatggaggtggccagccccacagctggctctgtgctggtggagctgagccagctgcagctgctgcaggtgtgccgggaggtggtggtgaggaccatgagcccccatggagagagcgctgacagcatcccagcccccatcaccccagccctggccccagccagcctgcctgcccgggtgtcctgccccagcccccaccccagccctgaggcccgggcccccctggccagcgccagccctggccctggggaccccagcagccccctgcagcacccagcccccctgggcacccaggagcccccaggggcccccccagccagccccagccgggagatggccaagggcagccatgaagatcctccagccccctgcagccaggaggaggccggggctgctgtgctgggcaccagcgaggagaggacagccagcaccagcaccctgggggagaaggaccccggccctgctgcccccagcctggccaagcaggaggccgagtggacagctggggaggcctgcccagccagcagcagcacccagggcgcccgggcccagcaggcccccaacacagagatgtgccagggcggggaccccggcagcggcctgcggcccagggctgagaaggaggacacagctgagctgggcgtgcacctggtgaacagcctggtggaccatggaagaaacagcgacctgagtgacatccaggaggaggaggaggaggaggaggaggaggaggaggaggagctgggcagcaggacctgcagcttccagaagcaggtggccggcaacagcatcagagaaaatggagccaagagccagcctgaccccttctgtgaaacagacagtgatgaggagatcctggagcagatcctggagctgcccctgcagcagttctgcagcaagaagctgttcagcatccctgaggaggaggaggaggaggaggaggatgaggaggaggagaagagcggggccggctgcagcagccgggaccccggccccccagagcccgccctgctgggcctgggctgtgacagcggccagcccaggaggcctggccagtgccccctgagccctgagagcagcagagctggggactgcctggaggacatgcctggcctggtgggcggcagcagcagaagaagaggaggcggcagccctgagaagccacccagcagaagaagacctccagacccccgggagcactgcagccggctgctgagcaacaacggcccccaggccagcggccgcctgggccccacccgggagcggggcggcctgcctgtgattgagggccccaggacaggcctggaggccagcggccggggccgcctgggccccagccgccgctgcagccggggccgggccctggagcccggcctggccagctgcctgagccccaagtgcctggagatcagcattgaatatgattctgaagatgagcaggaggccggcagcggcggcatcagcatcaccagcagctgctacccaggagatggagaggcctggggcacagccaccgtgggccggccccggggcccccccaaggccaacagcggccccaagccctacccccggctgcctgcctgggagaagggggagcctgagcggcggggccgcagcgccaccggccgggccaaggagcccctgagccgggccacagaaacaggagaggcccggggccaggacggcagcggccggcggggcccccagaagaggggcgtgcgggtgctgcggcccagcacagctgagctggtgcctgcccggagccccagcgagaccctggcctaccagcacctgcctgtgcgcatctttgtggccctgtttgattatgaccctgtgtccatgagccccaacccagatgctggggaggaggagctgcccttccgggagggccagatcctgaaggtgtttggagacaaggatgctgatggcttctaccagggcgagggcggcggccgcacaggctacatcccctgcaacatggtggccgaggtggccgtggacagccctgctggccggcagcagctgctgcagaggggctacctgagcccagacatcctgctggagggcagcggaaatggcccctttgtgtacagcacagcccacaccaccggccccccacccaagcccaggaggagcaagaaggccgagagcgagggccctgcccagccctgccccggcccccccaagctggtgcccagcgctgacctgaaggccccccacagcatggtggccgcctttgactacaacccccaggagagcagccccaacatggatgtggaggccgagctgcccttccgggctggagatgtgatcaccgtgtttggaggcatggatgatgatggcttctactatggagagctgaatggccagaggggcctggtgcccagcaacttcctggagggccctggccctgaggccggcggcctggaccgggagcccaggaccccccaggccgagagccagaggaccaggagaagaagagtgcagtgctag

SEQ ID NO: 145116 - DNA, 5574 bp, Artificial Sequence
  Description of Artificial Sequence: Synthetic coding sequence
atggagcagctgaccaccctgcccaggcctggggaccccggggccatggagccctgggccctgcccacctggcacagctggaccccaggccggggcggggagcccagcagcgctgcccccagcattgctgacaccccacctgctgccctgcagctgcaggagctgcggtctgaggagagcagcaagcccaagggagatggcagcagcaggcctgtgggcggcacagatcctgagggcgctgaggcctgcctgcccagcctgggccagcaggccagcagcagcggccctgcctgccagaggccagaagatgaggaggtggaggccttcctgaaggccaagctgaacatgagctttggagaccggcccaacctggagctgctgcgggccctgggggagctgcggcagagatgtgccatcctgaaggaggagaaccagatgctgaggaagagcagcttccctgagacagaggagaaggtgcggcggctgaagaggaagaatgctgagctggccgtcatcgccaagaggctggaggagcgggccaggaagctgcaggagaccaacctgcgggtggtgtctgcccccctgccccggcccggcaccagcctggagctgtgcaggaaggccctggcccggcagagggcccgggacctgtctgaaacagccagcgccctgctggccaaggacaagcagattgctgccctgcagagagaatgtcgggagctgcaggcccggctgaccctggtgggcaaggagggcccccagtggctgcacgtgcgggactttgaccggctgctgcgggagagccagcgggaggtgctgcggctgcagaggcagatcgccctgaggaaccagcgggagaccctgcccctgcccccatcctggcccccaggccctgccctgcaggcccgggccggggccccagcccctggggcccctggagaggccaccccccaggaggatgctgacaacctgcctgtgatcctgggggagcctgagaaggagcagagggtgcagcagctggagagcgagctgagcaagaagaggaagaagtgtgagagcctggagcaggaggccaggaagaagcagaggcgctgtgaggagctggagctgcagctgcggcaggcccagaatgaaaatgcccggctggtggaggagaacagccggctgagcggccgggccacagagaaggagcaggtggagtgggagaatgctgagctgcggggccagctgctgggcgtgacccaggagcgggacagcgccctgaggaagagccagggcctgcagagcaagctggagagcctggagcaggtgctgaagcacatgagggaggtggcccagaggcggcagcagctggaggtggagcacgagcaggcccggctgagcctgcgggagaagcaggaggaggtgcggcggctgcagcaggcccaggccgaggcccagcgggagcatgaaggagctgtgcagctgctggagagcaccctggacagcatgcaggcccgggtgcgggagctggaggagcagtgccgcagccagacagagcagttcagcctgctggcccaggagctgcaggccttccggctgcaccctggccccctggacctgctgaccagcgccctggactgtggcagcctgggggactgccccccaccaccctgctgctgcagcatcccccagccctgccggggcagcggccccaaggacctggacctgcccccaggcagccctggccgctgcacccccaagagcagcgagcccgccccagccaccctgactggagtgcccaggagaacagccaagaaggccgagagcctgagcaacagcagccacagcgagagcatccacaacagccccaagagctgccccaccccagaggtggacacagccagcgaggtggaggagctggaggccgacagcgtgtccctgctgcctgctgcccctgagggcagcagaggaggagcccgcatccaggtgttcctggcccgctacagctacaacccctttgagggccccaatgaaaatcctgaggccgagctgcccctgacagctggggagtacatctacatctacggcaacatggatgaagatggcttctttgaaggagagctgatggatggccggcggggcctggtgcccagcaactttgtggagcgggtgtctgatgatgacctgctgaccagcctgcccccagagctggccgacctgagccacagcagcggccctgagctgtccttcctgtctgtgggcggcggcggcagcagcagcggcggccagagctctgtgggccgcagccagcccaggcctgaggaggaggatgctggagatgagctgagcctgagccccagccctgagggcctgggggagcccccagctgtgccctacccccggcggctggtggtgctgaagcagctggcccacagcgtggtgctggcctgggagcccccacctgagcaggtggagctgcacggcttccacatctgtgtgaatggagagctgcggcaggccctgggccctggggccccacccaaggctgtgctggagaacctggacctgtgggccggccccctgcacatctctgtgcaggccctgaccagccggggcagcagtgaccccctgcgctgctgcctggccgtgggcgcccgggccggcgtggtgcccagccagctgcgggtgcaccggctgacagccaccagcgctgagatcacctgggtgcccggcaacagcaacctggcccacgccatctacctgaatggagaagaatgtcctccagccagccccagcacctactgggccaccttctgccacctgcggcccggcaccccctaccaggcccaggtggaggcccagctgcccccccagggcccctgggagcccggctgggagcggctggagcagagagctgccaccctgcagttcaccaccctgcctgctggccccccagatgcccccctggatgtgcagatcgagcccggccccagccctggcatcctgatcatctcctggctgcctgtgaccattgatgctgctggcaccagcaatggagtgcgggtgacaggctacgccatctatgcagatggccagaagatcatggaggtggccagccccacagctggctctgtgctggtggagctgagccagctgcagctgctgcaggtgtgccgggaggtggtggtgaggaccatgagcccccatggagagagcgctgacagcatcccagcccccatcaccccagccctggccccagccagcctgcctgcccgggtgtcctgccccagcccccaccccagccctgaggcccgggcccccctggccagcgccagccctggccctggggaccccagcagccccctgcagcacccagcccccctgggcacccaggagcccccaggggcccccccagccagccccagccgggagatggccaagggcagccatgaagatcctccagccccctgcagccaggaggaggccggggctgctgtgctgggcaccagcgaggagaggacagccagcaccagcaccctgggggagaaggaccccggccctgctgcccccagcctggccaagcaggaggccgagtggacagctggggaggcctgcccagccagcagcagcacccagggcgcccgggcccagcaggcccccaacacagagatgtgccagggcggggaccccggcagcggcctgcggcccagggctgagaaggaggacacagctgagctgggcgtgcacctggtgaacagcctggtggaccatggaagaaacagcgacctgagtgacatccaggaggaggaggaggaggaggaggaggaggaggaggaggagctgggcagcaggacctgcagcttccagaagcaggtggccggcaacagcatcagagaaaatggagccaagagccagcctgaccccttctgtgaaacagacagtgatgaggagatcctggagcagatcctggagctgcccctgcagcagttctgcagcaagaagctgttcagcatccctgaggaggaggaggaggaggaggaggatgaggaggaggagaagagcggggccggctgcagcagccgggaccccggccccccagagcccgccctgctgggcctgggctgtgacagcggccagcccaggaggcctggccagtgccccctgagccctgagagcagcagagctggggactgcctggaggacatgcctggcctggtgggcggcagcagcagaagaagaggaggcggcagccctgagaagccacccagcagaagaagacctccagacccccgggagcactgcagccggctgctgagcaacaacggcccccaggccagcggccgcctgggccccacccgggagcggggcggcctgcctgtgattgagggccccaggacaggcctggaggccagcggccggggccgcctgggccccagccgccgctgcagccggggccgggccctggagcccggcctggccagctgcctgagccccaagtgcctggagatcagcattgaatatgattctgaagatgagcaggaggccggcagcggcggcatcagcatcaccagcagctgctacccaggagatggagaggcctggggcacagccaccgtgggccggccccggggcccccccaaggccaacagcggccccaagccctacccccggctgcctgcctgggagaagggggagcctgagcggcggggccgcagcgccaccggccgggccaaggagcccctgagccgggccacagaaacaggagaggcccggggccaggacggcagcggccggcggggcccccagaagaggggcgtgcgggtgctgcggcccagcacagctgagctggtgcctgcccggagccccagcgagaccctggcctaccagcacctgcctgtgcgcatctttgtggccctgtttgattatgaccctgtgtccatgagccccaacccagatgctggggaggaggagctgcccttccgggagggccagatcctgaaggtgtttggagacaaggatgctgatggcttctaccagggcgagggcggcggccgcacaggctacatcccctgcaacatggtggccgaggtggccgtggacagccctgctggccggcagcagctgctgcagaggggctacctgagcccagacatcctgctggagggcagcggaaatggcccctttgtgtacagcacagcccacaccaccggccccccacccaagcccaggaggagcaagaaggccgagagcgagggccctgcccagccctgccccggcccccccaagctggtgcccagcgctgacctgaaggccccccacagcatggtggccgcctttgactacaacccccaggagagcagccccaacatggatgtggaggccgagctgcccttccgggctggagatgtgatcaccgtgtttggaggcatggatgatgatggcttctactatggagagctgaatggccagaggggcctggtgcccagcaacttcctggagggccctggccctgaggccggcggcctggaccgggagcccaggaccccccaggccgagagccagaggaccaggagaagaagagtgcagtgctag

SEQ ID NO: 145117 - DNA, 5724 bp, Artificial Sequence
  Description of Artificial Sequence: Synthetic coding sequence
atggagcagctgaccaccctgcccaggcctggggaccccggggccatggagccctgggccctgcccacctggcacagctggaccccaggccggggcggggagcccagcagcgctgcccccagcattgctgacaccccacctgctgccctgcagctgcaggagctgcggtctgaggagagcagcaagcccaagggagatggcagcagcaggcctgtgggcggcacagatcctgagggcgctgaggcctgcctgcccagcctgggccagcaggccagcagcagcggccctgcctgccagaggccagaagatgaggaggtggaggccttcctgaaggccaagctgaacatgagctttggagaccggcccaacctggagctgctgcgggccctgggggagctgcggcagagatgtgccatcctgaaggaggagaaccagatgctgaggaagagcagcttccctgagacagaggagaaggtgcggcggctgaagaggaagaatgctgagctggccgtcatcgccaagaggctggaggagcgggccaggaagctgcaggagaccaacctgcgggtggtgtctgcccccctgccccggcccggcaccagcctggagctgtgcaggaaggccctggcccggcagagggcccgggacctgtctgaaacagccagcgccctgctggccaaggacaagcagattgctgccctgcagagagaatgtcgggagctgcaggcccggctgaccctggtgggcaaggagggcccccagtggctgcacgtgcgggactttgaccggctgctgcgggagagccagcgggaggtgctgcggctgcagaggcagatcgccctgaggaaccagcgggagaccctgcccctgcccccatcctggcccccaggccctgccctgcaggcccgggccggggccccagcccctggggcccctggagaggccaccccccaggaggatgctgacaacctgcctgtgatcctgggggagcctgagaaggagcagagggtgcagcagctggagagcgagctgagcaagaagaggaagaagtgtgagagcctggagcaggaggccaggaagaagcagaggcgctgtgaggagctggagctgcagctgcggcaggcccagaatgaaaatgcccggctggtggaggagaacagccggctgagcggccgggccacagagaaggagcaggtggagtgggagaatgctgagctgcggggccagctgctgggcgtgacccaggagcgggacagcgccctgaggaagagccagggcctgcagagcaagctggagagcctggagcaggtgctgaagcacatgagggaggtggcccagaggcggcagcagctggaggtggagcacgagcaggcccggctgagcctgcgggagaagcaggaggaggtgcggcggctgcagcaggcccaggccgaggcccagcgggagcatgaaggagctgtgcagctgctggagagcaccctggacagcatgcaggcccgggtgcgggagctggaggagcagtgccgcagccagacagagcagttcagcctgctggcccaggagctgcaggccttccggctgcaccctggccccctggacctgctgaccagcgccctggactgtggcagcctgggggactgccccccaccaccctgctgctgcagcatcccccagccctgccggggcagcggccccaaggacctggacctgcccccaggcagccctggccgctgcacccccaagagcagcgagcccgccccagccaccctgactggagtgcccaggagaacagccaagaaggccgagagcctgagcaacagcagccacagcgagagcatccacaacagccccaagagctgccccaccccagaggtggacacagccagcgaggtggaggagctggaggccgacagcgtgtccctgctgcctgctgcccctgagggcagcagaggaggagcccgcatccaggtgttcctggcccgctacagctacaacccctttgagggccccaatgaaaatcctgaggccgagctgcccctgacagctggggagtacatctacatctacggcaacatggatgaagatggcttctttgaaggagagctgatggatggccggcggggcctggtgcccagcaactttgtggagcgggtgtctgatgatgacctgctgaccagcctgcccccagagctggccgacctgagccacagcagcggccctgagctgtccttcctgtctgtgggcggcggcggcagcagcagcggcggccagagctctgtgggccgcagccagcccaggcctgaggaggaggatgctggagatgagctgagcctgagccccagccctgagggcctgggggagcccccagctgtgccctacccccggcggctggtggtgctgaagcagctggcccacagcgtggtgctggcctgggagcccccacctgagcaggtggagctgcacggcttccacatctgtgtgaatggagagctgcggcaggccctgggccctggggccccacccaaggctgtgctggagaacctggacctgtgggccggccccctgcacatctctgtgcaggccctgaccagccggggcagcagtgaccccctgcgctgctgcctggccgtgggcgcccgggccggcgtggtgcccagccagctgcgggtgcaccggctgacagccaccagcgctgagatcacctgggtgcccggcaacagcaacctggcccacgccatctacctgaatggagaagaatgtcctccagccagccccagcacctactgggccaccttctgccacctgcggcccggcaccccctaccaggcccaggtggaggcccagctgcccccccagggcccctgggagcccggctgggagcggctggagcagagagctgccaccctgcagttcaccaccctgcctgctggccccccagatgcccccctggatgtgcagatcgagcccggccccagccctggcatcctgatcatctcctggctgcctgtgaccattgatgctgctggcaccagcaatggagtgcgggtgacaggctacgccatctatgcagatggccagaagatcatggaggtggccagccccacagctggctctgtgctggtggagctgagccagctgcagctgctgcaggtgtgccgggaggtggtggtgaggaccatgagcccccatggagagagcgctgacagcatcccagcccccatcaccccagccctggccccagccagcctgcctgcccgggtgtcctgccccagcccccaccccagccctgaggcccgggcccccctggccagcgccagccctggccctggggaccccagcagccccctgcagcacccagcccccctgggcacccaggagcccccaggggcccccccagccagccccagccgggagatggccaagggcagccatgaagatcctccagccccctgcagccaggaggaggccggggctgctgtgctgggcaccagcgaggagaggacagccagcaccagcaccctgggggagaaggaccccggccctgctgcccccagcctggccaagcaggaggccgagtggacagctggggaggcctgcccagccagcagcagcacccagggcgcccgggcccagcaggcccccaacacagagatgtgccagggcggggaccccggcagcggcctgcggcccagggctgagaaggaggacacagctgagctgggcgtgcacctggtgaacagcctggtggaccatggaagaaacagcgacctgagtgacatccaggaggaggaggaggaggaggaggaggaggaggaggaggagctgggcagcaggacctgcagcttccagaagcaggtggccggcaacagcatcagagaaaatggagccaagagccagcctgaccccttctgtgaaacagacagtgatgaggagatcctggagcagatcctggagctgcccctgcagcagttctgcagcaagaagctgttcagcatccctgaggaggaggaggaggaggaggaggatgaggaggaggagaagagcggggccggctgcagcagccgggaccccggccccccagagcccgccctgctgggcctgggctgtgacagcggccagcccaggaggcctggccagtgccccctgagccctgagagcagcagagctggggactgcctggaggacatgcctggcctggtgggcggcagcagcagaagaagaggaggcggcagccctgagaagccacccagcagaagaagacctccagacccccgggagcactgcagccggctgctgagcaacaacggcccccaggccagcggccgcctgggccccacccgggagcggggcggcctgcctgtgattgagggccccaggacaggcctggaggccagcggccggggccgcctgggccccagccgccgctgcagccggggccgggccctggagcccggcctggccagctgcctgagccccaagtgcctggagatcagcattgaatatgattctgaagatgagcaggaggccggcagcggcggcatcagcatcaccagcagctgctacccaggagatggagaggcctggggcacagccaccgtgggccggccccggggcccccccaaggccaacagcggccccaagccctacccccggctgcctgcctgggagaagggggagcctgagcggcggggccgcagcgccaccggccgggccaaggagcccctgagccgggccacagaaacaggagaggcccggggccaggacggcagcggccggcggggcccccagaagaggggcgtgcgggtgctgcggcccagcacagctgagctggtgcctgcccggagccccagcgagaccctggcctaccagcacctgcctgtgcgcatctttgtggccctgtttgattatgaccctgtgtccatgagccccaacccagatgctggggaggaggagctgcccttccgggagggccagatcctgaaggtgtttggagacaaggatgctgatggcttctaccagggcgagggcggcggccgcacaggctacatcccctgcaacatggtggccgaggtggccgtggacagccctgctggccggcagcagctgctgcagaggggctacctgagcccagacatcctgctggagggcagcggaaatggcccctttgtgtacagcacagcccacaccaccggccccccacccaagcccaggaggagcaagaaggccgagagcgagggccctgcccagccctgccccggcccccccaagctggtgcccagcgctgacctgaaggccccccacagcatggtggccgcctttgactacaacccccaggagagcagccccaacatggatgtggaggccgagctgcccttccgggctggagatgtgatcaccgtgtttggaggcatggatgatgatggcttctactatggagagctgaatggccagaggggcctggtgcccagcaacttcctggagggccctggccctgaggccggcggcctggaccgggagcccaggaccccccaggccgagagccaggactggggctgcaccacccagggcagccctggccccccaggcggcccctgcacccccagcagcggcagcgcccccagaattgagcggggggagccccagggccgctctgagaaggtgtggggcttcttcagcaagggcaagcagctgctgcggcggctgggcagcggcaagaaggagtag

SEQ ID NO: 145118 - DNA, 864 bp, Artificial Sequence
  Description of Artificial Sequence: Synthetic coding sequence
atggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccaccgtgagccacctgagccctgtgcacttctactacagaacagactgtgacagcagcaccaccagcctgtgcagcttccctgtggccaacgtgtccctgaccaagggcggccgggacagagtgctgatgtatggccagccctacagagtgaccctggagctggagctgcctgagagccctgtgaaccaggacctgggcatgttcctggtgaccatcagctgctacacccggggcggccgcatcatcagcaccagcagccgctctgtgatgctgcactacagaagtgacctgctgcagatgctggacaccctggtgttcagcagcctgctgctgtttggatttgctgagcagaagcagctgctggaggtggagctgtatgctgactacagagaaaattcctatgtgcccaccaccggggccatcatcgagatccacagcaagaggatccagctgtatggagcctacctgcgcatccacgcccacttcaccggcctgcggctgaccagcgagaaggagaccatccctggcaggaagagcaatgaaggcagcctgctgatcagccagggcctgaaggcccggcgcagccagctgaggaaccagatgctgcagaggatggtgcgggccctgaagatcccccagggccagagggtgtcctgccccaggagaagaaaccagatcagcagcccctag

SEQ ID NO: 145119 - DNA, 1389 bp, Artificial Sequence
  Description of Artificial Sequence: Synthetic coding sequence
atgagcacagagaaggtggaccagaaggaggaggccggggagaaggaggtgtgtggggaccagatcaagggccctgacaaggaggaggagcccccagctgctgccagccacggccagggctggaggcctgggggccgggccgccagaaatgcccggcctgagcccggggcccggcacccagccctgcctgccatggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccaccgtgagccacctgagccctgtgcacttctactacagaacagactgtgacagcagcaccaccagcctgtgcagcttccctgtggccaacgtgtccctgaccaagggcggccgggacagagtgctgatgtatggccagccctacagagtgaccctggagctggagctgcctgagagccctgtgaaccaggacctgggcatgttcctggtgaccatcagctgctacacccggggcggccgcatcatcagcaccagcagccgctctgtgatgctgcactacagaagtgacctgctgcagatgctggacaccctggtgttcagcagcctgctgctgtttggatttgctgagcagaagcagctgctggaggtggagctgtatgctgactacagagaaaattcctatgtgcccaccaccggggccatcatcgagatccacagcaagaggatccagctgtatggagcctacctgcgcatccacgcccacttcaccggcctgcgctacctgctgtacaacttccccatgacctgtgccttcatcggcgtggccagcaacttcaccttcctgtctgtgattgtgctcttctcctacatgcagtgggtgtggggcggcatctggcccaggcaccgcttcagcctgcaggtgaacatcaggaagagggacaacagcaggaaggaggtgcagaggcgcatcagcgcccaccagcccggccctgagggccaggaggagagcaccccccagagtgatgtgacagaagatggagagagccctgaggaccccagcggcacagagggccagctgtctgaggaggagaagccagaccagcagcccctgagcggggaggaggagctggagcctgaggccagtgatggcagcggctcctgggaggatgctgccctgctgacagaggccaacctgcctgccccagccccagccagcgccagcgcccctgtgctggagaccctgggcagcagcgagcctgctggaggagccctgcggcagaggcccacctgcagcagcagctag

SEQ ID NO: 145120 - DNA, 1197 bp, Artificial Sequence
  Description of Artificial Sequence: Synthetic coding sequence
atggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccaccgtgagccacctgagccctgtgcacttctactacagaacagactgtgacagcagcaccaccagcctgtgcagcttccctgtggccaacgtgtccctgaccaagggcggccgggacagagtgctgatgtatggccagccctacagagtgaccctggagctggagctgcctgagagccctgtgaaccaggacctgggcatgttcctggtgaccatcagctgctacacccggggcggccgcatcatcagcaccagcagccgctctgtgatgctgcactacagaagtgacctgctgcagatgctggacaccctggtgttcagcagcctgctgctgtttggatttgctgagcagaagcagctgctggaggtggagctgtatgctgactacagagaaaattcctatgtgcccaccaccggggccatcatcgagatccacagcaagaggatccagctgtatggagcctacctgcgcatccacgcccacttcaccggcctgcgctacctgctgtacaacttccccatgacctgtgccttcatcggcgtggccagcaacttcaccttcctgtctgtgattgtgctcttctcctacatgcagtgggtgtggggcggcatctggcccaggcaccgcttcagcctgcaggtgaacatcaggaagagggacaacagcaggaaggaggtgcagaggcgcatcagcgcccaccagcccggccctgagggccaggaggagagcaccccccagagtgatgtgacagaagatggagagagccctgaggaccccagcggcacagagggccagctgtctgaggaggagaagccagaccagcagcccctgagcggggaggaggagctggagcctgaggccagtgatggcagcggctcctgggaggatgctgccctgctgacagaggccaacctgcctgccccagccccagccagcgccagcgcccctgtgctggagaccctgggcagcagcgagcctgctggaggagccctgcggcagaggcccacctgcagcagcagctag

SEQ ID NO: 145121 - DNA, 1197 bp, Artificial Sequence; identical to SEQ ID NO: 145120
  Description of Artificial Sequence: Synthetic coding sequence

SEQ ID NO: 145122 - DNA, 1197 bp, Artificial Sequence; identical to SEQ ID NO: 145120
  Description of Artificial Sequence: Synthetic coding sequence

SEQ ID NO: 145123 - DNA, 1389 bp, Artificial Sequence; identical to SEQ ID NO: 145119
  Description of Artificial Sequence: Synthetic coding sequence

SEQ ID NO: 145124 - DNA, 672 bp, Artificial Sequence
  Description of Artificial Sequence: Synthetic coding sequence
atggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccaccgtgagccacctgagccctgtgcacttctactacagaacagactgtgacagcagcaccaccagcctgtgcagcttccctgtggccaacgtgtccctgaccaagggcggccgggacagagtgctgatgtatggccagccctacagagtgaccctggagctggagctgcctgagagccctgtgaaccaggacctgggcatgttcctggtgaccatcagctgctacacccggggcggccgcatcatcagcaccagcagccgctctgtgatgctgcactacagaagtgacctgctgcagatgctggacaccctggtgttcagcagcctgctgctgtttggatttgctgagcagaagcagctgctggaggtggagctgtatgctgactacagagaaaattcctatgtgcccaccaccggggccatcatcgagatccacagcaagaggatccagctgtatggagcctacctgcgcatccacgcccacttcaccggcctgtag

SEQ ID NO: 145125 - DNA, 282 bp, Artificial Sequence
  Description of Artificial Sequence: Synthetic coding sequence
atgagcacagagaaggtggaccagaaggaggaggccggggagaaggaggtgtgtggggaccagatcaagggccctgacaaggaggaggagcccccagctgctgccagccacggccagggctggaggcctgggggccgggccgccagaaatgcccggcctgagcccggggcccggcacccagccctgcctgccatggtgaatgacccccctgtgcctgccctgctgtgggcccaggaggtgggccaggtgctggccggccgggcccggcggctgctgctgtag

SEQ ID NO: 145126 - DNA, 681 bp, Artificial Sequence
  Description of Artificial Sequence: Synthetic coding sequence
atgagcacagagaaggtggaccagaaggaggaggccggggagaaggaggtgtgtggggaccagatcaagggccctgacaaggaggaggagcccccagctgctgccagccacggccagggctggaggcctgggggccgggccgccagaaatgcccggcctgagcccggggcccggcacccagccctgcctgccatggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccaccgtgagccacctgagccctgtgcacttctactacagaacagactgtgacagcagcaccaccagcctgtgcagcttccctgtggccaacgtgtccctgaccaagggcggccgggacagagtgctgatgtatggccagccctacagagtgaccctggagctggagctgcctgagagccctgtgaaccaggacctgggcatgttcctggtgaccatcagctgctacacccggggcggccgcatcatcagcaccagcagccgctctgtgatgctgcactacagaagtgacctgctgcagatgctggacaccctgtag

SEQ ID NO: 145127 - DNA, 72 bp, Artificial Sequence
  Description of Artificial Sequence: Synthetic coding sequence
atgagcacagagaaggtggaccagaaggaggaggccggggagaaggaggtgtgtggggaccagatcaagtag

SEQ ID NO: 145128 - DNA, 87 bp, Artificial Sequence
  Description of Artificial Sequence: Synthetic coding sequence
atgagcacagagaaggtggaccagaaggaggaggccggggagaaggaggtgtgtggggaccagatcaagggccctgacaaggagtag

SEQ ID NO: 145129 - DNA, 372 bp, Artificial Sequence
  Description of Artificial Sequence: Synthetic coding sequence
atgagcacagagaaggtggaccagaaggaggaggccggggagaaggaggtgtgtggggaccagatcaagggccctgacaaggaggaggagcccccagctgctgccagccacggccagggctggaggcctgggggccgggccgccagaaatgcccggcctgagcccggggcccggcacccagccctgcctgccatggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccacctag

SEQ ID NO: 145130 - DNA, 300 bp, Artificial Sequence
  Description of Artificial Sequence: Synthetic coding sequence
atggtgaatgacccccctgtgcctgccctgctgtgggcccaggaggtgggccaggtgctggccggccgggcccggcggctgctgctgcagtttggagtgctcttctgcaccatcctgctgctgctgtgggtgtctgtgttcctgtatggcagcttctactacagctacatgcccaccgtgagccacctgagccctgtgcacttctactacagaacagactgtgacagcagcaccaccagcctgtgcagcttccctgtggccaacgtgtccctgaccaagggcggccgggacagagtgtag

SEQ ID NO: 145131 - DNA, 879 bp, Artificial Sequence
  Description of Artificial Sequence: Synthetic coding sequence
atggagttccagcccaaccaggaggatgaagaagatgcccatgctggcatcatcggccgcttcctgggcctgcagagccatgaccaccaccccccccgggccaacagcaggaccaagctgctgtggcccaagcgggagagcctgctgcacgagggcctgcccaagaaccacaaggccgccaagcagaatgtgcggggccaggaggacaacaaggcctggaagctgaaggctgtggatgccttcaagagcgcccccctgtaccagaggcctggctactacagcgccccccagacccccctgagccccacccccatgttcttccccctggagcccagcgcccccagcaagctgcacagcgtgactggaattgacaccaaggacaagagcctgaagacagtgtcctctggggccaagaagagctttgagctgctgtctgagagtgatggagccctgatggagcaccctgaggtgtcccaggtgcggaggaagacagtggagttcaacctgacagacatgcctgagatccctgagaaccacctgaaggagcccctggagcagagccccaccaacatccacaccaccctgaaggaccacatggacccctactgggccctggagaacagatctgtgctgcacctgaaccagggccactgcatcgccctgtgccccaccccagccagcctggccctgagcctgcccttcctgcacaacttcctgggcttccaccactgccagagcaccctggacctgcggcctgccctggcctggggcatctacctggccaccttcaccggcatcctgggcaaatgttctggccccttcctgaccagcccctggtaccaccctgaggacttcctgggccctggagagggccgctag

SEQ ID NO: 145132 - DNA, 1497 bp, Artificial Sequence
  Description of Artificial Sequence: Synthetic coding sequence
atgtttgagaagctgaccctgtactgtgacagctacatccagctgatccccatcagctttgtgctgggcttctacgtgaccctggtggtgacccgctggtggaaccagtatgagaacctgccctggccagaccggctgatgagcctggtgtctggctttgtggagggcaaggatgagcagggccgcctgctgcggaggaccctcatccgctatgccaacctgggcaatgtgctgatcctgcggtctgtgtccacagctgtgtacaagcgcttccccagcgcccagcacctggtgcaggccggcttcatgaccccagctgagcacaagcagctggagaagctgagcctgccccacaacatgttctgggtgccctgggtgtggtttgccaacctgtccatgaaggcctggctgggcggccgcatccgggaccccatcctgctgcagagcctgctgaatgagatgaacaccctgcggacccagtgtggccacctgtatgcctatgactggatcagcatccccctggtgtacacccaggtggtgacagtggccgtgtacagcttcttcctgacctgcctggtgggccggcagttcctgaacccagccaaggcctacccaggccacgagctggacctggtggtgcctgtgttcaccttcctgcagttcttcttctacgtgggctggctgaaggtgtccctgctggccgtggatgagatgcaccaggacctgcccaggatggagccagacatgtactggaacaagccagagccccagcccccctacacagctgccagcgcccagttccggcgggccagcttcatgggcagcaccttcaacatcagcctgaacaaggaggagatggagttccagcccaaccaggaggatgaggaggatgcccacgccggcatcatcggccgcttcctgggcctgcagagccatgaccaccaccccccccgggccaacagcaggaccaagctgctgtggcccaagcgggagagcctgctgcacgagggcctgcccaagaaccacaaggccgccaagcagaatgtgcggggccaggaggacaacaaggcctggaagctgaaggctgtggatgccttcaagagcgcccccctgtaccagaggcctggctactacagcgccccccagacccccctgagccccacccccatgttcttccccctggagcccagcgcccccagcaagctgcacagcgtgacaggcatcgacaccaaggacaagagcctgaagacagtgagcagcggggccaagaagagctttgagctgctgtctgagagtgatggagccctgatggagcaccctgaggtgtcccaggtgcggaggaagacagtggagttcaacctgacagacatgcctgagatccctgagaaccacctgaaggagcccctggagcagagccccaccaacatccacaccaccctgaaggaccacatggacccctactgggccctggagaacagagatgaggcccacagctag

SEQ ID NO: 145133 - DNA, 1758 bp, Artificial Sequence
  Description of Artificial Sequence: Synthetic coding sequence
atgaccatcacctacaccagccaggtggccaatgcccggctgggcagcttcagccggctgctgctgtgctggaggggcagcatctacaagctgctgtatggagagttcctgatcttcctgctgtgctactacatcatccgcttcatctaccgcctggccctgacagaggagcagcagctgatgtttgagaagctgaccctgtactgtgacagctacatccagctgatccccatcagctttgtgctgggcttctacgtgaccctggtggtgacccgctggtggaaccagtatgagaacctgccctggccagaccggctgatgagcctggtgtctggctttgtggagggcaaggatgagcagggccgcctgctgcggaggaccctcatccgctatgccaacctgggcaatgtgctgatcctgcggtctgtgtccacagctgtgtacaagcgcttccccagcgcccagcacctggtgcaggccggcttcatgaccccagctgagcacaagcagctggagaagctgagcctgccccacaacatgttctgggtgccctgggtgtggtttgccaacctgtccatgaaggcctggctgggcggccgcatccgggaccccatcctgctgcagagcctgctgaatgagatgaacaccctgcggacccagtgtggccacctgtatgcctatgactggatcagcatccccctggtgtacacccaggtggtgacagtggccgtgtacagcttcttcctgacctgcctggtgggccggcagttcctgaacccagccaaggcctacccaggccacgagctggacctggtggtgcctgtgttcaccttcctgcagttcttcttctacgtgggctggctgaaggtggccgagcagctgatcaacccctttggagaagatgatgatgactttgagaccaactggatcgtggacaggaacctgcaggtgtccctgctggccgtggatgagatgcaccaggacctgcccaggatggagccagacatgtactggaacaagccagagccccagcccccctacacagctgccagcgcccagttcagaagagccagcttcatgggcagcaccttcaacatcagcctgaacaaggaggagatggagttccagcccaaccaggaggatgaagaagatgcccatgctggcatcatcggccgcttcctgggcctgcagagccatgaccaccaccccccccgggccaacagcaggaccaagctgctgtggcccaagcgggagagcctgctgcacgagggcctgcccaagaaccacaaggccgccaagcagaatgtgcggggccaggaggacaacaaggcctggaagctgaaggctgtggatgccttcaagagcgcccccctgtaccagaggcctggctactacagcgccccccagacccccctgagccccacccccatgttcttccccctggagcccagcgcccccagcaagctgcacagcgtgactggaattgacaccaaggacaagagcctgaagacagtgtcctctggggccaagaagagctttgagctgctgtctgagagtgatggagccctgatggagcaccctgaggtgtcccaggtgcggaggaagacagtggagttcaacctgacagacatgcctgagatccctgagaaccacctgaaggagcccctggagcagagccccaccaacatccacaccaccctgaaggaccacatggacccctactgggccctggagaacagagatgaggcccacagctag

SEQ ID NO: 145134 - DNA, 813 bp, Artificial Sequence
  Description of Artificial Sequence: Synthetic coding sequence
atgaccatcacctacaccagccaggtggccaatgcccggctgggcagcttcagccggctgctgctgtgctggaggggcagcatctacaagctgctgtatggagagttcctgatcttcctgctgtgctactacatcatccgcttcatctaccgcctggccctgacagaggagcagcagctgatgtttgagaagctgaccctgtactgtgacagctacatccagctgatccccatcagctttgtgctgggcttctacgtgaccctggtggtgacccgctggtggaaccagtatgagaacctgccctggccagaccggctgatgagcctggtgtctggctttgtggagggcaaggatgagcagggccgcctgctgcggaggaccctcatccgctatgccaacctgggcaatgtgctgatcctgcggtctgtgtccacagctgtgtacaagcgcttccccagcgcccagcacctggtgcaggccggcttcatgaccccagctgagcacaagcagctggagaagctgagcctgccccacaacatgttctgggtgccctgggtgtggtttgccaacctgtccatgaaggcctggctgggcggccgcatccgggaccccatcctgctgcagagcctgctgaatgagatgaacaccctgcggacccagtgtggccacctgtatgcctatgactggatcagcatccccctggtgtacacccagcctgagcagagaggagatggagtgcctgcccagagcggcggccggggcggctgcagccgctggcaccactggcccctgcccaggcctgctgtgccctag

SEQ ID NO: 145135 - DNA, 1815 bp, Artificial Sequence
  Description of Artificial Sequence: Synthetic coding sequence
atgtttgagaagctgaccctgtactgtgacagctacatccagctgatccccatcagctttgtgctgggcttctacgtgaccctggtggtgacccgctggtggaaccagtatgagaacctgccctggccagaccggctgatgagcctggtgtctggctttgtggagggcaaggatgagcagggccgcctgctgcggaggaccctcatccgctatgccaacctgggcaatgtgctgatcctgcggtctgtgtccacagctgtgtacaagcgcttccccagcgcccagcacctggtgcaggccggcttcatgaccccagctgagcacaagcagctggagaagctgagcctgccccacaacatgttctgggtgccctgggtgtggtttgccaacctgtccatgaaggcctggctgggcggccgcatccgggaccccatcctgctgcagagcctgctgaatgagatgaacaccctgcggacccagtgtggccacctgtatgcctatgactggatcagcatccccctggtgtacacccaggtggtgacagtggccgtgtacagcttcttcctgacctgcctggtgggccggcagttcctgaacccagccaaggcctacccaggccacgagctggacctggtggtgcctgtgttcaccttcctgcagttcttcttctacgtgggctggctgaaggtggccgagcagctgatcaacccctttggagaagatgatgatgactttgagaccaactggatcgtggacaggaacctgcaggtgtccctgctggccgtggatgagatgcaccaggacctgcccaggatggagccagacatgtactggaacaagccagagccccagcccccctacacagctgccagcgcccagttcagaagagccagcttcatgggcagcaccttcaacatcagcctgaacaaggaggagatggagttccagcccaaccaggaggatgaagaagatgcccatgctggcatcatcggccgcttcctgggcctgcagagccatgaccaccaccccccccgggccaacagcaggaccaagctgctgtggcccaagcgggagagcctgctgcacgagggcctgcccaagaaccacaaggccgccaagcagaatgtgcggggccaggaggacaacaaggcctggaagctgaaggctgtggatgccttcaagagcgcccccctgtaccagaggcctggctactacagcgccccccagacccccctgagccccacccccatgttcttccccctggagcccagcgcccccagcaagctgcacagcgtgactggaattgacaccaaggacaagagcctgaagacagtgtcctctggggccaagaagagctttgagctgctgtctgagagtgatggagccctgatggagcaccctgaggtgtcccaggtgcggaggaagacagtggagttcaacctgacagacatgcctgagatccctgagaaccacctgaaggagcccctggagcagagccccaccaacatccacaccaccctgaaggaccacatggacccctactgggccctggagaacagatctgtgctgcacctgaaccagggccactgcatcgccctgtgccccaccccagccagcctggccctgagcctgcccttcctgcacaacttcctgggcttccaccactgccagagcaccctggacctgcggcctgccctggcctggggcatctacctggccaccttcaccggcatcctgggcaaatgttctggccccttcctgaccagcccctggtaccaccctgaggacttcctgggccctggagagggccgctag

SEQ ID NO: 145136 - DNA, 1530 bp, Artificial Sequence
  Description of Artificial Sequence: Synthetic coding sequence
atgacagtgacctacacagcccgggtggccaatgccaggtttggaggcttcagccagctgctgctgctgtggaggggcagcatctacaagctgctgtggagggagctgctgtgcttcctgggcttctacatggccctgtctgctgcctacagatttgtgctgacagagggccagaagcgctactttgagaagctggtgatctactgtgaccagtatgccagcctcatccctgtgtcctttgtgctgggcttctacgtgaccctggtggtgaaccgctggtggagccagtacctgtgcatgcccctgcctgatgccctgatgtgtgtggtggccggcaccgtgcacggcagagatgaccggggccgcctgtacagaaggaccctgatgagatatgccggcctgtctgctgtgctgatcctgcggtctgtgtccacagctgtgttcaagcgcttccccaccatcgaccacgtggtggaggccggcttcatgacccgggaggagaggaagaagtttgagaacctgaacagcagctacaacaagtactgggtgccctgtgtgtggttcagcaacctggccgcccaggcccggcgggagggccgcatccgggacaacagcgccctgaagctgctgctggaggagctgaatgtgttccggggcaaatgtggcatgctgttccactatgactggatctctgtgcccctggtgtacacccaggtggtgaccatcgccctgtacagctacttcctggcctgcctgattggccggcagttcctggaccctgcccagggctacaaggaccatgacctggacctgtgtgtgcccatcttcaccctgctgcagttcttcttctacgccggctggctgaaggtggccgagcagctgatcaacccctttggagaagatgatgatgactttgagaccaacttcctgattgacaggaacttccaggtgtccatgctggccgtggatgagatgtatgatgacctggccgtgctggagaaggacctgtactgggatgctgctgaggcccgggccccctacacagctgccaccgtcttccagctgcggcagcccagcttccagggcagcacctttgacatcaccctggccaaggaggacatgcagttccagaggctggatggcctggatggccccatgggagaggcccctggggacttcctgcagaggctgctgcctgctggggccggcatggtggccggcggccccctgggccggcggctgtccttcctgctgaggaagaacagctgtgtgtctgaggccagcactggagccagctgcagctgtgctgtggtgcctgagggcgccgccccagaatgttcctgtggggaccccctgctggaccccggcctgcctgagcctgaggcccctcctcctgctggccctgagcccctgaccctcatccctggccctgtggagcccttcagcatcgtgaccatgcctggcccccggggccctgccccaccctggctgcccagccccatcggggaggaggaggagaacctggcctag

SEQ ID NO: 145137 - DNA, 1530 bp, Artificial Sequence; identical to SEQ ID NO: 145136
  Description of Artificial Sequence: Synthetic coding sequence

SEQ ID NO: 145138 - DNA, 1530 bp, Artificial Sequence; identical to SEQ ID NO: 145136
  Description of Artificial Sequence: Synthetic coding sequence

SEQ ID NO: 145139 - DNA, 219 bp, Artificial Sequence
  Description of Artificial Sequence: Synthetic coding sequence
atgttcctgatcagcagctctgtgcacggcagtgatgagcacggccgcctgctgcggaggaccctgatgagatatgtgaacctgaccagcctgctgatcttccgctctgtgtccacagctgtgtacaagcgcttccccaccatggaccacgtggtggaggccgagaggacaggcatgaagcccatcctgcccagcagctttgagatgcagagcttctag

SEQ ID NO: 145140 - DNA, 2007 bp, Artificial Sequence
  Description of Artificial Sequence: Synthetic coding sequence
atgacagtgacctacagcagcaaggtggccaatgccaccttcttcggcttccaccggctgctgctgaagtggaggggcagcatctacaagctgctgtaccgggagttcatcgtgtttgctgtgctgtacacagccatcagcctggtgtaccgcctgctgctgactggagtgcagaagcgctactttgagaagctgagcatctactgtgacagatatgcagagcagatccctgtgacctttgtgctgggcttctacgtgaccctggtggtgaaccgctggtggaaccagtttgtgaacctgccctggccagaccggctgatgttcctgatcagcagctctgtgcacggcagtgatgagcacggccgcctgctgcggaggaccctgatgagatatgtgaacctgaccagcctgctgatcttccgctctgtgtccacagctgtgtacaagcgcttccccaccatggaccacgtggtggaggccggcttcatgaccacagatgagaggaagctgttcaaccacctgaagagcccccacctgaagtactgggtgcccttcatctggtttggaaacctggccaccaaggccagaaatgaaggccgcatccgggacagcgtggacctgcagagcctgatgacagagatgaaccgctaccgctcctggtgcagcctgctgtttggctatgactgggtgggcatccccctggtgtacacccaggtggtgaccctggccgtgtacaccttcttctttgcctgcctgattggccggcagttcctggaccccaccaagggctacgccggccatgacctggacctgtacatccccatcttcaccctgctgcagttcttcttctacgccggctggctgaaggtggccgagcagctgatcaacccctttggagaagatgatgatgactttgagaccaactggtgcatcgacaggaacctgcaggtgtccctgctggccgtggatgagatgcacatgagcctgcccaagatgaagaaggacatctactgggatgattctgctgcccggcccccctacaccctggccgctgctgactactgcatccccagcttcctgggcagcacagtgcagatgggcctgagcggcagtgacttcccagatgaggagtggctgtgggactatgagaagcacggccaccgccacagcatgatcagaagagtgaagcgcttcctgagcgcccacgagcaccccagcagcccccggcggcgcagctaccgccggcagaccagtgacagctccatgttcctgcccagagatgacctgagccctgcccgggacctgctggatgtgcccagcagaaatccaccccgggccagccccacctggaagaagagctgcttccctgagggcagccccaccctgcacttctccatgggagagctgagcaccatccgggagaccagccagaccagcaccctgcagagcctgaccccccagagctctgtgaggaccagccccatcaagatgcccctggtgcctgaggtgctgatcacagctgctgaggcccctgtgcccaccagcggcggctaccaccacgacagcgccaccagcatcctgagcagcgagttcaccggggtgcagcccagcaagacagagcagcagcagggccccatgggcagcatcctgagccccagcgagaaggagaccccacctgggggccccagcccccagacagtgtctgccagcgctgaggagaacatcttcaactgtgaggaggaccccggggacaccttcctgaagcgctggagcctgcccggcttcctgggcagcagccacaccagcctgggcaacctgagcccagaccccatgagcagccagcctgccctgctgattgacacagagaccagcagcgagatcagcggcatcaacatcgtggccggcagccgggtgtccagtgacatgctgtacctgatggagaacctggacaccaaggagacagacatcatcgagctgaacaaggagacagaggagagccccaagtag

SEQ ID NO: 145141 - DNA, 1197 bp, Artificial Sequence
  Description of Artificial Sequence: Synthetic coding sequence
atgacagtgacctacagcagcaaggtggccaatgccaccttcttcggcttccaccggctgctgctgaagtggaggggcagcatctacaagctgctgtaccgggagttcatcgtgtttgctgtgctgtacacagccatcagcctggtgtaccgcctgctgctgactggagtgcagaagcgctactttgagaagctgagcatctactgtgacagatatgcagagcagatccctgtgacctttgtgctgggcttctacgtgaccctggtggtgaaccgctggtggaaccagtttgtgaacctgccctggccagaccggctgatgttcctgatcagcagctctgtgcacggcagtgatgagcacggccgcctgctgcggaggaccctgatgagatatgtgaacctgaccagcctgctgatcttccgctctgtgtccacagctgtgtacaagcgcttccccaccatggaccacgtggtggaggccggcttcatgaccacagatgagaggaagctgttcaaccacctgaagagcccccacctgaagtactgggtgcccttcatctggtttggaaacctggccaccaaggccagaaatgaaggccgcatccgggacagcgtggacctgcagagcctgatgacagagatgaaccgctaccgctcctggtgcagcctgctgtttggctatgactgggtgggcatccccctggtgtacacccaggtggtgaccctggccgtgtacaccttcttctttgcctgcctgattggccggcagttcctggaccccaccaagggctacgccggccatgacctggacctgtacatccccatcttcaccctgctgcagttcttcttctacgccggctggctgaaggtggccgagcagctgatcaacccctttggagaagatgatgatgactttgagaccaactggtgcatcgacaggaacctgcaggtgtccctgctggccgtggatgagatgcacatgagcctgcccaagatgaagaaggacatctactgggatgattctgctgcccggcccccctacaccctggccgctgctgactactgcatccccagcttcctgggcagcacagtgcagatgggcaagcagatgcccaagaatgagtggaagatggaggacatcaagatccccctgccccagccccagttccagtgtgccaagagtgaccccggcggctag

SEQ ID NO: 145142 - DNA, 219 bp, Artificial Sequence; identical to SEQ ID NO: 145139
  Description of Artificial Sequence: Synthetic coding sequence

SEQ ID NO: 145143 - DNA, 1368 bp, Artificial Sequence
  Description of Artificial Sequence: Synthetic coding sequence
atgaccacagatgagaggaagctgttcaaccacctgaagagcccccacctgaagtactgggtgcccttcatctggtttggaaacctggccaccaaggccagaaatgaaggccgcatccgggacagcgtggacctgcagagcctgatgacagagatgaaccgctaccgctcctggtgcagcctgctgtttggctatgactgggtgggcatccccctggtgtacacccaggtggccgagcagctgatcaacccctttggagaagatgatgatgactttgagaccaactggtgcatcgacaggaacctgcaggtgtccctgctggccgtggatgagatgcacatgagcctgcccaagatgaagaaggacatctactgggatgacagcgctgcccggcccccctacaccctggccgctgctgactactgcatccccagcttcctgggcagcacagtgcagatgggcctgagcggcagtgacttcccagatgaggagtggctgtgggactatgagaagcacggccaccgccacagcatgatccggcgggtgaagcgcttcctgagcgcccacgagcaccccagcagccccaggagaagaagctaccgccggcagaccagtgacagctccatgttcctgcccagagatgacctgagccctgcccgggacctgctggatgtgcccagcaggaaccccccccgggccagccccacctggaagaagagctgcttccctgagggcagccccaccctgcacttctccatgggagagctgagcaccatccgggagaccagccagaccagcaccctgcagagcctgaccccccagagctctgtgaggaccagccccatcaagatgcccctggtgcctgaggtgctgatcacagctgctgaggcccctgtgcccaccagcggcggctaccaccatgattctgccaccagcatcctgagcagcgagttcaccggggtgcagcccagcaagacagagcagcagcagggccccatgggcagcatcctgagccccagcgagaaggagaccccacctgggggccccagcccccagacagtgtctgccagcgctgaggagaacatcttcaactgtgaagaagatcctggggacaccttcctgaagcgctggagcctgcccggcttcctgggcagcagccacaccagcctgggcaacctgagcccagaccccatgagcagccagcctgccctgctgattgacacagagaccagcagcgagatcagcggcatcaacatcgtggccggcagccgggtgtccagtgacatgctgtacctgatggagaacctggacaccaaggagacagacatcatcgagctgaacaaggagacagaggagagccccaagtag

SEQ ID NO: 145144 - DNA, 219 bp, Artificial Sequence; identical to SEQ ID NO: 145139
  Description of Artificial Sequence: Synthetic coding sequence

SEQ ID NO: 145145 - DNA, 1422 bp, Artificial Sequence
  Description of Artificial Sequence: Synthetic coding sequence
atgacagtgtcctacaccctgaaggtggccgaggccaggtttggaggcttcagcggcctgctgctgcgctggaggggcagcatctacaagctgctgtacaaggagttcctgctgtttggagccctgtatgctgtgctgagcatcacctaccgcctgctgctgacccaggagcagcgctacgtgtatgcccaggtggcccgctactgcaacagatctgctgacctgatccccctgagctttgtgctgggcttctacgtgaccctggtggtgaaccgctggtggagccagtacaccagcatccccctgcctgaccagctgatgtgtgtgatcagcgcctctgtgcatggagtggaccagaggggccgcctgctgcggaggaccctcatccgctatgccaacctggcctctgtgctggtgctgcggtctgtgtccaccagggtgctgaagcgcttccccaccatggagcacgtggtggatgctggcttcatgagccaggaggagaggaagaagtttgagagcctgaagagtgacttcaacaagtactgggtgccctgtgtgtggttcaccaacctggccgcccaggccaggagagatggccgcatcagagatgacatcgccctgtgcctgctgctggaggagctgaacaagtaccgggccaagtgcagcatgctgttccactatgactggatcagcatccccctggtgtacacccaggtggtgaccatcgctgtgtacagcttctttgccctgagcctggtgggccggcagtttgtggagcctgaggccggggccgccaagccccagaagctgctgaagccaggccaggagcccgccccagccctgggggaccctgacatgtatgtgcccctgaccaccctgctgcagttcttcttctacgccggctggctgaaggtggccgagcagatcatcaacccctttggagaagatgatgatgactttgagaccaaccagctgattgacaggaacctgcaggtgtccctgctgtctgtggatgagatgtaccagaacctgcccccagctgagaaggaccagtactgggatgaggaccagccccagcccccctacacagtggccacagctgctgagagcctgcggcccagcttcctgggcagcaccttcaacctgaggatgtctgatgatcctgagcagagcctgcaggtggaggccagccctggcagcggccgcccagccccagctgcccagacccccctgctgggccgcttcctgggcgtgggcgcccccagccctgccatcagcctgaggaactttggccgggtgcggggcacccccaggcctccccacctgctgcgcttccgggcagaggagggcggggaccctgaggccgccgccagaattgaggaggagagcgctgagagcggagatgaggccctggagccctag

SEQ ID NO: 145146 - DNA, 294 bp, Artificial Sequence
  Description of Artificial Sequence: Synthetic coding sequence
atgtacctgggcatcacccccagcgtgacctgcaacaacagcagcaagaatgagttcagcctcatcctggagaagaaccccctggtggagtttgtggaggagctgcctgctggccgcagcagcctgtgctactgcaacctgctgtgtggcatcatccggggggccctggagatggtgcacctggccgcagatgtgaccttcctgcaggaccggctgaagggggacagcgtgacagagatcggcatcaccttcctgaagaagagagatgagaagaagtaccggggcaagaagtag

SEQ ID NO: 145147 - DNA, 546 bp, Artificial Sequence
  Description of Artificial Sequence: Synthetic coding sequence
atgagcaggcctgcccacagaagacctgagtaccacaagatcaacaaggacctgtttgtgctgacctatggagccctggtggcccagctgtgcaaggactatgagaaggatgaagatgtgaaccagtacctggacaagatgggctatggaattggcacccggctggtggaggacttcctggcccggagctgtgtgggccgctgccacagctacagcgagatcatcgacatcatcgcccaggtggccttcaagatgtacctgggcatcacccccagcgtgacctgcaacaacagcagcaagaatgagttcagcctcatcctggagaagaaccccctggtggagtttgtggaggagctgcctgctggccgcagcagcctgtgctactgcaacctgctgtgtggcatcatccggggggccctggagatggtgcacctggccgcagatgtgaccttcctgcaggaccggctgaagggggacagcgtgacagagatcggcatcaccttcctgaagaagagagatgagaagaagtaccggggcaagaagtag

SEQ ID NO: 145148 - DNA, 504 bp, Artificial Sequence
  Description of Artificial Sequence: Synthetic coding sequence
aacaaggacctgtttgtgctgacctatggagccctggtggcccagctgtgcaaggactatgagaaggatgaagatgtgaaccagtacctggacaagatgggctatggaattggcacccggctggtggaggacttcctggcccggagctgtgtgggccgctgccacagctacagcgagatcatcgacatcatcgcccaggtggccttcaagatgtacctgggcatcacccccagcgtgacctgcaacaacagcagcaagaatgagttcagcctcatcctggagaagaaccccctggtggagtttgtggaggagctgcctgctggccgcagcagcctgtgctactgcaacctgctgtgtggcatcatccggggggccctggagatggtgcacctggccgcagatgtgaccttcctgcaggaccggctgaagggggacagcgtgacagagatcggcatcaccttcctgaagaagagagatgagaagaagtaccggggcaagaagtag

SEQ ID NO: 145149 - DNA, 1497 bp, Artificial Sequence
  Description of Artificial Sequence: Synthetic coding sequence
atgaggcccccagcctgctggtggctgctggcccccccagccctgctggccctgctgacctgcagcctggccttcggcctggccagcgaggacaccaagaaggaggtgaagcagagccaggacctggagaagagcggcatcagcaggaagaatgacatcgacctgaagggcatcgtgtttgtgatccagagccagagcaacagcttccacgccaagagagctgagcagctgaagaagagcatcctgaagcaggccgctgacctgacccaggagctgcccagcgtgctgctgctgcaccagctggccaagcaggagggcgcctggaccatcctgcccctgctgccccacttctctgtgacctacagcaggaacagctcctggatcttcttctgtgaggaggagacccgcatccagatccccaagctgctggagaccctgcggcgctatgaccccagcaaggagtggttcctgggcaaggccctgcatgatgaggaggccaccatcatccaccactacgccttcagcgagaaccccaccgtcttcaagtacccagactttgctgctggctgggccctgagcatccccctggtgaacaagctgaccaagaggctgaagtctgagagcctgaagagtgacttcaccatcgacctgaagcatgaaattgccctgtacatctgggacaagggcggcggcccccccctgacccctgtgcctgagttctgcaccaatgatgtggacttctactgtgccaccaccttccacagcttcctgcccctgtgcaggaagcctgtgaagaagaaggacatctttgtggccgtgaagacctgcaagaagttccacggggaccgcatccccatcgtgaagcagacctgggagagccaggccagcctcatcgagtactacagcgactacacagagaacagcatccccaccgtggacctgggcatccccaacacagaccggggccactgtgggaagacctttgccatcctggagcgcttcctgaacagaagccaggacaagacagcctggctggtgattgtggatgatgacaccctcatcagcatcagccggctgcagcacctgctgagctgctatgacagcggggagcctgtgttcctgggggagagatatggctacggcctgggcaccggcggctacagctacatcactggaggcggcggcatggtgttcagccgggaggccgtgcggcggctgctggccagcaagtgccgctgctacagcaatgatgccccagatgacatggtgctgggcatgtgcttcagcggcctgggcatccctgtgacccacagccccctcttccaccaggcccggcctgtggactaccccaaggactacctgagccaccaggtgcccatctccttccacaagcactggaacatcgaccctgtgaaggtgtacttcacctggctggcccccagtgatgaggacaaggcccggcaggagacccagaagggcttccgggaggagctgtag

SEQ ID NO: 145150 - DNA, 1005 bp, Artificial Sequence
  Description of Artificial Sequence: Synthetic coding sequence
atgcccaagaggcgggacatcctggccatcgtgctgattgtgctgccctggaccctgctgatcaccgtgtggcaccagagcaccctggcccccctgctggccgtgcacaaggatgagggcagtgacccccggcgggagaccccacctggagctgacccccgggagtactgcaccagtgaccgggacatcgtggaggtggtgaggacagaatatgtgtacacccggcccccaccctggagcgacaccctgcccaccatccacgtggtgacccccacctacagcaggcctgtgcagaaggccgagctgaccaggatggccaacaccctgctgcacgtgcccaacctgcactggctggtggtggaggatgcccccaggaggacccccctgacagcccggctgctgcgggacaccggcctgaactacacccacctgcacgtggagacccccaggaactacaagctgcggggagatgcccgggacccccgcatcccccggggcaccatgcagaggaacctggccctgcgctggctgcgggagaccttccccaggaacagcagccagcccggggtggtgtactttgctgatgatgacaacacctacagcctggagctgtttgaggagatgaggagcacccggcgggtgtctgtgtggcctgtggcctttgtgggcggcctgcgctatgaggccccccgggtgaatggagctgggaaggtggtgggctggaagacagtgtttgacccccaccggccctttgccatcgacatggccggctttgctgtgaacctgcggctcatcctgcagaggagccaggcctacttcaagctgcggggcgtgaagggcggctaccaggagagcagcctgctgcgggagctggtgaccctgaatgacctggagcccaaggccgccaactgcaccaagatcctggtgtggcacaccaggacagagaagcctgtgctggtgaatgaaggcaagaagggcttcacagaccccagcgtggagatctag

SEQ ID NO: 145151 - DNA, 1005 bp, Artificial Sequence; identical to SEQ ID NO: 145150
  Description of Artificial Sequence: Synthetic coding sequence

SEQ ID NO: 145152 - DNA, 1005 bp, Artificial Sequence; identical to SEQ ID NO: 145150
  Description of Artificial Sequence: Synthetic coding sequence

SEQ ID NO: 145153 - DNA, 1044 bp, Artificial Sequence
  Description of Artificial Sequence: Synthetic coding sequence
atgggaaatgaggagccctgggtgcagcctgccctggagatgcccaagagaagagacatcctggccatcgtgctgattgtgctgccctggaccctgctgatcaccgtgtggcaccagagcaccctggcccccctgctggccgtgcacaaggatgagggcagtgacccccggcgggagaccccacctggagctgacccccgggagtactgcaccagtgaccgggacatcgtggaggtggtgaggacagaatatgtgtacacccggcccccaccctggagcgacaccctgcccaccatccacgtggtgacccccacctacagcaggcctgtgcagaaggccgagctgaccaggatggccaacaccctgctgcacgtgcccaacctgcactggctggtggtggaggatgcccccaggaggacccccctgacagcccggctgctgcgggacaccggcctgaactacacccacctgcacgtggagaccccaagaaactacaagctgcggggagatgcccgggacccccgcatcccccggggcaccatgcagaggaacctggccctgcgctggctgcgggagaccttccccaggaacagcagccagcccggggtggtgtactttgctgatgatgacaacacctacagcctggagctgtttgaggagatgaggagcaccaggagagtgtctgtgtggcctgtggcctttgtgggcggcctgcgctatgaggccccccgggtgaatggagctgggaaggtggtgggctggaagacagtgtttgacccccaccggccctttgccatcgacatggccggctttgctgtgaacctgcggctcatcctgcagaggagccaggcctacttcaagctgcggggcgtgaagggcggctaccaggagagcagcctgctgcgggagctggtgaccctgaatgacctggagcccaaggccgccaactgcaccaagatcctggtgtggcacaccaggacagagaagcctgtgctggtgaatgaaggcaagaagggcttcacagaccccagcgtggagatctag

SEQ ID NO: 145154 - DNA, 1008 bp, Artificial Sequence
  Description of Artificial Sequence: Synthetic coding sequence
atgaagctgaagctgaagaatgtgttcctggcctacttcctggtgtccattgctggcctgctgtatgccctggtgcagctgggccagccctgtgactgcctgccccccctgcgggctgctgctgagcagctgcggcagaaggacctgcgcatcagccagctgcaggccgagctgcggcggcccccaccagccccagcccagcccccagagcctgaggccctgcccaccatctacgtggtgacccccacctacgcccggctggtgcagaaggccgagctggtgcggctgagccagaccctgagcctggtgccccggctgcactggctgctggtggaggatgctgagggccccacccccctggtgtctggcctgctggccgccagcggcctgctcttcacccacctggtggtgctgacccccaaggcccagaggctgcgggagggggagcccggctgggtgcacccccggggcgtggagcagaggaacaaggccctggactggctgcggggccggggcggcgctgtgggcggggagaaggaccccccacctcctggcacccagggcgtggtgtactttgctgatgatgacaacacctacagccgggagctgtttgaggagatgcgctggacccggggcgtgtctgtgtggcctgtgggcctggtgggcggcctgcgctttgagggcccccaggtgcaggacggccgggtggtgggcttccacacagcctgggagcccagccggcccttccctgtggacatggccggctttgctgtggccctgcccctgctgctggacaagcccaatgcccagtttgacagcacagccccccggggccacctggagagcagcctgctgagccacctggtggaccccaaggacctggagccccgggccgccaactgcaccagggtgctggtgtggcacaccaggacagagaagcccaagatgaagcaggaggagcagctgcagaggcagggccggggcagtgaccctgccatcgaggtgtag

SEQ ID NO: 145155 - DNA, 948 bp, Artificial Sequence
  Description of Artificial Sequence: Synthetic coding sequence
atgaagctgaagctgaagaatgtgttcctggcctacttcctggtgtccattgctggcctgctgtatgccctggtgcagctgggccagccctgtgactgcctgccccccctgcgggctgctgctgagcagctgcggcagaaggacctgcgcatcagccagctgcaggccgagctgcggcggcccccaccagccccagcccagcccccagagcctgaggccctgcccaccatctacgtggtgacccccacctacgcccggctggtgcagaaggccgagctggtgcggctgagccagaccctgagcctggtgccccggctgcactggctgctggtggaggatgctgagggccccacccccctggtgtctggcctgctggccgccagcggcctgctcttcacccacctggtggtgctgacccccaaggcccagaggctgcgggagggggagcccggctgggtgcacccccggggcgtggagcagaggaacaaggccctggactggctgcggggccggggcggcgctgtgggcggggagaaggaccccccacctcctggcacccagggcgtggtgtactttgctgatgatgacaacacctacagccgggagctgtttgaggagatgcgctggacccggggcgtgtctgtgtggcctgtgggcctggtgggcggcctgcgctttgagggcccccaggtgcaggacggccgggtggtgggcttccacacagcctgggagcccagccggcccttccctgtggacatggccggctttgctgtggccctgcccctgctgctggacaagcccaatgcccagtttgacagcacagccccccggggccacctggagagcagcctgctgagccacctggtggaccccaaggacctggagccccgggccgccaactgcaccaggacagagagccgctgtgtgacccaggccggcgtgcagtag

SEQ ID NO: 145156 - DNA, 2997 bp, Artificial Sequence
  Description of Artificial Sequence: Synthetic coding sequence
atgggcagcccccgggccgcccggccccccctgctgctgcggcctgtgaagctgctgcggcggcgcttccggctgctgctggccctggccgtggtgtctgtgggcctgtggaccctgtacctggagctggtggccagcgcccaggtgggcggcaaccccctgaacagaagatatggctcctggagggagctggccaaggccctggccagcaggaacatcccagctgtggacccccacctgcagttctaccacccccagaggctgagcctggaggaccatgacatcgaccagggcgtgagcagcaacagcagctacctgaagtggaacaagcctgtgccctggctgtctgagttccggggccgggccaacctgcacgtgtttgaggactggtgtggcagcagcatccagcagctgcggaggaacctgcacttccccctgtacccccacatccgcaccaccctgaggaagctggccgtgagccccaagtggaccaactacggcctgcgcatcttcggctacctgcaccccttcacagatggcaagatccagtttgccatcgccgcagatgacaatgctgagttctggctgagcctggatgaccaggtgtctggcctgcagctgctggcctctgtgggcaagacaggcaaggagtggacagcccctggagaatttgggaagttccgcagccagatcagcaagcctgtgtccctgagcgccagccaccgctactactttgaggtgctgcacaagcagaatgaggagggcacagaccacgtggaggtggcctggaggagaaatgaccccggggccaagttcaccatcatcgacagcctgagcctgagcctcttcaccaatgagaccttcctgcagatggatgaggtgggccacatcccccagacagctgccagccacgtggacagcagcaatgccctgcccagagatgagcagcccccagctgacatgctgcggccagacccccgggacaccctgtacagagtgcccctcatccccaagagccacctgcggcacgtgctgcctgactgcccctacaagcccagctacctggtggatggcctgcccctgcagcgctaccagggcctgcgctttgtgcacctgagctttgtgtacccaaatgactacacccggctgagccacatggagacccacaacaagtgcttctaccaggagaatgcctactaccaggaccgcttctccttccaggagtacatcaagattgaccagcctgagaagcagggcctggagcagcccggctttgaggagaacctgctggaggagagccagtatggagaggtggccgaggagaccccagccagcaacaaccagaatgccaggatgctggagggccggcagaccccagccagcaccctggagcaggatgccacagactaccgcctgcggagcctgaggaagctgctggcccagccccgggagggcctgctggcccccttcagcaagaggaacagcacagccagcttccctggccgcaccagccacatccctgtgcagcagcctgagaagaggaagcagaagcccagccctgagcccagccaggacagcccccacagcgacaagtggcccccaggccaccctgtgaagaacctgccccagatgaggggcccccggcccaggcctgctggggacagccccaggaagacccagtggctgaaccaggtggagagctacatcgccgagcagaggagaggagacaggatgaggccccaggcccctggccggggctggcacggggaggaggaggtggtggccgctgctggccaggagggccaggtggagggggaggaggagggggaggaggaggaggaggaggaggacatgtctgaggtgtttgaatatgtgcctgtgtttgatcctgtggtgaactgggaccagaccttcagcgccaggaacctggacttccaggccctgaggacagactggattgacctgagctgcaacaccagcggcaacctgctgctgcctgagcaggaggccctggaggtgaccagggtcttcctgaagaagctgaaccagaggagccggggccgctaccagctgcagagaattgtgaatgtggagaagaggcaggaccagctgcggggcggccgctacctgctggagctggagctgctggagcagggccagagggtggtgcggctgtctgaatatgtgtctgcccggggctggcagggcattgatcctgctggaggagaggaggtggaggccaggaacctgcagggcctggtgtgggacccccacaacagaagacggcaggtgctgaacacccgggcccaggagcccaagctgtgctggccccagggcttctcctggagccacagagctgtggtgcactttgtggtgcctgtgaagaaccaggcccgctgggtgcagcagttcatcaaggacatggagaacctcttccaggtgactggagacccccacttcaacatcgtcatcacagactacagcagcgaggacatggatgtggagatggccctgaagaggagcaagctgcggagctaccagtatgtgaagctgagcggcaactttgagaggtctgctggcctgcaggccggcatcgacctggtgaaggacccccacagcatcatcttcctgtgtgacctgcacatccacttccctgctggggtgattgatgccatcaggaagcactgtgtggagggcaagatggcctttgcccccatggtgatgaggctgcactgtggggccaccccccagtggccagagggctactgggaggtgaatggcttcggcctgctgggcatctacaagagtgacctggacagaattggaggcatgaacaccaaggagttccgggaccgctggggcggggaggactgggagctgctggaccgcatcctgcaggccggcctggatgtggagcggctgagcctgaggaacttcttccaccacttccacagcaagaggggcatgtggagccggcggcagatgaagaccctgtag

SEQ ID NO: 145157 - DNA, 306 bp, Artificial Sequence
  Description of Artificial Sequence: Synthetic coding sequence
atgagccgctctgtggccctggccgtgctggccctgctgagcctgagcggcctggaggccatccagaggacccccaagatccaggtgtacagccgccacccagcagaaaatggcaagagcaacttcctgaactgctacgtgtctggcttccaccccagcgacatcgaggtggacctgctgaagaatggagagcgcatcgagaaggtggagcacagcgacctgtccttcagcaaggactggagcttctacctgctgtactacacagagttcacccccacagagaagatgtccatgcctgctgtgtag

SEQ ID NO: 145158 - DNA, 369 bp, Artificial Sequence
  Description of Artificial Sequence: Synthetic coding sequence
atgagccgctctgtggccctggccgtgctggccctgctgagcctgagcggcctggaggccatccagaggacccccaagatccaggtgtacagccgccacccagcagaaaatggcaagagcaacttcctgaactgctacgtgtctggcttccaccccagcgacatcgaggtggacctgctgaagaatggagagcgcatcgagaaggtggagcacagcgacctgtccttcagcaaggactggagcttctacctgctgtactacacagagttcacccccacagagaaggatgaatatgcctgccgggtgaaccacgtgaccctgagccagcccaagatcgtgaagtggggcaagagctacatcctgctgtag

SEQ ID NO: 145159 - DNA, 360 bp, Artificial Sequence
  Description of Artificial Sequence: Synthetic coding sequence
atgagccgctctgtggccctggccgtgctggccctgctgagcctgagcggcctggaggccatccagaggacccccaagatccaggtgtacagccgccacccagcagaaaatggcaagagcaacttcctgaactgctacgtgtctggcttccaccccagcgacatcgaggtggacctgctgaagaatggagagcgcatcgagaaggtggagcacagcgacctgtccttcagcaaggactggagcttctacctgctgtactacacagagttcacccccacagagaaggatgaatatgcctgccgggtgaaccacgtgaccctgagccagcccaagatcgtgaagtgggaccgggacatgtag

SEQ ID NO: 145160 - DNA, 369 bp, Artificial Sequence; identical to SEQ ID NO: 145158
  Description of Artificial Sequence: Synthetic coding sequence

SEQ ID NO: 145161 - DNA, 360 bp, Artificial Sequence; identical to SEQ ID NO: 145159
  Description of Artificial Sequence: Synthetic coding sequence

SEQ ID NO: 145162 - DNA, 360 bp, Artificial Sequence; identical to SEQ ID NO: 145159
  Description of Artificial Sequence: Synthetic coding sequence

SEQ ID NO: 145163 - DNA, 1644 bp, Artificial Sequence
  Description of Artificial Sequence: Synthetic coding sequence
atggacatcatctttggaagaaacaggaaggagcagctggagcctgtgcgggccaaggtgacaggcaagatcccagcctggctgcagggcaccctgctgagaaatggacctggcatgcacacagtgggggagagccgctacaaccactggtttgatggcctggccctgctgcacagcttcaccatcagagatggagaggtgtactaccgcagcaagtacctgcggagtgacacctacaacaccaacatcgaggccaaccgcatcgtggtgtctgaatttggcaccatggcctacccagacccctgcaagaacatcttcagcaaggccttctcctacctgagccacaccatcccagacttcacagacaactgcctgatcaacatcatgaagtgtggggaggacttctacgccaccagcgagaccaactacatcaggaagatcaacccccagaccctggagaccctggagaaggtggactacagaaaatatgtggccgtgaacctggccaccagccacccccactatgatgaggccggaaatgtgctgaacatgggcaccagcatcgtggagaagggcaagaccaagtatgtgatcttcaagatcccagccaccgtgcctgagggcaagaagcagggcaagagcccctggaagcacacagaggtgttctgcagcatccccagccgcagcctgctgagccccagctactaccacagctttggagtgacagaaaattatgtgatcttcctggagcagcccttccggctggacatcctgaagatggccacagcctacatccggaggatgtcctgggccagctgcctggccttccaccgggaggagaagacctacatccacatcatcgaccagaggacccggcagcctgtgcagaccaagttctacacagatgccatggtggtgttccaccacgtgaatgcctatgaagaagatggctgcatcgtgtttgatgtgattgcctatgaggacaacagcctgtaccagctgttctacctggccaacctgaaccaggacttcaaggagaacagccggctgacctctgtgcccaccctgcggagatttgctgtgcccctgcacgtggacaagaatgctgaggtgggcaccaacctgatcaaggtggccagcaccacagccacagccctgaaggaggaggatggccaggtgtactgccagcctgagttcctgtatgagggcctggagctgccccgggtgaactatgcccacaacgggaagcagtaccgctacgtgtttgccaccggggtgcagtggagccccatccccaccaagatcatcaagtatgacatcctgaccaagagcagcctgaagtggagagaagatgactgctggccagctgagcccctgtttgtgcctgcccctggggccaaggatgaagatgatggagtcatcctgagcgccatcgtgtccacagacccccagaagctgcccttcctgctgatcctggatgccaagagcttcacagagctggcccgggcctctgtggatgtggacatgcacatggacctgcacggcctcttcatcacagacatggactgggacaccaagaagcaggccgccagcgaggagcagagggaccgggccagtgactgccacggggcccccctgacctag

SEQ ID NO: 145164 - DNA, 1437 bp, Artificial Sequence
  Description of Artificial Sequence: Synthetic coding sequence
atggctgctggcaacccagccccccagtgggcctgggatgcccacagctggggcgtgcagatccagcccctggtgcggcggccctgcccagccccccagctgcaccaccagaggcgggccttctcctacctgagccacaccatcccagacttcacagacaactgcctgatcaacatcatgaagtgtggggaggacttctacgccaccagcgagaccaactacatcaggaagatcaacccccagaccctggagaccctggagaaggtggactacagaaaatatgtggccgtgaacctggccaccagccacccccactatgatgaagctggaaatgtgctgaacatgggcaccagcatcgtggagaagggcaagaccaagtatgtgatcttcaagatcccagccaccgtgcctgagggcaagaagcagggcaagagcccctggaagcacacagaggtgttctgcagcatccccagccgcagcctgctgagccccagctactaccacagctttggagtgacagagaactacgtgatcttcctggagcagcccttccggctggacatcctgaagatggccacagcctacatccggaggatgtcctgggccagctgcctggccttccaccgggaggagaagacctacatccacatcatcgaccagaggacccggcagcctgtgcagaccaagttctacacagatgccatggtggtgttccaccacgtgaatgcctatgaggaggatggctgcatcgtgtttgatgtgattgcctatgaggacaacagcctgtaccagctgttctacctggccaacctgaaccaggacttcaaggagaacagccggctgacctctgtgcccaccctgcggagatttgctgtgcccctgcacgtggacaagaatgctgaggtgggcaccaacctgatcaaggtggccagcaccacagccacagccctgaaggaggaggatggccaggtgtactgccagcctgagttcctgtatgagggcctggagctgccccgggtgaactatgcccacaacgggaagcagtaccgctacgtgtttgccactggagtgcagtggagccccatccccaccaagatcatcaagtatgacatcctgaccaagagcagcctgaagtggagagaagatgactgctggccagctgagcccctgtttgtgcctgcccctggggccaaggatgaagatgatggagtcatcctgagcgccatcgtgtccacagacccccagaagctgcccttcctgctgatcctggatgccaagagcttcacagagctggcccgggcctctgtggatgtggacatgcacatggacctgcacggcctcttcatcacagacatggactgggacaccaagaagcaggccgccagcgaggagcagagggaccgggccagtgactgccacggggcccccctgacctag

SEQ ID NO: 145165 - DNA, 1740 bp, Artificial Sequence
  Description of Artificial Sequence: Synthetic coding sequence
atgttcttccgggtcttcctgcacttcatccgcagccacagcgccacagctgtggacttcctgcctgtgatggtgcaccggctgcctgtgttcaagcgctacatgggcaacaccccccagaagaaggctgtgtttggccagtgccggggcctgccctgtgtggcccccctgctgaccaccgtggaggaggccccccggggcatcagcgcccgggtgtggggccacttccccaagtggctgaatggcagcctgctgagaattggccctgggaagtttgaatttgggaaggacaagtacaaccactggtttgatggcatggccctgctgcaccagttcaggatggccaagggcaccgtgacctaccgcagcaagttcctgcagagcgacacctacaaggccaacagcgccaagaaccgcatcgtcatcagcgagtttggcaccctggccctgcctgacccctgcaagaatgtgtttgagcgcttcatgagcagatttgagctgcccgggaaggccgccgccatgacagacaacaccaacgtgaactacgtgcgctacaagggggactactacctgtgcacagagaccaacttcatgaacaaggtggacatcgagaccctggagaagacagagaaggtggactggagcaagttcatcgctgtgaatggagccacagcccacccccactatgacctggatggaacagcctacaacatgggcaacagctttggcccctacggcttctcctacaaggtgatccgggtgcccccagagaaggtggacctgggggagaccatccacggcgtgcaggtgatctgcagcatcgccagcacagagaagggcaagcccagctactaccacagctttggcatgaccaggaactacatcatcttcatcgagcagcccctgaagatgaacctgtggaagatcgccaccagcaagatccggggcaaggccttcagtgatggcatctcctgggagccccagtgcaacacccgcttccacgtggtggagaagaggacaggccagctgctgcccggccgctactacagcaagccctttgtgaccttccaccagatcaatgcctttgaggaccagggctgtgtgatcatcgacctgtgctgccaggacaatggaagaaccctggaggtgtaccagctgcagaacctgaggaaggccggggagggcctggaccaggtgcacaacagcgctgccaagagcttccccaggagatttgtgctgcccctgaatgtgtccctgaatgcccctgagggggacaacctgagccccctgagctacaccagcgccagcgctgtgaagcaggctgatggcaccatctggtgcagccatgagaacctgcaccaggaggacctggagaaggagggcggcatcgagttcccccagatctactatgaccgcttcagcggcaagaagtaccacttcttctacggctgcggcttccgccacctggtgggggacagcctcatcaaggtggatgtggtgaacaagaccctgaaggtgtggagagaagatggcttctaccccagcgagcctgtgtttgtgcctgcccctggcaccaatgaggaggatggaggagtcatcctgtctgtggtgatcacccccaaccagaatgaaagcaacttcatcctggtgctggatgccaagaactttgaggagctgggccgggcagaggtgcctgtgcagatgccctacggcttccacggcaccttcatccccatctag

SEQ ID NO: 145166 - DNA, 1638 bp, Artificial Sequence
  Description of Artificial Sequence: Synthetic coding sequence
atgggcaacaccccccagaagaaggctgtgtttggccagtgccggggcctgccctgtgtggcccccctgctgaccaccgtggaggaggccccccggggcatcagcgcccgggtgtggggccacttccccaagtggctgaatggcagcctgctgagaattggccctgggaagtttgaatttgggaaggacaagtacaaccactggtttgatggcatggccctgctgcaccagttcaggatggccaagggcaccgtgacctaccgcagcaagttcctgcagagcgacacctacaaggccaacagcgccaagaaccgcatcgtcatcagcgagtttggcaccctggccctgcctgacccctgcaagaatgtgtttgagcgcttcatgagcagatttgagctgcccgggaaggccgccgccatgacagacaacaccaacgtgaactacgtgcgctacaagggggactactacctgtgcacagagaccaacttcatgaacaaggtggacatcgagaccctggagaagacagagaaggtggactggagcaagttcatcgctgtgaatggagccacagcccacccccactatgacctggatggaacagcctacaacatgggcaacagctttggcccctacggcttctcctacaaggtgatccgggtgcccccagagaaggtggacctgggggagaccatccacggcgtgcaggtgatctgcagcatcgccagcacagagaagggcaagcccagctactaccacagctttggcatgaccaggaactacatcatcttcatcgagcagcccctgaagatgaacctgtggaagatcgccaccagcaagatccggggcaaggccttcagtgatggcatctcctgggagccccagtgcaacacccgcttccacgtggtggagaagaggacaggccagctgctgcccggccgctactacagcaagccctttgtgaccttccaccagatcaatgcctttgaggaccagggctgtgtgatcatcgacctgtgctgccaggacaatggaagaaccctggaggtgtaccagctgcagaacctgaggaaggccggggagggcctggaccaggtgcacaacagcgctgccaagagcttccccaggagatttgtgctgcccctgaatgtgtccctgaatgcccctgagggggacaacctgagccccctgagctacaccagcgccagcgctgtgaagcaggctgatggcaccatctggtgcagccatgagaacctgcaccaggaggacctggagaaggagggcggcatcgagttcccccagatctactatgaccgcttcagcggcaagaagtaccacttcttctacggctgcggcttccgccacctggtgggggacagcctcatcaaggtggatgtggtgaacaagaccctgaaggtgtggagagaagatggcttctaccccagcgagcctgtgtttgtgcctgcccctggcaccaatgaggaggatggaggagtcatcctgtctgtggtgatcacccccaaccagaatgaaagcaacttcatcctggtgctggatgccaagaactttgaggagctgggccgggcagaggtgcctgtgcagatgccctacggcttccacggcaccttcatccccatctag

SEQ ID NO: 145167 - DNA, 1638 bp, Artificial Sequence; identical to SEQ ID NO: 145166
  Description of Artificial Sequence: Synthetic coding sequence

SEQ ID NO: 145168 - DNA, 1620 bp, Artificial Sequence
  Description of Artificial Sequence: Synthetic coding sequence
atgggcaacaccccccagaagaaggctgtgtttggccagtgccggggcctgccctgtgtggcccccctgctgaccaccgtggaggaggccccccggggcatcagcgcccgggtgtggggccacttccccaagtggctgaatggcagcctgctgagaattggccctgggaagtttgaatttgggaaggacaagtacaaccactggtttgatggcatggccctgctgcaccagttcaggatggccaagggcaccgtgacctaccgcagcaagttcctgcagagcgacacctacaaggccaacagcgccaagaaccgcatcgtcatcagcgagtttggcaccctggccctgcctgacccctgcaagaatgtgtttgagcgcttcatgagcagatttgagctgcccgggaaggccgccgccatgacagacaacaccaacgtgaactacgtgcgctacaagggggactactacctgtgcacagagaccaacttcatgaacaaggtggacatcgagaccctggagaagacagagaaggtggactggagcaagttcatcgctgtgaatggagccacagcccacccccactatgacctggatggaacagcctacaacatgggcaacagctttggcccctacggcttctcctacaaggtgatccgggtgcccccagagaaggtggacctgggggagaccatccacggcgtgcaggtgatctgcagcatcgccagcacagagaagggcaagcccagctactaccacagctttggcatgaccaggaactacatcatcttcatcgagcagcccctgaagatgaacctgtggaagatcgccaccagcaagatccggggcaaggccttcagtgatggcatctcctgggagccccagtgcaacacccgcttccacgtggtggagaagaggacaggccagctgctgcccggccgctactacagcaagccctttgtgaccttccaccagatcaatgcctttgaggaccagggctgtgtgatcatcgacctgtgctgccaggacaatggaagaaccctggaggtgtaccagctgcagaacctgaggaaggccggggagggcctggaccaggtgcacaacagcgctgccaagagcttccccaggagatttgtgctgcccctgaatgtgtccctgaatgcccctgagggggacaacctgagccccctgagctacaccagcgccagcgctgtgaagcaggctgatggcaccatctggtgcagccatgagaacctgcaccaggaggacctggagaaggagggcggcatcgagttcccccagatctactatgaccgcttcagcggcaagaagtaccacttcttctacggctgcggcttccgccacctggtgggggacagcctcatcaaggtggatgtggtgtggagagaagatggcttctaccccagcgagcctgtgtttgtgcctgcccctggcaccaatgaggaggatggaggagtcatcctgtctgtggtgatcacccccaaccagaatgaaagcaacttcatcctggtgctggatgccaagaactttgaggagctgggccgggcagaggtgcctgtgcagatgccctacggcttccacggcaccttcatccccatctag

SEQ ID NO: 145169 - DNA, 1638 bp, Artificial Sequence; identical to SEQ ID NO: 145166
  Description of Artificial Sequence: Synthetic coding sequence

SEQ ID NO: 145170 - DNA, 1221 bp, Artificial Sequence
  Description of Artificial Sequence: Synthetic coding sequence
atgcctcctgtgggcggcaagaaggccaagaagggcatcctggagcggctgaatgctggggagatcgtgattggagatggcggctttgtgtttgccctggagaagaggggctacgtgaaggccggcccctggaccccagaggccgctgtggagcaccctgaggccgtgcggcagctgcaccgggagttcctgcgggccggcagcaatgtgatgcagaccttcaccttctacgccagcgaggacaagctggagaacagaggcaactacgtgctggagaagatcagcggccaggaggtgaatgaggccgcctgtgacatcgcccggcaggtggctgatgaaggagatgccctggtggccggcggcgtgtcccagacccccagctacctgagctgcaagtcagaaacagaggtgaagaaggtgttcctgcagcagctggaggtgttcatgaagaagaatgtggacttcctgattgctgagtactttgaacatgtggaggaggccgtgtgggccgtggagaccctgattgccagcggcaagcctgtggccgccaccatgtgcatcggccctgagggggacctgcacggcgtgcccccaggagaatgtgctgtgcggctggtgaaggccggggccagcatcattggagtgaactgccactttgaccccaccatcagcctgaagacagtgaagctgatgaaggagggcctggaggccgcccggctgaaggcccacctgatgagccagcccctggcctaccacaccccagactgcaacaagcagggcttcatcgacctgcctgagttccccttcggcctggagccccgggtggccacccgctgggacatccagaagtatgcccgggaggcctacaacctgggcgtgcgctacatcggcggctgctgcggctttgagccctaccacatccgggccatcgccgaggagctggcccctgagcggggcttcctgcccccagccagcgagaagcacggctcctggggcagcggcctggacatgcacaccaagccctgggtgcgggcccgggccaggaaggagtactgggagaacctgagaattgccagcggccggccctacaaccccagcatgagcaagccagatggctggggcgtgaccaagggcacagctgagctgatgcagcagaaggaggccaccacagagcagcagctgaaggagctgtttgagaagcagaagttcaagagccagtag

SEQ ID NO: 145171 - DNA, 612 bp, Artificial Sequence
  Description of Artificial Sequence: Synthetic coding sequence
atgcctcctgtgggcggcaagaaggccaagaagggcatcctggagcggctgaatgctggggagatcgtgattggagatggcggctttgtgtttgccctggagaagaggggctacgtgaaggccggcccctggaccccagaggccgctgtggagcaccctgaggccggggccagcatcatcggcgtgaactgccactttgaccccaccatcagcctgaagacagtgaagctgatgaaggagggcctggaggccgcccggctgaaggcccacctgatgagccagcccctggcctaccacaccccagactgcaacaagcagggcttcatcgacctgcctgagttccccttcggcctggagcctgagctgcccccagatggcatcttcaagaacaccccagagcggcccaccacctggggcagcggcaccctggccggggctgtggacctgagccccaccaccagcggccagctgcagaggtcctggccccagaagggggccttctgccaccagctgcagaagaacatggctgctggggaggtggtgtggacctgcacccccaaccctggcctggagcagggccctggcaggaacacaggccgcatcttcggctag

SEQ ID NO: 145172 - DNA, 1092 bp, Artificial Sequence
  Description of Artificial Sequence: Synthetic coding sequence
atggccccagctggccggcctggggccaagaagggcatcctggagcggctggagagcggggaggtggtgattggagatggcagcttcctgatcaccctggagaagaggggctacgtgaaggccggcctgtggaccccagaggccgtcatcgagcacccagatgctgtgcggcagctgcacatggagttcctgcgggccggcagcaatgtgatgcagaccttcaccttcagcgccagcgaggacaacatggagagcaagtgggaggatgtgaatgctgctgcctgtgacctggcccgggaggtggccgggaaaggagatgccctggtggccggcggcatctgccagaccagcatctacaagtaccagaaggatgaggcccgcatcaagaagctgttccggcagcagctggaggtgtttgcctggaagaatgtggacttcctgattgctgagtactttgagcacgtggaggaggccgtgtgggccgtggaggtgctgaaggagagtgacaggcctgtggccgtgaccatgtgcatcggccctgagggggacatgcatgacatcaccccaggagaatgtgctgtgcggctggtgaaggccggggccagcatcgtgggcgtgaactgccgcttcggccctgacaccagcctgaagaccatggagctgatgaaggagggcctggagtgggccggcctgaaggcccacctgatggtgcagcccctgggcttccacgccccagactgtgggaaggagggctttgtggacctgcctgagtaccccttcggcctggagagccgggtggccacccgctgggacatccagaagtatgcccgggaggcctacaacctgggcgtgcgctacatcggcggctgctgcggctttgagccctaccacatccgggccatcgccgaggagctggcccctgagcggggcttcctgcccccagccagcgagaagcacggctcctggggcagcggcctggacatgcacaccaagccctggatccgggcccgggcccggcgggagtactgggagaacctgctgcctgccagcggccggcccttctgccccagcctgagcaagccagacttctag

SEQ ID NO: 145173 - DNA, 900 bp, Artificial Sequence
  Description of Artificial Sequence: Synthetic coding sequence
atggccccagctggccggcctggggccaagaagggcatcctggagcggctggagagcggggaggtggtgattggagatggcagcttcctgatcaccctggagaagaggggctacgtgaaggccggcctgtggaccccagaggccgtcatcgagcacccagatgctgtgcggcagctgcacatggagttcctgcgggccggcagcaatgtgatgcagaccttcaccttcagcgccagcgaggacaacatggagagcaagtactttgagcacgtggaggaggccgtgtgggccgtggaggtgctgaaggagagtgacaggcctgtggccgtgaccatgtgcatcggccctgagggggacatgcatgacatcaccccaggagaatgtgctgtgcggctggtgaaggccggggccagcatcgtgggcgtgaactgccgcttcggccctgacaccagcctgaagaccatggagctgatgaaggagggcctggagtgggccggcctgaaggcccacctgatggtgcagcccctgggcttccacgccccagactgtgggaaggagggctttgtggacctgcctgagtaccccttcggcctggagagccgggtggccacccgctgggacatccagaagtatgcccgggaggcctacaacctgggcgtgcgctacatcggcggctgctgcggctttgagccctaccacatccgggccatcgccgaggagctggcccctgagcggggcttcctgcccccagccagcgagaagcacggctcctggggcagcggcctggacatgcacaccaagccctggatccgggcccgggcccggcgggagtactgggagaacctgctgcctgccagcggccggcccttctgccccagcctgagcaagccagacttctag

SEQ ID NO: 145174 - DNA, 639 bp, Artificial Sequence
  Description of Artificial Sequence: Synthetic coding sequence
atgatcattggaggcatcgaccacagcctgtacacaggcagcctgtggtacacccccatcagaagagagtggtactatgaggtgatcatcgtgcgggtggagatcaatggccaggacctgaagatggactgcaaggagtacaactatgacaagagcatcgtggacagcggcaccaccaacctgcggctgcccaagaaggtgtttgaggccgctgtgaagagcatcaaggccgccagcagcacagagaagttcccagatggcttctggctgggggagcagctggtgtgctggcaggccggcaccaccccctggaacatcttccctgtgatcagcctgtacctgatgggagaggtgaccaaccagagcttccgcatcaccatcctgccccagcagtacctgcgctggaagatgtggccccggcccaagaccaccgtgacctgccacctgaccgtcatccacggccactgctacggcagctgctaccacggcggcctgctgctgagcctcatcggcccagaaaatgagctggccctgctgagcgccctggccatgtgcaccatgagcagcggccggcagcgctggaaggcctgccacctgggccacggccgcctgtggctgcagcacagcacagacagatag

SEQ ID NO: 145175 - DNA, 1506 bp, Artificial Sequence
  Description of Artificial Sequence: Synthetic coding sequence
atggcccaggccctgccctggctgctgctgtggatgggcgctggggtgctgcctgcccacggcacccagcacggcatccggctgcccctgcggagcggcctgggcggggcccccctgggcctgcggctgccccgggagacagatgaggagcctgaggagcccggccggcggggcagctttgtggagatggtggacaacctgcggggcaagagcggccagggctactacgtggagatgacagtgggcagccccccccagaccctgaacatcctggtggacaccggcagcagcaactttgctgtgggcgccgccccccaccccttcctgcaccgctactaccagaggcagctgagcagcacctacagagacctgaggaagggcgtgtatgtgccctacacccagggcaagtgggagggggagctgggcacagacctggtgtccatcccccacggccccaacgtgacagtgcgggccaacattgctgccatcacagaaagtgacaagttcttcatcaatggcagcaactgggagggcatcctgggcctggcctatgcagaaattgcccggccagatgacagcctggagcccttctttgacagcctggtgaagcagacccacgtgcccaacctcttcagcctgcagctgtgtggggccggcttccccctgaaccagagcgaggtgctggcctctgtgggcggctccatgatcattggaggcatcgaccacagcctgtacacaggcagcctgtggtacacccccatcagaagagagtggtactatgaggtgatcatcgtgcgggtggagatcaatggccaggacctgaagatggactgcaaggagtacaactatgacaagagcatcgtggacagcggcaccaccaacctgcggctgcccaagaaggtgtttgaggccgctgtgaagagcatcaaggccgccagcagcacagagaagttcccagatggcttctggctgggggagcagctggtgtgctggcaggccggcaccaccccctggaacatcttccctgtgatcagcctgtacctgatgggagaggtgaccaaccagagcttccgcatcaccatcctgccccagcagtacctgcggcctgtggaggatgtggccaccagccaggatgactgctacaagtttgccatcagccagagcagcacaggcaccgtgatgggcgccgtcatcatggagggcttctacgtggtgtttgaccgggccaggaagagaattggatttgctgtgtctgcctgccacgtgcatgatgagttcagaacagctgctgtggagggcccctttgtgaccctggacatggaggactgtggctacaacatcccccagacagatgagagcaccctgatgaccatcgcctacgtgatggccgccatctgtgccctcttcatgctgcccctgtgcctgatggtgtgccagtggtgctgcctgcgctgcctgcggcagcagcatgatgactttgctgatgacatcagcctgctgaagtag

SEQ ID NO: 145176 - DNA, 1299 bp, Artificial Sequence
  Description of Artificial Sequence: Synthetic coding sequence
atggcccaggccctgccctggctgctgctgtggatgggcgctggggtgctgcctgcccacggcacccagcacggcatccggctgcccctgcggagcggcctgggcggggcccccctgggcctgcggctgccccgggagacagatgaggagcctgaggagcccggccggcggggcagctttgtggagatggtggacaacctgcggggcaagagcggccagggctactacgtggagatgacagtgggcagccccccccagaccctgaacatcctggtggacaccggcagcagcaactttgctgtgggcgccgccccccaccccttcctgcaccgctactaccagaggcagctgagcagcacctacagagacctgaggaagggcgtgtatgtgccctacacccagggcaagtgggagggggagctgggcacagacctgctgtgtggggccggcttccccctgaaccagagcgaggtgctggcctctgtgggcggctccatgatcatcggcggcatcgaccacagcctgtacacaggcagcctgtggtacacccccatccggcgggagtggtactatgaagtcatcatcgtgcgggtggagatcaatggccaggacctgaagatggactgcaaggagtacaactatgacaagagcatcgtggacagcggcaccaccaacctgcggctgcccaagaaggtgtttgaagctgctgtgaagagcatcaaggccgccagcagcacagagaagttcccagatggcttctggctgggggagcagctggtgtgctggcaggccggcaccaccccctggaacatcttccctgtgatcagcctgtacctgatgggagaggtgaccaaccagagcttccgcatcaccatcctgccccagcagtacctgcggcctgtggaggatgtggccaccagccaggatgactgctacaagtttgccatcagccagagcagcactggaacagtgatgggcgctgtgatcatggagggcttctacgtggtgtttgaccgggccaggaagagaattggatttgctgtgtctgcctgccacgtgcatgatgagttcagaacagctgctgtggagggcccctttgtgaccctggacatggaggactgtggctacaacatcccccagacagatgagagcaccctgatgaccatcgcctacgtgatggccgccatctgtgccctcttcatgctgcccctgtgcctgatggtgtgccagtggtgctgcctgcgctgcctgcggcagcagcatgatgactttgctgatgacatcagcctgctgaagtag

SEQ ID NO: 145177 - DNA, 1374 bp, Artificial Sequence
  Description of Artificial Sequence: Synthetic coding sequence
atggcccaggccctgccctggctgctgctgtggatgggcgctggggtgctgcctgcccacggcacccagcacggcatccggctgcccctgcggagcggcctgggcggggcccccctgggcctgcggctgccccgggagacagatgaggagcctgaggagcccggccggcggggcagctttgtggagatggtggacaacctgcggggcaagagcggccagggctactacgtggagatgacagtgggcagccccccccagaccctgaacatcctggtggacaccggcagcagcaactttgctgtgggcgccgccccccaccccttcctgcaccgctactaccagaggcagctgagcagcacctacagagacctgaggaagggcgtgtatgtgccctacacccagggcaagtgggagggggagctgggcacagacctgcctgatgacagcctggagcccttctttgacagcctggtgaagcagacccacgtgcccaacctcttcagcctgcagctgtgtggggccggcttccccctgaaccagagcgaggtgctggcctctgtgggcggctccatgatcattggaggcatcgaccacagcctgtacacaggcagcctgtggtacacccccatcagaagagagtggtactatgaggtgatcatcgtgcgggtggagatcaatggccaggacctgaagatggactgcaaggagtacaactatgacaagagcatcgtggacagcggcaccaccaacctgcggctgcccaagaaggtgtttgaggccgctgtgaagagcatcaaggccgccagcagcacagagaagttcccagatggcttctggctgggggagcagctggtgtgctggcaggccggcaccaccccctggaacatcttccctgtgatcagcctgtacctgatgggagaggtgaccaaccagagcttccgcatcaccatcctgccccagcagtacctgcggcctgtggaggatgtggccaccagccaggatgactgctacaagtttgccatcagccagagcagcacaggcaccgtgatgggcgccgtcatcatggagggcttctacgtggtgtttgaccgggccaggaagagaattggatttgctgtgtctgcctgccacgtgcatgatgagttcagaacagctgctgtggagggcccctttgtgaccctggacatggaggactgtggctacaacatcccccagacagatgagagcaccctgatgaccatcgcctacgtgatggccgccatctgtgccctcttcatgctgcccctgtgcctgatggtgtgccagtggtgctgcctgcgctgcctgcggcagcagcatgatgactttgctgatgacatcagcctgctgaagtag

SEQ ID NO: 145178 - DNA, 1431 bp, Artificial Sequence
  Description of Artificial Sequence: Synthetic coding sequence
atggcccaggccctgccctggctgctgctgtggatgggcgctggggtgctgcctgcccacggcacccagcacggcatccggctgcccctgcggagcggcctgggcggggcccccctgggcctgcggctgccccgggagacagatgaggagcctgaggagcccggccggcggggcagctttgtggagatggtggacaacctgcggggcaagagcggccagggctactacgtggagatgacagtgggcagccccccccagaccctgaacatcctggtggacaccggcagcagcaactttgctgtgggcgccgccccccaccccttcctgcaccgctactaccagaggcagctgagcagcacctacagagacctgaggaagggcgtgtatgtgccctacacccagggcaagtgggagggggagctgggcacagacctggtgtccatcccccacggccccaacgtgacagtgcgggccaacattgctgccatcacagaaagtgacaagttcttcatcaatggcagcaactgggagggcatcctgggcctggcctatgcagaaattgcccggctgtgtggggccggcttccccctgaaccagagcgaggtgctggcctctgtgggcggctccatgatcatcggcggcatcgaccacagcctgtacacaggcagcctgtggtacacccccatccggcgggagtggtactatgaagtcatcatcgtgcgggtggagatcaatggccaggacctgaagatggactgcaaggagtacaactatgacaagagcatcgtggacagcggcaccaccaacctgcggctgcccaagaaggtgtttgaagctgctgtgaagagcatcaaggccgccagcagcacagagaagttcccagatggcttctggctgggggagcagctggtgtgctggcaggccggcaccaccccctggaacatcttccctgtgatcagcctgtacctgatgggagaggtgaccaaccagagcttccgcatcaccatcctgccccagcagtacctgcggcctgtggaggatgtggccaccagccaggatgactgctacaagtttgccatcagccagagcagcactggaacagtgatgggcgctgtgatcatggagggcttctacgtggtgtttgaccgggccaggaagagaattggatttgctgtgtctgcctgccacgtgcatgatgagttcagaacagctgctgtggagggcccctttgtgaccctggacatggaggactgtggctacaacatcccccagacagatgagagcaccctgatgaccatcgcctacgtgatggccgccatctgtgccctcttcatgctgcccctgtgcctgatggtgtgccagtggtgctgcctgcgctgcctgcggcagcagcatgatgactttgctgatgacatcagcctgctgaagtag

SEQ ID NO: 145179 - DNA, 1131 bp, Artificial Sequence
  Description of Artificial Sequence: Synthetic coding sequence
atggtgcccttcatctacctgcaggcccacttcaccctgtgcagcggctggagcagcacctacagagacctgaggaagggcgtgtatgtgccctacacccagggcaagtgggagggggagctgggcacagacctggtgtccatcccccacggccccaacgtgacagtgcgggccaacattgctgccatcacagaaagtgacaagttcttcatcaatggcagcaactgggagggcatcctgggcctggcctatgcagaaattgcccggctgtgtggggccggcttccccctgaaccagagcgaggtgctggcctctgtgggcggctccatgatcatcggcggcatcgaccacagcctgtacacaggcagcctgtggtacacccccatccggcgggagtggtactatgaagtcatcatcgtgcgggtggagatcaatggccaggacctgaagatggactgcaaggagtacaactatgacaagagcatcgtggacagcggcaccaccaacctgcggctgcccaagaaggtgtttgaagctgctgtgaagagcatcaaggccgccagcagcacagagaagttcccagatggcttctggctgggggagcagctggtgtgctggcaggccggcaccaccccctggaacatcttccctgtgatcagcctgtacctgatgggagaggtgaccaaccagagcttccgcatcaccatcctgccccagcagtacctgcggcctgtggaggatgtggccaccagccaggatgactgctacaagtttgccatcagccagagcagcactggaacagtgatgggcgctgtgatcatggagggcttctacgtggtgtttgaccgggccaggaagagaattggatttgctgtgtctgcctgccacgtgcatgatgagttcagaacagctgctgtggagggcccctttgtgaccctggacatggaggactgtggctacaacatcccccagacagatgagagcaccctgatgaccatcgcctacgtgatggccgccatctgtgccctcttcatgctgcccctgtgcctgatggtgtgccagtggtgctgcctgcgctgcctgcggcagcagcatgatgactttgctgatgacatcagcctgctgaagtag

SEQ ID NO: 145180 - DNA, 1191 bp, Artificial Sequence
  Description of Artificial Sequence: Synthetic coding sequence
atgggcgccctggcccgggccctgctgctgcccctgctggcccagtggctgctgcgggccgcccctgagctggccccagcccccttcaccctgcccctgcgggtggccgccgccaccaacagagtggtggcccccaccccaggccctggcaccccagctgagagacatgctgatggcctggccctggccctggagcccgccctggccagccctgctggggccgccaacttcctggccatggtggacaacctgcagggcgacagcggccggggctactacctggagatgctgattggcaccccaccccagaagctgcagatcctggtggacaccggcagcagcaactttgctgtggccggcaccccccacagctacatcgacacctactttgacacagagaggagcagcacctaccgcagcaaaggatttgatgtgacagtgaagtacacccagggctcctggacaggctttgtgggggaggacctggtgaccatccccaagggcttcaacaccagcttcctggtgaacatcgccaccatctttgaaagtgagaacttcttcctgcccggcatcaagtggaatggcatcctgggcctggcctatgccaccctggccaagcccagcagcagcctggagaccttctttgacagcctggtgacccaggccaacatccccaacgtgttctccatgcagatgtgtggggccggcctgcctgtggccggcagcggcaccaatggaggcagcctggtgctgggcggcatcgagcccagcctgtacaagggggacatctggtacacccccatcaaggaggagtggtactaccagatcgagatcctgaagctggagattggaggccagagcctgaacctggactgccgggagtacaatgctgacaaggccatcgtggacagcggcaccaccctgctgcggctgccccagaaggtgtttgatgctgtggtggaggccgtggcccgggccagcctcatccctgagttcagtgatggcttctggacaggcagccagctggcctgctggaccaacagcgagaccccctggagctacttccccaagatcagcatctacctgagagatgagaacagcagccgctccttccgcatcaccatcctgccccagaagctgcaggtgctgcagtgcctgaagtttcctggcctgagccagcagaggatgtag

SEQ ID NO: 145181 - DNA, 1557 bp, Artificial Sequence
  Description of Artificial Sequence: Synthetic coding sequence
atgggcgccctggcccgggccctgctgctgcccctgctggcccagtggctgctgcgggccgcccctgagctggccccagcccccttcaccctgcccctgcgggtggccgccgccaccaacagagtggtggcccccaccccaggccctggcaccccagctgagagacatgctgatggcctggccctggccctggagcccgccctggccagccctgctggggccgccaacttcctggccatggtggacaacctgcagggcgacagcggccggggctactacctggagatgctgattggcaccccaccccagaagctgcagatcctggtggacaccggcagcagcaactttgctgtggccggcaccccccacagctacatcgacacctactttgacacagagaggagcagcacctaccgcagcaaaggatttgatgtgacagtgaagtacacccagggctcctggacaggctttgtgggggaggacctggtgaccatccccaagggcttcaacaccagcttcctggtgaacatcgccaccatctttgaaagtgagaacttcttcctgcccggcatcaagtggaatggcatcctgggcctggcctatgccaccctggccaagcccagcagcagcctggagaccttctttgacagcctggtgacccaggccaacatccccaacgtgttctccatgcagatgtgtggggccggcctgcctgtggccggcagcggcaccaatggaggcagcctggtgctgggcggcatcgagcccagcctgtacaagggggacatctggtacacccccatcaaggaggagtggtactaccagatcgagatcctgaagctggagattggaggccagagcctgaacctggactgccgggagtacaatgctgacaaggccatcgtggacagcggcaccaccctgctgcggctgccccagaaggtgtttgatgctgtggtggaggccgtggcccgggccagcctcatccctgagttcagtgatggcttctggacaggcagccagctggcctgctggaccaacagcgagaccccctggagctacttccccaagatcagcatctacctgagagatgagaacagcagccgctccttccgcatcaccatcctgccccagctgtacatccagcccatgatgggcgccggcctgaactatgagtgctaccgcttcggcatcagccccagcaccaatgccctggtgattggagccaccgtgatggagggcttctacgtgatctttgaccgggcccagaagagggtgggctttgctgccagcccctgtgccgagattgctggagctgctgtgtctgagatcagcggccccttcagcacagaagatgtggccagcaactgtgtgcctgcccagagcctgtctgagcccatcctgtggatcgtgtcctatgccctgatgtctgtgtgtggggccatcctgctggtgctgattgtgctgctgctgctgcccttccgctgccagaggcggccccgggaccctgaggtggtgaatgatgagagcagcctggtgcgccaccgctggaagtag

SEQ ID NO: 145182 - DNA, 1407 bp, Artificial Sequence
  Description of Artificial Sequence: Synthetic coding sequence
atgggcgccctggcccgggccctgctgctgcccctgctggcccagtggctgctgcgggccgcccctgagctggccccagcccccttcaccctgcccctgcgggtggccgccgccaccaacagagtggtggcccccaccccaggccctggcaccccagctgagagacatgctgatggcctggccctggccctggagcccgccctggccagccctgctggggccgccaacttcctggccatggtggacaacctgcagggcgacagcggccggggctactacctggagatgctgattggcaccccaccccagaagctgcagatcctggtggacaccggcagcagcaactttgctgtggccggcaccccccacagctacatcgacacctactttgacacagagaggagcagcacctaccgcagcaaaggatttgatgtgacagtgaagtacacccagggctcctggacaggctttgtgggggaggacctggtgaccatccccaagggcttcaacaccagcttcctggtgaacatcgccaccatctttgaaagtgagaacttcttcctgcccggcatcaagtggaatggcatcctgggcctggcctatgccaccctggccaagcccagcagcagcctggagaccttctttgacagcctggtgacccaggccaacatccccaacgtgttctccatgcagatgtgtggggccggcctgcctgtggccggcagcggcaccaatggaggcagcctggtgctgggcggcatcgagcccagcctgtacaagggggacatctggtacacccccatcaaggaggagtggtactaccagatcgagatcctgaagctggagattggaggccagagcctgaacctggactgccgggagtacaatgctgacaaggccatcgtggacagcggcaccaccctgctgcggctgccccagaaggtgtttgatgctgtggtggaggccgtggcccgggccagcctgctgtacatccagcccatgatgggcgccggcctgaactatgagtgctaccgcttcggcatcagccccagcaccaatgccctggtgattggagccaccgtgatggagggcttctacgtgatctttgaccgggcccagaagagggtgggctttgctgccagcccctgtgccgagattgctggagctgctgtgtctgagatcagcggccccttcagcacagaagatgtggccagcaactgtgtgcctgcccagagcctgtctgagcccatcctgtggatcgtgtcctatgccctgatgtctgtgtgtggggccatcctgctggtgctgattgtgctgctgctgctgcccttccgctgccagaggcggccccgggaccctgaggtggtgaatgatgagagcagcctggtgcgccaccgctggaagtag

SEQ ID NO: 145183 - DNA, 1272 bp, Artificial Sequence
  Description of Artificial Sequence: Synthetic coding sequence
atgctgattggcaccccaccccagaagctgcagatcctggtggacaccggcagcagcaactttgctgtggccggcaccccccacagctacatcgacacctactttgacacagagaggagcagcacctaccgcagcaagggctttgatgtgacagtgaagtacacccagggctcctggacaggctttgtgggggaggacctggtgaccatccccaagggcttcaacaccagcttcctggtgaacatcgccaccatctttgaaagtgagaacttcttcctgcccggcatcaagtggaatggcatcctgggcctggcctatgccaccctggccaagcccagcagcagcctggagaccttctttgacagcctggtgacccaggccaacatccccaacgtgttctccatgcagatgtgtggggccggcctgcctgtggccggcagcggcaccaacggcggcagcctggtgctgggcggcatcgagcccagcctgtacaagggggacatctggtacacccccatcaaggaggagtggtactaccagatcgagatcctgaagctggagatcggcggccagagcctgaacctggactgccgggagtacaatgctgacaaggccatcgtggacagcggcaccaccctgctgcggctgccccagaaggtgtttgatgctgtggtggaggccgtggcccgggccagcctcatccctgagttcagtgatggcttctggacaggcagccagctggcctgctggaccaacagcgagaccccctggagctacttccccaagatcagcatctacctgagagatgagaacagcagccgctccttccgcatcaccatcctgccccagctgtacatccagcccatgatgggcgccggcctgaactatgagtgctacagatttggcatcagccccagcaccaatgccctggtgattggagccaccgtgatggagggcttctacgtgatctttgaccgggcccagaagagggtgggctttgctgccagcccctgtgccgagattgctggagctgctgtgtctgagatcagcggccccttcagcacagaagatgtggccagcaactgtgtgcctgcccagagcctgtctgagcccatcctgtggatcgtgtcctatgccctgatgtctgtgtgtggggccatcctgctggtgctgattgtgctgctgctgctgcccttccgctgccagaggcggccccgggaccctgaggtggtgaatgatgagagcagcctggtgcgccaccgctggaagtag

SEQ ID NO: 145184 - DNA, 576 bp, Artificial Sequence
  Description of Artificial Sequence: Synthetic coding sequence
atgcccaggagcctgtggctgggctgcagcagcctggccgacagcatgcccagcctgcgctgcctgtacaaccctggcactggagccctgacagccttccagaacagcagcgagcgggaggactgcaacaacggggagccccccaggaagatcatccctgagaagaacagcctgcggcagacctacaacagctgtgcccggctgtgcctgaaccaggagaccgtgtgcctggccagcacagccatgaagacagagaactgtgtggccaagaccaagctggccaacggcaccagctccatgattgtgcccaagcagaggaagctgagcgccagctatgagaaggagaaggagctgtgtgtgaagtactttgagcagtggagcgagagtgaccaggtggagtttgtggagcacctgatcagccagatgtgccactaccagcacggccacatcaacagctacctgaagcccatgctgcagagggacttcatcacagccctgcctgcccggggcctggaccacatcgccgagaacatcctgagctacctggatgccaagagcctgtgtgccgctgagtag

SEQ ID NO: 145185 - DNA, 1818 bp, Artificial Sequence
  Description of Artificial Sequence: Synthetic coding sequence
atggaccctgctgaggccgtgctgcaggagaaggccctgaagttcatgtgcagcatgcccaggagcctgtggctgggctgcagcagcctggccgacagcatgcccagcctgcgctgcctgtacaaccctggcactggagccctgacagccttccagaacagcagcgagcgggaggactgcaacaacggggagccccccaggaagatcatccctgagaagaacagcctgcggcagacctacaacagctgtgcccggctgtgcctgaaccaggagaccgtgtgcctggccagcacagccatgaagacagagaactgtgtggccaagaccaagctggccaacggcaccagctccatgattgtgcccaagcagaggaagctgagcgccagctatgagaaggagaaggagctgtgtgtgaagtactttgagcagtggagcgagagtgaccaggtggagtttgtggagcacctgatcagccagatgtgccactaccagcacggccacatcaacagctacctgaagcccatgctgcagagggacttcatcacagccctgcctgcccggggcctggaccacatcgccgagaacatcctgagctacctggatgccaagagcctgtgtgccgctgagctggtgtgcaaggagtggtacagagtgaccagtgatggcatgctgtggaagaagctgattgaaagaatggtgaggacagacagcctgtggaggggcctggccgagcggcggggctggggccagtacctgttcaagaacaagcccccagatggaaatgccccacccaacagcttctaccgggccctgtaccccaagatcatccaggacatcgagaccatcgagagcaactggaggtgtggccgccacagcctgcagaggatccactgccgctctgagaccagcaagggcgtgtactgcctgcagtatgatgaccagaagatcgtgtctggcctgcgggacaacaccatcaagatctgggacaagaacaccctggagtgcaagaggatcctgaccggccacactggatctgtgctgtgcctgcagtatgatgagagggtcatcatcaccggcagcagtgacagcacagtgcgggtgtgggatgtgaacacaggagagatgctgaacaccctcatccaccactgtgaggccgtgctgcacctgcgcttcaacaacggcatgatggtgacctgcagcaaggacaggagcattgctgtgtgggacatggccagccccacagacatcaccctgcggcgggtgctggtgggccacagagctgctgtgaatgtggtggactttgatgacaagtacatcgtgtctgccagcggggacaggaccatcaaggtgtggaacaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctggtggccgccctggacccccgggccccagctggcaccctgtgcctgcggaccctggtggagcacagcggccgggtcttccggctgcagtttgatgagttccagatcgtgagcagcagccatgatgacaccatcctgatctgggacttcctgaatgaccctgctgcccaggccgagccccccaggagccccagcaggacctacacctacatcagcaggtag

SEQ ID NO: 145186 - DNA, 1695 bp, Artificial Sequence
  Description of Artificial Sequence: Synthetic coding sequence
atgtgcagcatgcccaggagcctgtggctgggctgcagcagcctggccgacagcatgcccagcctgcgctgcctgtacaaccctggcaccggggccctgacagccttccagacctacaacagctgtgcccggctgtgcctgaaccaggagaccgtgtgcctggccagcacagccatgaagacagagaactgtgtggccaagaccaagctggccaacggcaccagctccatgattgtgcccaagcagaggaagctgagcgccagctatgagaaggagaaggagctgtgtgtgaagtactttgagcagtggagcgagagtgaccaggtggagtttgtggagcacctgatcagccagatgtgccactaccagcacggccacatcaacagctacctgaagcccatgctgcagagggacttcatcacagccctgcctgcccggggcctggaccacatcgccgagaacatcctgagctacctggatgccaagagcctgtgtgccgctgagctggtgtgcaaggagtggtacagagtgaccagtgatggcatgctgtggaagaagctgattgaaagaatggtgaggacagacagcctgtggaggggcctggccgagcggcggggctggggccagtacctgttcaagaacaagcccccagatggaaatgccccacccaacagcttctaccgggccctgtaccccaagatcatccaggacatcgagaccatcgagagcaactggaggtgtggccgccacagcctgcagaggatccactgccgctctgagaccagcaaaggagtgtactgcctgcagtatgatgaccagaagatcgtgtctggcctgcgggacaacaccatcaagatctgggacaagaacaccctggagtgcaagaggatcctgaccggccacacaggctctgtgctgtgcctgcagtatgatgagagggtcatcatcaccggcagcagtgacagcacagtgcgggtgtgggatgtgaacacaggagagatgctgaacaccctcatccaccactgtgaggccgtgctgcacctgcgcttcaacaacggcatgatggtgacctgcagcaaggacaggagcattgctgtgtgggacatggccagccccacagacatcaccctgcggcgggtgctggtgggccacagagctgctgtgaatgtggtggactttgatgacaagtacatcgtgtctgccagcggggacaggaccatcaaggtgtggaacaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctggtggccgccctggacccccgggccccagctggcaccctgtgcctgcggaccctggtggagcacagcggccgggtcttccggctgcagtttgatgagttccagatcgtgagcagcagccatgatgacaccatcctgatctgggacttcctgaatgaccctgctgcccaggccgagcccccaagaagccccagcaggacctacacctacatcagcaggtag

SEQ ID NO: 145187 - DNA, 1710 bp, Artificial Sequence
  Description of Artificial Sequence: Synthetic coding sequence
atggaccctgctgaggccgtgctgcaggagaaggccctgaagttcatgaacagcagcgagcgggaggactgcaacaacggggagccccccaggaagatcatccctgagaagaacagcctgcggcagacctacaacagctgtgcccggctgtgcctgaaccaggagaccgtgtgcctggccagcacagccatgaagacagagaactgtgtggccaagaccaagctggccaacggcaccagctccatgattgtgcccaagcagaggaagctgagcgccagctatgagaaggagaaggagctgtgtgtgaagtactttgagcagtggagcgagagtgaccaggtggagtttgtggagcacctgatcagccagatgtgccactaccagcacggccacatcaacagctacctgaagcccatgctgcagagggacttcatcacagccctgcctgcccggggcctggaccacatcgccgagaacatcctgagctacctggatgccaagagcctgtgtgccgctgagctggtgtgcaaggagtggtacagagtgaccagtgatggcatgctgtggaagaagctgattgaaagaatggtgaggacagacagcctgtggaggggcctggccgagcggcggggctggggccagtacctgttcaagaacaagcccccagatggaaatgccccacccaacagcttctaccgggccctgtaccccaagatcatccaggacatcgagaccatcgagagcaactggaggtgtggccgccacagcctgcagaggatccactgccgctctgagaccagcaagggcgtgtactgcctgcagtatgatgaccagaagatcgtgtctggcctgcgggacaacaccatcaagatctgggacaagaacaccctggagtgcaagaggatcctgaccggccacactggatctgtgctgtgcctgcagtatgatgagagggtcatcatcaccggcagcagtgacagcacagtgcgggtgtgggatgtgaacacaggagagatgctgaacaccctcatccaccactgtgaggccgtgctgcacctgcgcttcaacaacggcatgatggtgacctgcagcaaggacaggagcattgctgtgtgggacatggccagccccacagacatcaccctgcggcgggtgctggtgggccacagagctgctgtgaatgtggtggactttgatgacaagtacatcgtgtctgccagcggggacaggaccatcaaggtgtggaacaccagcacctgtgaatttgtgaggaccctgaatggccacaagaggggcatcgcctgcctgcagtacagagaccggctggtggtgtctggcagcagtgacaacaccatccggctgtgggacattgaatgtggggcctgcctgcgggtgctggagggccacgaggagctggtgcgctgcatccgctttgacaacaagagaattgtgtctggggcctatgatggcaagatcaaggtgtgggacctggtggccgccctggacccccgggccccagctggcaccctgtgcctgcggaccctggtggagcacagcggccgggtcttccggctgcagtttgatgagttccagatcgtgagcagcagccatgatgacaccatcctgatctgggacttcctgaatgaccctgctgcccaggccgagccccccaggagccccagcaggacctacacctacatcagcaggtag

SEQ ID NO: 145188 - DNA, 126 bp, Artificial Sequence
  Description of Artificial Sequence: Synthetic coding sequence
atggaccctgctgaggccgtgctgcaggagaaggccctgaagttcatgacctacaacagctgtgcccggctgtgcctgaaccaggagaccgtgtgcctggccagcacagccatgaagacagaatag

SEQ ID NO: 145189 - DNA, 327 bp, Artificial Sequence
  Description of Artificial Sequence: Synthetic coding sequence
atggtgaccctgctgcccatcgagggccaggagatccacttctttgagatcctggagagtgaatgtgtgctgtacacaggctggattgagcgggccagcggcagcagcatctacccagaggccaaggcccggctgcccctggaggccctgctgggcagcaacaaggagcccatgctgcccaaggagaccgtgctgagcctgaagcgctacaacctgggcagcagcgccatgaagagaaatgtgcccggccacgtgctgcagaggcccagctacctgacccgcatccaggtgaccctgctgtgcaacagcagcgctgaggccctgtag

SEQ ID NO: 145190 - DNA, 1521 bp, Artificial Sequence
  Description of Artificial Sequence: Synthetic coding sequence
atggagcagctggatgtgttcatcagcatcaagcccaagcccaagcagcccagcaagagcgtcatcgtgaagtctgtggagagaaatgccctgaacatgtatgaggccaggaagtgcctgctgggcctggagagcagcggcgtgaccatcgccaccagccccagccctgccagctgcccagctggcctggcctgccccagcctggacatcctggccagcgctggcctgggcctgaccggcctgggcctgctgggccccaccaccctgagcctgaacaccagcaccacccccaacagcctgctgaatgccctgaacagctctgtgagccccctgcagagccccagcagcggcacccccagccccaccctgtgggccccacccctggccaacaccagcagcgccaccggcttcagcgccatcccccacctgatgatccccagcacagcccaggccaccctgaccaacatcctgctgtctggagtgcccacctacggccacacagcccccagccccccacctggcctgacccctgtggatgtgcacatcaacagcatgcagacagagggcaagaagatctctgctgccctgaatggacatgcccagagcccagacatcaagtatggagccatcagcaccagcagcctgggggagaaggtgctgagcgccaaccacggggaccccagcatccagaccagcggcagcgagcagaccagccccaagagcagccccacagagggctgcaatgatgcctttgtggaggtgggcatgcccaggagccccagccacagcggaaatgctggggacctgaagcagatgatgtgccccagcaaggtgtcctgtgccaagaggcagacagtggagctgctgcagggcaccaagaacagccacctgcacagcacagaccggctgctgagtgaccctgagctgagcgccacagagagccccctggccgacaagaaggcccctggcagcgagagagctgctgagagagctgctgctgcccagcagaacagcgagcgggcccacctggcccccaggagcagctatgtgaacatgcaggcctttgattatgagcagaagaagctgctggccaccaaggccatgctgaagaagcctgtggtgacagaggtgaggacccccaccaacacctggagcggcctgggcttcagcaagtccatgcctgctgagaccatcaaggagctgcggcgggccaaccacgtgtcctacaagcccaccatgaccaccacctatgagggcagctccatgagcctgagccgcagcaacagccgggagcacctgggcggcggcagcgagagtgacaactggagggacagaaatggcatcggccctggcagccacagcgagtttgctgccagcatcggcagccccaagaggaagcagaacaagagcagcgagcgctgtgtgctgtgcaccctgctgggcatcccccggctggagtgtgtgtacctgggctggagcatcacagactgtggcctgagtgacttcaagtgcctggtgtag

SEQ ID NO: 145191 - DNA, 2925 bp, Artificial Sequence
  Description of Artificial Sequence: Synthetic coding sequence
atggccgcccagggcgagcccggctacctggccgcccagagcgaccccggcagcaacagcgagaggagcacagacagccctgtgcccggctctgaagatgacctggtggccggggccaccctgcacagccctgagtggagcgaggagcgcttccgggtggacaggaagaagctggaggccatgctgcaggccgctgctgagggcaagggccgcagcggggaggacttcttccagaagatcatggaggagaccaacacccagatcgcctggcccagcaagctgaagatcggggccaagagcaagaaggacccccacatcaaggtgtctgggaagaaggaggatgtgaaggaggccaaggagatgatcatgtctgtgctggacaccaagagcaacagagtgaccctgaagatggatgtgagccacacagagcacagccacgtgattggcaagggcggcaacaacatcaagaaggtgatggaggagaccggctgccacatccacttcccagacagcaacagaaacaaccaggccgagaagagcaaccaggtgtccattgctggccagcctgctggggtggagagcgcccgggtgcgcatccgggagctgctgcccctggtgctgatgtttgagctgcccatcgccggcatcctgcagcctgtgcctgaccccaacagccccagcatccagcacatcagccagacctacaacatctctgtgtccttcaagcagaggagcaggatgtacggggccaccgtgattgtgcggggcagccagaacaacaccagcgctgtgaaggagggcacagccatgctgctggagcacctggccggcagcctggccagcgccatccctgtgtccacccagctggacattgctgcccagcaccacctgttcatgatgggcagaaatggcagcaacatcaagcacatcatgcagaggactggagcccagatccacttcccagaccccagcaacccccagaagaagagcacagtgtacctgcagggcaccatcgagagcgtgtgcctggcccggcagtacctgatgggctgcctgcccctggtgctgatgtttgacatgaaggaggagattgaggtggacccccagttcatcgcccagctgatggagcagctggatgtgttcatcagcatcaagcccaagcccaagcagcccagcaagagcgtcatcgtgaagtctgtggagagaaatgccctgaacatgtatgaggccaggaagtgcctgctgggcctggagagcagcggcgtgaccatcgccaccagccccagccctgccagctgcccagctggcctggcctgccccagcctggacatcctggccagcgctggcctgggcctgaccggcctgggcctgctgggccccaccaccctgagcctgaacaccagcaccacccccaacagcctgctgaatgccctgaacagctctgtgagccccctgcagagccccagcagcggcacccccagccccaccctgtgggccccacccctggccaacaccagcagcgccaccggcttcagcgccatcccccacctgatgatccccagcacagcccaggccaccctgaccaacatcctgctgtctggagtgcccacctacggccacacagcccccagccccccacctggcctgacccctgtggatgtgcacatcaacagcatgcagacagagggcaagaagatctctgctgccctgaatggacatgcccagagcccagacatcaagtatggagccatcagcaccagcagcctgggggagaaggtgctgagcgccaaccacggggaccccagcatccagaccagcggcagcgagcagaccagccccaagagcagccccacagagggctgcaatgatgcctttgtggaggtgggcatgcccaggagccccagccacagcggaaatgctggggacctgaagcagatgatgtgccccagcaaggtgtcctgtgccaagaggcagacagtggagctgctgcagggcaccaagaacagccacctgcacagcacagaccggctgctgagtgaccctgagctgagcgccacagagagccccctggccgacaagaaggcccctggcagcgagagagctgctgagagagctgctgctgcccagcagaacagcgagcgggcccacctggcccccaggagcagctatgtgaacatgcaggcctttgattatgagcagaagaagctgctggccaccaaggccatgctgaagaagcctgtggtgacagaggtgaggacccccaccaacacctggagcggcctgggcttcagcaagtccatgcctgctgagaccatcaaggagctgcggcgggccaaccacgtgtcctacaagcccaccatgaccaccacctatgagggcagctccatgagcctgagccgcagcaacagccgggagcacctgggcggcggcagcgagagtgacaactggagggacagaaatggcatcggccctggcagccacagcgagtttgctgccagcatcggcagccccaagaggaagcagaacaagagcacagagcactacctgagcagcagcaactacatggactgcatcagcagcctgaccggcagcaatggctgcaacctgaacagcagcttcaagggcagtgacctgcctgagctgttcagcaagctgggcctgggcaagtacacagatgtgttccagcagcaggagattgacctgcagaccttcctgaccctgacagaccaggacctgaaggagctgggcatcaccaccttcggggcccggaggaagatgctgctggccatcagcgagctgaacaagaacagaaggaagctgtttgagagccccaatgcccggaccagcttcctggagggcggggccagcggccgcctgccccggcagtaccacagcgacatcgcctctgtgtctggccgctggtag

SEQ ID NO: 145192 - DNA, 2928 bp, Artificial Sequence
  Description of Artificial Sequence: Synthetic coding sequence
atggctgctgaggaggtgctgcagacagtggaccactacaagacagaaattgagcggctgaccaaggagctgacagagaccacccatgagaagatccaggccgcagaatatggcctggtggtgctggaggagaagctgaccctgaagcagcagtatgatgagctggaggccgagtatgacagcctgaagcaggagctggagcagctgaaggaggccttcggccagagcttcagcatccacaggaaggtggctgaagatggagagacccgggaggagaccctgctgcaggagagcgccagcaaggaggcctactacctgggcaagatcctggagatgcagaatgagctgaagcagagcagagctgtggtgaccaacgtgcaggctgaaaatgaaaggctgacagctgtggtgcaggacctgaaggagaacaatgagatggtggagctgcagaggatccgcatgaaggatgagatccgggagtacaagttccgggaggcccggctgctgcaggactacacagagctggaggaggagaacatcaccctgcagaagctggtgtccaccctgaagcagaaccaggtggagtatgagggcctgaagcatgagatcaagagatttgaggaggagaccgtgctgctgaacagccagctggaggatgccatccggctgaaggagattgctgagcaccagctggaggaggccctggagaccctgaagaatgaaagagagcagaagaacaacctgaggaaggagctgagccagtacatcagcctgaatgacaaccacatcagcatctctgtggatggcctgaagtttgctgaagatggcagcgagcccaacaatgatgacaagatgaatggccacatccacggccccctggtgaagctgaatggagactaccgcacccccaccctgaggaaaggagagagcctgaaccctgtgtctgacctcttcagcgagctgaacatcagcgagatccagaagctgaagcagcagctgatgcaggtggagcgggagaaggccatcctgctggccaacctgcaggagagccagacccagctggagcacaccaagggggccctgacagagcagcacgagcgggtgcaccggctgacagagcacgtgaatgccatgaggggcctgcagagcagcaaggagctgaaggccgagctggatggagagaagggccgggacagcggggaggaggcccatgactatgaggtggacatcaatggcctggagatcctggagtgcaagtacagagtggccgtgacagaggtgattgacctgaaggccgagatcaaggccctgaaggagaagtacaacaagtctgtggagaactacacagatgagaaggccaagtatgagagcaagatccagatgtatgatgagcaggtgaccagcctggagaagaccaccaaggagagcggggagaagatggcccacatggagaaggagctgcagaagatgaccagcatcgccaatgaaaaccacagcaccctgaacacagcccaggatgagctggtgaccttcagcgaggagctggcccagctgtaccaccacgtgtgcctgtgcaacaatgagacccccaacagagtgatgctggactactaccggcagagccgggtgaccaggagcggcagcctgaagggcccagatgacccccggggcctgctgagcccccggctggccaggagaggagtgagcagccctgtggagaccaggaccagcagcgagcctgtggccaaggagagcacagaggccagcaaggagcccagccccaccaagacccccaccatcagccctgtgatcacagccccacccagcagccctgtgctggacaccagtgacatcaggaaggagcccatgaacatctacaacctgaatgccatcatccgggaccagatcaagcacctgcagaaggctgtggacaggagcctgcagctgagccggcagagagctgctgcccgggagctggcccccatgattgacaaggacaaggaggccctgatggaggagatcctgaagctgaagagcctgctgagcaccaagcgggagcagatcgccaccctgcgggctgtgctgaaggccaacaagcagacagctgaggtggccctggccaacctgaagaacaagtatgaaaatgagaaggccatggtgacagagaccatgaccaagctgagaaatgagctgaaggccctgaaggaggatgctgccaccttcagcagcctgcgggccatgtttgccacccgctgtgatgaatatgtgacccagctggatgagatgcagaggcagctggccgctgctgaagatgagaagaagaccctgaacaccctgctgaggatggccatccagcagaagctggccctgacccagaggctggaggacctggagtttgaccacgagcagagcagaagaagcaagggcaagctgggcaagagcaagattggcagccccaaggtgtctggagaggcctctgtgacagtgcccaccatcgacacctacctgctgcacagccagggcccccagacccccaacatccgggtgagcagcggcacccagaggaagaggcagttcagccccagcctgtgtgaccagagccggcccaggaccagcggggccagctacctgcagaacctgctgcgggtgcccccagaccccaccagcacagagagcttcctgctgaagggcccccccagcatgtctgagttcatccagggccaccggctgagcaaggagaagaggctgactgtggcccccccagactgccagcagcctgctgcctctgtgcccccccagtgcagccagctggccggccggcaggactgccccaccgtgtccccagacacagccctgcctgaggagcagccccacagcagcagccagtgtgcccccctgcactgcctgagcaagccaccccacccctag

SEQ ID NO: 145193 - DNA, 2484 bp, Artificial Sequence
  Description of Artificial Sequence: Synthetic coding sequence
atggctgctgaggaggtgctgcagacagtggaccactacaagacagaaattgagcggctgaccaaggagctgacagagaccacccatgagaagatccaggccgcagaatatggcctggtggtgctggaggagaagctgaccctgaagcagcagtatgatgagctggaggccgagtatgacagcctgaagcaggagctggagcagctgaaggaggccttcggccagagcttcagcatccacaggaaggtggctgaagatggagagacccgggaggagaccctgctgcaggagagcgccagcaaggaggcctactacctgggcaagatcctggagatgcagaatgagctgaagcagagcagagctgtggtgaccaacgtgcaggctgaaaatgaaaggctgacagctgtggtgcaggacctgaaggagaacaatgagatggtggagctgcagaggatccgcatgaaggatgagatccgggagtacaagttccgggaggcccggctgctgcaggactacacagagctggaggaggagaacatcaccctgcagaagctggtgtccaccctgaagcagaaccaggtggagtatgagggcctgaagcatgagatcaagagatttgaggaggagaccgtgctgctgaacagccagctggaggatgccatccggctgaaggagattgctgagcaccagctggaggaggccctggagaccctgaagaatgaaagagagcagaagaacaacctgaggaaggagctgagccagtacatcagcctgaatgacaaccacatcagcatctctgtggatggcctgaagtttgctgaagatggcagcgagcccaacaatgatgacaagatgaatggccacatccacggccccctggtgaagctgaatggagactaccgcacccccaccctgaggaaaggagagagcctgaaccctgtgtctgacctcttcagcgagctgaacatcagcgagatccagaagctgaagcagcagctgatgcaggtggagcgggagaaggccatcctgctggccaacctgcaggagagccagacccagctggagcacaccaagggggccctgacagagcagcacgagcgggtgcaccggctgacagagcacgtgaatgccatgaggggcctgcagagcagcaaggagctgaaggccgagctggatggagagaagggccgggacagcggggaggaggcccatgactatgaggtggacatcaatggcctggagatcctggagtgcaagtacagagtggccgtgacagaggtgattgacctgaaggccgagatcaaggccctgaaggagaagtacaacaagtctgtggagaactacacagatgagaaggccaagtatgagagcaagatccagatgtatgatgagcaggtgaccagcctggagaagaccaccaaggagagcggggagaagatggcccacatggagaaggagctgcagaagatgaccagcatcgccaatgaaaaccacagcaccctgaacacagcccaggatgagctggtgaccttcagcgaggagctggcccagctgtaccaccacgtgtgcctgtgcaacaatgagacccccaacagagtgatgctggactactaccggcagagccgggtgaccaggagcggcagcctgaagggcccagatgacccccggggcctgctgagcccccggctggccaggagaggagtgagcagccctgtggagaccaggaccagcagcgagcctgtggccaaggagagcacagaggccagcaaggagcccagccccaccaagacccccaccatcagccctgtgatcacagccccacccagcagccctgtgctggacaccagtgacatcaggaaggagcccatgaacatctacaacctgaatgccatcatccgggaccagatcaagcacctgcagaaggctgtggacaggagcctgcagctgagccggcagagagctgctgcccgggagctggcccccatgattgacaaggacaaggaggccctgatggaggagatcctgaagctgaagagcctgctgagcaccaagcgggagcagatcgccaccctgcgggctgtgctgaaggccaacaagcagacagctgaggtggccctggccaacctgaagaacaagtatgaaaatgagaaggccatggtgacagagaccatgaccaagctgagaaatgagctgaaggccctgaaggaggatgctgccaccttcagcagcctgcgggccatgtttgccacccgctgtgatgaatatgtgacccagctggatgagatgcagaggcagctggccgctgctgaagatgagaagaagaccctgaacaccctgctgaggatggccatccagcagaagctggccctgacccagaggctggaggacctggagtttgaccacgagcagagcagaagaagcaagggcaagctgggcaagagcaagattggcagccccaagaccatcttcaccttccccctgtag

SEQ ID NO: 145194 - DNA, 2508 bp, Artificial Sequence
  Description of Artificial Sequence: Synthetic coding sequence
atggctgctgaggaggtgctgcagacagtggaccactacaagacagaaattgagcggctgaccaaggagctgacagagaccacccatgagaagatccaggccgcagaatatggcctggtggtgctggaggagaagctgaccctgaagcagcagtatgatgagctggaggccgagtatgacagcctgaagcaggagctggagcagctgaaggaggccttcggccagagcttcagcatccacaggaaggtggctgaagatggagagacccgggaggagaccctgctgcaggagagcgccagcaaggaggcctactacctgggcaagatcctggagatgcagaatgagctgaagcagagcagagctgtggtgaccaacgtgcaggctgaaaatgaaaggctgacagctgtggtgcaggacctgaaggagaacaatgagatggtggagctgcagaggatccgcatgaaggatgagatccgggagtacaagttccgggaggcccggctgctgcaggactacacagagctggaggaggagaacatcaccctgcagaagctggtgtccaccctgaagcagaaccaggtggagtatgagggcctgaagcatgagatcaagagatttgaggaggagaccgtgctgctgaacagccagctggaggatgccatccggctgaaggagattgctgagcaccagctggaggaggccctggagaccctgaagaatgaaagagagcagaagaacaacctgaggaaggagctgagccagtacatcagcctgaatgacaaccacatcagcatctctgtggatggcctgaagtttgctgaagatggcagcgagcccaacaatgatgacaagatgaatggccacatccacggccccctggtgaagctgaatggagactaccgcacccccaccctgaggaaaggagagagcctgaaccctgtgtctgacctcttcagcgagctgaacatcagcgagatccagaagctgaagcagcagctgatgcaggtggagcgggagaaggccatcctgctggccaacctgcaggagagccagacccagctggagcacaccaagggggccctgacagagcagcacgagcgggtgcaccggctgacagagcacgtgaatgccatgaggggcctgcagagcagcaaggagctgaaggccgagctggatggagagaagggccgggacagcggggaggaggcccatgactatgaggtggacatcaatggcctggagatcctggagtgcaagtacagagtggccgtgacagaggtgattgacctgaaggccgagatcaaggccctgaaggagaagtacaacaagtctgtggagaactacacagatgagaaggccaagtatgagagcaagatccagatgtatgatgagcaggtgaccagcctggagaagaccaccaaggagagcggggagaagatggcccacatggagaaggagctgcagaagatgaccagcatcgccaatgaaaaccacagcaccctgaacacagcccaggatgagctggtgaccttcagcgaggagctggcccagctgtaccaccacgtgtgcctgtgcaacaatgagacccccaacagagtgatgctggactactaccggcagagccgggtgaccaggagcggcagcctgaagggcccagatgacccccggggcctgctgagcccccggctggccaggagaggagtgagcagccctgtggagaccaggaccagcagcgagcctgtggccaaggagagcacagaggccagcaaggagcccagccccaccaagacccccaccatcagccctgtgatcacagccccacccagcagccctgtgctggacaccagtgacatcaggaaggagcccatgaacatctacaacctgaatgccatcatccgggaccagatcaagcacctgcagaaggctgtggacaggagcctgcagctgagccggcagagagctgctgcccgggagctggcccccatgattgacaaggacaaggaggccctgatggaggagatcctgaagctgaagagcctgctgagcaccaagcgggagcagatcgccaccctgcgggctgtgctgaaggccaacaagcagacagctgaggtggccctggccaacctgaagaacaagtatgaaaatgagaaggccatggtgacagagaccatgaccaagctgagaaatgagctgaaggccctgaaggaggatgctgccaccttcagcagcctgcgggccatgtttgccacccgctgtgatgaatatgtgacccagctggatgagatgcagaggcagctggccgctgctgaagatgagaagaagaccctgaacaccctgctgaggatggccatccagcagaagctggccctgacccagaggctggaggacctggagtttgaccacgagcagagcagaagaagcaagggcaagctgggcaagagcaagattggcagccccaagatcgtgagcagcctgctgcccccctaccgccacagcgcccacaactag

SEQ ID NO: 145195 - DNA, 2568 bp, Artificial Sequence
  Description of Artificial Sequence: Synthetic coding sequence
atgtctgcccccagcgaggaggaggagtatgcccggctggtgatggaggcccagcctgagtggctgcgggcagaggtgaagaggctgagccatgagctggccgagaccacccgggagaagatccaggccgcagaatatggcctggccgtgctggaggagaagcaccagctgaagctgcagtttgaggagctggaggtggactatgaggccatccgctctgagatggagcagctgaaggaggccttcggccaggcccacaccaaccacaagaaggtggccgcagatggagagagccgggaggagagcctcatccaggagagcgccagcaaggagcagtactacgtgaggaaggtgctggagctgcagacagagctgaagcagctgagaaatgtgctgaccaacacccagagtgaaaatgaaaggctggcctctgtggcccaggagctgaaggagatcaaccagaatgtggagatccagaggggccgcctgagagatgacatcaaggagtacaagttccgggaggcccggctgctgcaggactacagcgagctggaggaggagaacatcagcctgcagaagcaggtgtctgtgctgcggcagaaccaggtggagtttgagggcctgaagcatgagatcaagaggctggaggaggagacagagtacctgaacagccagctggaggatgccatccggctgaaggagatcagcgagcggcagctggaggaggccctggagaccctgaagacagagcgggagcagaagaacagcctgaggaaggagctgagccactacatgagcatcaatgacagcttctacaccagccacctgcacgtgtccctggatggcctgaagttcagtgatgatgctgctgagcccaacaatgatgctgaggccctggtgaatggatttgaacatggaggcctggccaagctgcccctggacaacaagaccagcacccccaagaaggagggcctggccccacccagccccagcctggtgtctgacctgctgtctgagctgaacatcagcgagatccagaagctgaagcagcagctgatgcagatggagcgggagaaggccggcctgctggccaccctgcaggacacccagaagcagctggagcacacccggggcagcctgtctgagcagcaggagaaggtgacccggctgacagagaacctgagcgccctgcggcggctgcaggccagcaaggagcggcagacagccctggacaatgagaaggaccgggacagccatgaagatggagactactatgaggtggacatcaatggacctgagatcctggcctgcaagtaccacgtggccgtggccgaggccggggagctgcgggagcagctgaaggccctgcggagcacccatgaggcccgggaggcccagcacgccgaggagaagggccgctatgaggccgagggccaggccctgacagagaaggtgtccctgctggagaaggccagccggcaggaccgggagctgctggcccggctggagaaggagctgaagaaggtgtctgatgtggccggggagacccagggcagcctgtctgtggcccaggatgagctggtgaccttcagcgaggagctggccaacctgtaccaccacgtgtgcatgtgcaacaatgagacccccaacagagtgatgctggactactaccgggagggccagggcggggccggccgcaccagccctgggggccgcaccagccctgaggcccggggccgccgcagccccatcctgctgcccaagggcctgctggcccctgaggccggccgggcagatggcggcaccggggacagcagccccagccctggcagcagcctgcccagccccctgagtgacccccggcgggagcccatgaacatctacaacctgattgccatcatccgggaccagatcaagcacctgcaggccgctgtggacaggaccacagagctgagccggcagagaattgccagccaggagctgggccctgctgtggacaaggacaaggaggccctgatggaggagatcctgaagctgaagagcctgctgagcaccaagcgggagcagatcaccaccctgaggacagtgctgaaggccaacaagcagacagctgaggtggccctggccaacctgaagagcaaatatgaaaatgagaaggccatggtgacagagaccatgatgaagctgagaaatgagctgaaggccctgaaggaggatgctgccaccttcagcagcctgcgggccatgtttgccacccgctgtgatgagtacatcacccagctggatgagatgcagaggcagctggccgctgctgaagatgagaagaagaccctgaacagcctgctgaggatggccatccagcagaagctggccctgacccagaggctggagctgctggagctggaccacgagcagacccggcggggccgggccaaggccgcccccaagaccaagccagccaccccatctgtgagccacacctgtgcctgtgccagtgacagagctgagggcaccggcctggccaaccaggtgttctgcagcgagaagcacagcatctactgtgactag

SEQ ID NO: 145196 - DNA, 2475 bp, Artificial Sequence
  Description of Artificial Sequence: Synthetic coding sequence
atgtctgcccccagcgaggaggaggagtatgcccggctggtgatggaggcccagcctgagtggctgcgggcagaggtgaagaggctgagccatgagctggccgagaccacccgggagaagatccaggccgcagaatatggcctggccgtgctggaggagaagcaccagctgaagctgcagtttgaggagctggaggtggactatgaggccatccgctctgagatggagcagctgaaggaggccttcggccaggcccacaccaaccacaagaaggtggccgcagatggagagagccgggaggagagcctcatccaggagagcgccagcaaggagcagtactacgtgaggaaggtgctggagctgcagacagagctgaagcagctgagaaatgtgctgaccaacacccagagtgaaaatgaaaggctggcctctgtggcccaggagctgaaggagatcaaccagaatgtggagatccagaggggccgcctgagagatgacatcaaggagtacaagttccgggaggcccggctgctgcaggactacagcgagctggaggaggagaacatcagcctgcagaagcaggtgtctgtgctgcggcagaaccaggtggagtttgagggcctgaagcatgagatcaagaggctggaggaggagacagagtacctgaacagccagctggaggatgccatccggctgaaggagatcagcgagcggcagctggaggaggccctggagaccctgaagacagagcgggagcagaagaacagcctgaggaaggagctgagccactacatgagcatcaatgacagcttctacaccagccacctgcacgtgtccctggatggcctgaagttcagtgatgatgctgctgagcccaacaatgatgctgaggccctggtgaatggatttgaacatggaggcctggccaagctgcccctggacaacaagaccagcacccccaagaaggagggcctggccccacccagccccagcctggtgtctgacctgctgtctgagctgaacatcagcgagatccagaagctgaagcagcagctgatgcagatggagcgggagaaggccggcctgctggccaccctgcaggacacccagaagcagctggagcacacccggggcagcctgtctgagcagcaggagaaggtgacccggctgacagagaacctgagcgccctgcggcggctgcaggccagcaaggagcggcagacagccctggacaatgagaaggaccgggacagccatgaagatggagactactatgaggtggacatcaatggacctgagatcctggcctgcaagtaccacgtggccgtggccgaggccggggagctgcgggagcagctgaaggccctgcggagcacccatgaggcccgggaggcccagcacgccgaggagaagggccgctatgaggccgagggccaggccctgacagagaaggtgtccctgctggagaaggccagccggcaggaccgggagctgctggcccggctggagaaggagctgaagaaggtgtctgatgtggccggggagacccagggcagcctgtctgtggcccaggatgagctggtgaccttcagcgaggagctggccaacctgtaccaccacgtgtgcatgtgcaacaatgagacccccaacagagtgatgctggactactaccgggagggccagggcggggccggccgcaccagccctgggggccgcaccagccctgaggcccggggccgccgcagccccatcctgctgcccaagggcctgctggcccctgaggccggccgggcagatggcggcaccggggacagcagccccagccctggcagcagcctgcccagccccctgagtgacccccggcgggagcccatgaacatctacaacctgattgccatcatccgggaccagatcaagcacctgcaggccgctgtggacaggaccacagagctgagccggcagagaattgccagccaggagctgggccctgctgtggacaaggacaaggaggccctgatggaggagatcctgaagctgaagagcctgctgagcaccaagcgggagcagatcaccaccctgaggacagtgctgaaggccaacaagcagacagctgaggtggccctggccaacctgaagagcaaatatgaaaatgagaaggccatggtgacagagaccatgatgaagctgagaaatgagctgaaggccctgaaggaggatgctgccaccttcagcagcctgcgggccatgtttgccacccgctgtgatgagtacatcacccagctggatgagatgcagaggcagctggccgctgctgaagatgagaagaagaccctgaacagcctgctgaggatggccatccagcagaagctggccctgacccagaggctggagctgctggagctggaccacgagcagacccggcggggccgggccaaggccgcccccaagaccaagccagccacccccagcctgtag

SEQ ID NO: 145197 - DNA, 1107 bp, Artificial Sequence
  Description of Artificial Sequence: Synthetic coding sequence
atgtggcccctgtggaggctggtgtccctgctggccctgagccaggccctgccctttgagcagaggggcttctgggacttcaccctggatgatggccccttcatgatgaatgatgaggaggccagcggggctgacaccagcggcgtgctggaccctgacagcgtgacccccacctacagcgccatgtgccccttcggctgccactgccacctgcgggtggtgcagtgcagcgacctgggcctgaagtctgtgcccaaggagatcagcccagacaccaccctgctggacctgcagaacaatgacatcagcgagctgaggaaggatgacttcaagggcctgcagcacctgtatgccctggtgctggtgaacaacaagatcagcaagatccacgagaaggccttcagccccctgaggaagctgcagaagctgtacatcagcaagaaccacctggtggagatcccccccaacctgcccagcagcctggtggagctgcgcatccatgacaaccgcatcaggaaggtgcccaagggcgtcttcagcggcctgaggaacatgaactgcatcgagatgggcggcaaccccctggagaacagcggctttgagcccggggcctttgatggcctgaagctgaactacctgcgcatcagcgaggccaagctgaccggcatccccaaggacctgcctgagaccctgaatgagctgcacctggaccacaacaagatccaggccatcgagctggaggacctgctgcgctacagcaagctgtaccgcctgggcctgggccacaaccagatccgcatgattgaaaatggcagcctgtccttcctgcccaccctgcgggagctgcacctggacaacaacaagctggcccgggtgcccagcggcctgcctgacctgaagctgctgcaggtggtgtacctgcacagcaacaacatcaccaaggtgggcgtgaatgacttctgccccatgggctttggagtgaagagggcctactacaacggcatcagcctcttcaacaaccctgtgccctactgggaggtgcagcctgccaccttccgctgtgtgacagaccggctggccatccagtttggaaactacaagaagtag

SEQ ID NO: 145198 - DNA, 924 bp, Artificial Sequence
  Description of Artificial Sequence: Synthetic coding sequence
atgtgccccttcggctgccactgccacctgcgggtggtgcagtgcagcgacctgggcctgaagtctgtgcccaaggagatcagcccagacaccaccctgctggacctgcagaacaatgacatcagcgagctgaggaaggatgacttcaagggcctgcagcacctgtatgccctggtgctggtgaacaacaagatcagcaagatccacgagaaggccttcagccccctgaggaagctgcagaagctgtacatcagcaagaaccacctggtggagatcccccccaacctgcccagcagcctggtggagctgcgcatccatgacaaccgcatcaggaaggtgcccaagggcgtcttcagcggcctgaggaacatgaactgcatcgagatgggcggcaaccccctggagaacagcggctttgagcccggggcctttgatggcctgaagctgaactacctgcgcatcagcgaggccaagctgaccggcatccccaaggacctgcctgagaccctgaatgagctgcacctggaccacaacaagatccaggccatcgagctggaggacctgctgcgctacagcaagctgtaccgcctgggcctgggccacaaccagatccgcatgattgaaaatggcagcctgtccttcctgcccaccctgcgggagctgcacctggacaacaacaagctggcccgggtgcccagcggcctgcctgacctgaagctgctgcaggtggtgtacctgcacagcaacaacatcaccaaggtgggcgtgaatgacttctgccccatgggcttcggcgtgaagagggcctactacaacggcatcagcctcttcaacaaccctgtgccctactgggaggtgcagcctgccaccttccgctgtgtgacagaccggctggccatccagtttggaaactacaagaagtag

SEQ ID NO: 145199 - DNA, 924 bp, Artificial Sequence; identical to SEQ ID NO: 145198
  Description of Artificial Sequence: Synthetic coding sequence

SEQ ID NO: 145200 - DNA, 717 bp, Artificial Sequence
  Description of Artificial Sequence: Synthetic coding sequence
atgtggcccctgtggaggctggtgtccctgctggccctgagccaggccctgccctttgagcagaggggcttctgggacttcaccctggatgatggccccttcatgatgaatgatgaggaggccagcggggctgacaccagcggcgtgctggaccctgacagcgtgacccccacctacagcgccatgtgccccttcggctgccactgccacctgcgggtggtgcagtgcagcgacctgggcctgaagtctgtgcccaaggagatcagcccagacaccaccctgctggacctgcagaacaatgacatcagcgagctgaggaaggatgacttcaagggcctgcagcacctgtatgtgcgctcctgggaggagcctgctggcctgcagcagagagctggggtgcgggccctggtgctggtgaacaacaagatcagcaagatccacgagaaggccttcagccccctgaggaagctgcagaagctgtacatcagcaagaaccacctggtggagatcccccccaacctgcccagcagcctggtggagctgcgcatccatgacaaccgcatcaggaaggtgcccaagggcgtcttcagcggcctgaggaacatgaactgcatcgagatgggcggcaaccccctggagaacagcggctttgagcccggggcctttgatggcctgaagctgaactacctgcgcatcagcgaggccaagctgacctag

SEQ ID NO: 145201 - DNA, 1257 bp, Artificial Sequence
  Description of Artificial Sequence: Synthetic coding sequence
atgatccagctgacagccacccctgtgtctgccctggtggatgagcctgtgcacatccgggccaccggcctcatccccttccagatggtgtccttccaggccagcctggaggatgaaaatggagacatgttctacagccaggcccactaccgggccaatgaatttggagaggtggacctgaaccacgccagcagcctgggcggggactacatgggcgtgcaccccatgggcctcttctggagcctgaagccagagaagctgctgacccggctgctgaagagagatgtgatgaaccggcccttccaggtgcaggtgaagctgtatgacctggagctgattgtgaacaacaaggtggccagcgcccccaaggccagcctgaccctggagcgctggtacgtggcccctggggtgacccgcatcaaggtgcgggagggccgcctgcggggggccctcttcctgcccccaggagagggcctcttccctggggtcatcgacctgtttggaggcctgggcggcctgctggagttccgggccagcctgctggccagccggggctttgccagcctggccctggcctaccacaactatgaggacctgcccaggaagccagaggtgacagacctggagtactttgaggaggccgccaacttcctgctgcggcaccccaaggtgtttggaagtggagtgggcgtggtgtctgtgtgccagggcgtgcagatcggcctgtccatggccatctacctgaagcaggtgacagccaccgtgctgatcaatggcaccaacttccccttcggcatcccccaggtgtaccacggccagatccaccagcccctgccccacagcgcccagctgatcagcaccaatgccctgggcctgctggagctgtaccgcacctttgagaccacccaggtgggcgccagccagtacctgttccccatcgaggaggcccagggccagttcctgttcatcgtgggggagggggacaagaccatcaacagcaaggcccatgctgagcaggccatcggccagctgaagagacatggcaagaacaactggaccctgctgagctacccaggggccggccacctgattgagcccccctacagccccctgtgctgtgccagcaccacccatgacctgcggctgcactggggcggggaggtgatcccccacgccgccgcccaggagcacgcctggaaggagatccagcgcttcctgaggaagcacctgatcccagatgtgaccagccagctgtag

SEQ ID NO: 145202 - DNA, 1257 bp, Artificial Sequence; identical to SEQ ID NO: 145201
  Description of Artificial Sequence: Synthetic coding sequence

SEQ ID NO: 145203 - DNA, 891 bp, Artificial Sequence
  Description of Artificial Sequence: Synthetic coding sequence
atgaatgctgagcctgagaggaagtttggagtggtggtggtgggcgtgggccgggccggctctgtgaggatgagggacctgaggaacccccaccccagcagcgccttcctgaacctgattggatttgtgtccagaagagagctgggcagcattgatggagtgcagcagatcagcctggaggatgccctgagcagccaggaggtggaggtggcctacatctgcagcgagagcagcagccatgaggactacatccggcagttcctgaatgctgggaagcacgtgctggtggagtaccccatgaccctgagcctggccgccgcccaggagctgtgggagctggccgagcagaagggcaaggtgctgcacgaggagcacgtggagctgctgatggaggagtttgccttcctgaagaaggaggtggtgggcaaggacctgctgaagggcagcctgctcttcaccgctggccccctggaggaggagcgcttcggcttccctgccttcagcggcatcagccggctgacctggctggtgtccctgtttggagagctgagcctggtgtctgccaccctggaggagaggaaagaagaccagtacatgaagatgacagtgtgcctggagacagagaagaagagccccctgtcctggattgaggagaagggccctggcctgaagaggaaccgctacctgtccttccacttcaagagcggcagcctggagaatgtgcccaacgtgggcgtgaacaagaacatcttcctgaaggaccagaacatctttgtgcagaagctgctgggccagttcagcgagaaggagctggccgctgagaagaagaggatcctgcactgcctgggcctggccgaggagatccagaagtactgctgcagcaggaagtag

SEQ ID NO: 145204 - DNA, 891 bp, Artificial Sequence; identical to SEQ ID NO: 145203
  Description of Artificial Sequence: Synthetic coding sequence

SEQ ID NO: 145205 - DNA, 309 bp, Artificial Sequence
  Description of Artificial Sequence: Synthetic coding sequence
atgaatgctgagcctgagaggaagtttggagtggtggtggtgggcgtgggccgggccggctctgtgaggatgagggacctgaggaacccccaccccagcagcgccttcctgaacctgattggatttgtgtccagaagagagctgggcagcattgatggagtgcagcagatcagcctggaggatgccctgagcagccaggaggtggaggtggcctacatctgcagcgagagcagcagccatgaggactacatccggcagttcctgaatgctgggaagcacgtgctggtggagtaccccatgaccctgtag

SEQ ID NO: 145206 - DNA, 621 bp, Artificial Sequence
  Description of Artificial Sequence: Synthetic coding sequence
atggctgtgaagaagatcgccatctttggagccaccggccagacaggcctgaccaccctggcccaggccgtgcaggccggctatgaggtgacagtgctggtgcgggacagcagccggctgcccagcgagggccccaggcctgcccacgtggtggtgggagatgtgctgcaggccgcagatgtggacaagacagtggccggccaggatgctgtgattgtgctgctgggcaccagaaatgacctgagccccaccaccgtgatgtctgagggcgccaggaacatcgtggccgccatgaaggcccatggagtggacaaggtggtggcctgcaccagcgccttcctgctgtgggaccccaccaaggtgcccccccggctgcaggccgtgacagatgaccacatccgcatgcacaaggtgctgcgggagagcggcctgaagtatgtggccgtgatgccaccccacatcggggaccagcccctgaccggggcctacacagtgaccctggatggccggggccccagcagggtcatcagcaagcatgacctgggccacttcatgctgcgctgcctgaccacagatgaatatgatggccacagcacctaccccagccaccagtaccagtag

SEQ ID NO: 145207 - DNA, 399 bp, Artificial Sequence
  Description of Artificial Sequence: Synthetic coding sequence
atgggcagcctgatgctgctgtttgtggagaccaccaggaacagcagcgcctgcatcttccctgtgatcctgaatgagctgagcagcacagtggagaccatcacccacttccctgaggtgacagatggagaatgtgtgttccccttccactacaagaatggcacctactatgactgcatcaagagcaaggcccggcacaagtggtgcagcctgaacaagacctatgagggctactggaagttctgcagcgcagaagattttgccaactgtgtgttccccttctggtacagaagactcatctactgggagtgcacagatgatggagaggccttcggcaagaagtggtgcagcctgaccaagaacttcaacaaggaccgcatctggaagtactgtgagtag

SEQ ID NO: 145208 - DNA, 429 bp, Artificial Sequence
  Description of Artificial Sequence: Synthetic coding sequence
atggctgctgctgctgagggcgtgctggccaccaggagtgatgagcccgccagagatgatgctgctgtggagacagctgaggaggccaaggagcctgctgaggccgacatcacagagctgtgccgggacatgttcagcaagatggccacctacctgactggagagctgacagccaccagcgaggactacaagctgctggagaacatgaacaagctgaccagcctgaagtacctggagatgaaggacatcgccatcaacatcagcaggaacctgaaggacctgaaccagaagtatgccggcctgcagccctacctggaccagatcaacgtgattgaggagcaggtggccgccctggagcaggccgcctacaagctggatgcctacagcaagaagctggaggccaagtacaagaagctggagaagaggtag

SEQ ID NO: 145209 - DNA, 225 bp, Artificial Sequence
  Description of Artificial Sequence: Synthetic coding sequence
atgaacaagctgaccagcctgaagtacctggagatgaaggacatcgccatcaacatcagcaggaacctgaaggacctgaaccagaagtatgccggcctgcagccctacctggaccagatcaacgtgattgaggagcaggtggccgccctggagcaggccgcctacaagctggatgcctacagcaagaagctggaggccaagtacaagaagctggagaagaggtag

SEQ ID NO: 145210 - DNA, 225 bp, Artificial Sequence; identical to SEQ ID NO: 145209
  Description of Artificial Sequence: Synthetic coding sequence

SEQ ID NO: 145211 - DNA, 300 bp, Artificial Sequence
  Description of Artificial Sequence: Synthetic coding sequence
atgttcagcaagatggccacctacctgaccggggagctgacagccaccagcgaggactacaagctgctggagaacatgaacaagctgaccagcctgaagtacctggagatgaaggacatcgccatcaacatcagcaggaacctgaaggacctgaaccagaagtatgccggcctgcagccctacctggaccagatcaacgtcatcgaggagcaggtggccgccctggagcaggccgcctacaagctggatgcctacagcaagaagctggaggccaagtacaagaagctggagaagaggtag

SEQ ID NO: 145212 - DNA, 609 bp, Artificial Sequence
  Description of Artificial Sequence: Synthetic coding sequence
atggccagccagggcagaagaagaagacccctgcggcggcctgagaccgtggtgcctggagaggccacagaaacagattctgagaggtctgccagcagcagcgaggaggaggagctgtacctgggccccagcggccccacccggggccggcccaccggcctgcgggtggccggggaggccgctgagacagattctgagcctgagcctgagcctgagcccacagctgccccccgggacctgccccccctggtggtgcagcgggagagcgctgaggaggcctggggcacagaggaggccccagccccagccccagcccggagcctgctgcagctgcggctggccgagagccaggcccggctggaccatgatgtggccgctgctgtgtctggagtgtacagaagagctggaagagatgtggccgccctggccagccggctggccgccgcccaggccgccggcctggccgccgcccacagcgtgcggctggcccggggggacctgtgtgccctggccgagcggctggacatcgtggccggctgccgcctgctgcctgacatccggggcgtgcccggcacagagcctgagaaggaccccggcccccgggcctag

SEQ ID NO: 145213 - DNA, 1632 bp, Artificial Sequence
  Description of Artificial Sequence: Synthetic coding sequence
atggcccacgcccacatccagggcggccggcgggccaagagcagatttgtggtgtgcatcatgtctggggcccggagcaagctggccctcttcctgtgtggctgctacgtggtggccctgggcgcccacactggagaggagagcgtggccgaccaccatgaagctgagtactacgtggccgctgtgtatgagcaccccagcatcctgagcctgaaccccctggccctgatcagccggcaggaggccctggagctgatgaaccagaacctggacatctatgagcagcaggtgatgacagctgcccagaaggatgtgcagatcatcgtgtttcctgaagatggcatccacggcttcaacttcaccaggaccagcatctaccccttcctggacttcatgcccagcccccaggtggtgcgctggaacccctgcctggagccccaccgcttcaatgacacagaggtgctgcagaggctgagctgcatggccatccggggggacatgttcctggtggccaacctgggcaccaaggagccctgccacagcagtgacccccgctgccccaaggatggccgctaccagttcaacaccaacgtggtgttcagcaacaacggcaccctggtggaccgctacaggaagcacaacctgtactttgaagctgcctttgatgtgcccctgaaggtggacctgatcacctttgacaccccatttgctggccgcttcggcatcttcacctgctttgacatcctcttctttgatcctgccatccgggtgctgcgggactacaaggtgaagcacgtggtgtaccccacagcctggatgaaccagctgcccctgctggccgccatcgagatccagaaggcctttgctgtggccttcggcatcaacgtgctggccgccaacgtgcaccaccctgtgctgggcatgactggaagtggcatccacacccccctggagagcttctggtaccatgacatggagaaccccaagagccacctgatcatcgcccaggtggccaagaaccctgtgggcctgattggagcagaaaatgccactggagaaacagaccccagccacagcaagttcctgaagatcctgagcggggacccctactgtgagaaggatgcccaggaggtgcactgtgatgaggccaccaagtggaatgtgaatgccccacccaccttccacagcgagatgatgtatgacaacttcaccctggtgcctgtgtggggcaaggagggctacctgcacgtgtgcagcaatggcctgtgctgctacctgctgtatgaaagacccaccctgagcaaggagctgtatgccctgggcgtgtttgatggcctgcacacagtgcacggcacctactacatccaggtgtgtgccctggtgcgctgtggcggcctgggctttgacacctgtggccaggagatcacagaggccaccggcatctttgagttccacctgtggggcaacttcagcaccagctacatcttccccctcttcctgaccagcggcatgaccctggaggtgcctgaccagctgggctgggagaatgaccactacttcctgaggaagagccggctgagcagcggcctggtgacagctgccctgtatggccgcctgtatgaaagagactag

SEQ ID NO: 145214 - DNA, 1572 bp, Artificial Sequence
  Description of Artificial Sequence: Synthetic coding sequence
atgtctggggcccggagcaagctggccctcttcctgtgtggctgctacgtggtggccctgggcgcccacactggagaggagagcgtggccgaccaccatgaagctgagtactacgtggccgctgtgtatgagcaccccagcatcctgagcctgaaccccctggccctgatcagccggcaggaggccctggagctgatgaaccagaacctggacatctatgagcagcaggtgatgacagctgcccagaaggatgtgcagatcatcgtgtttcctgaagatggcatccacggcttcaacttcaccaggaccagcatctaccccttcctggacttcatgcccagcccccaggtggtgcgctggaacccctgcctggagccccaccgcttcaatgacacagaggtgctgcagaggctgagctgcatggccatccggggggacatgttcctggtggccaacctgggcaccaaggagccctgccacagcagtgacccccgctgccccaaggatggccgctaccagttcaacaccaacgtggtgttcagcaacaacggcaccctggtggaccgctacaggaagcacaacctgtactttgaagctgcctttgatgtgcccctgaaggtggacctgatcacctttgacaccccatttgctggccgcttcggcatcttcacctgctttgacatcctcttctttgatcctgccatccgggtgctgcgggactacaaggtgaagcacgtggtgtaccccacagcctggatgaaccagctgcccctgctggccgccatcgagatccagaaggcctttgctgtggccttcggcatcaacgtgctggccgccaacgtgcaccaccctgtgctgggcatgactggaagtggcatccacacccccctggagagcttctggtaccatgacatggagaaccccaagagccacctgatcatcgcccaggtggccaagaaccctgtgggcctgattggagcagaaaatgccactggagaaacagaccccagccacagcaagttcctgaagatcctgagcggggacccctactgtgagaaggatgcccaggaggtgcactgtgatgaggccaccaagtggaatgtgaatgccccacccaccttccacagcgagatgatgtatgacaacttcaccctggtgcctgtgtggggcaaggagggctacctgcacgtgtgcagcaatggcctgtgctgctacctgctgtatgaaagacccaccctgagcaaggagctgtatgccctgggcgtgtttgatggcctgcacacagtgcacggcacctactacatccaggtgtgtgccctggtgcgctgtggcggcctgggctttgacacctgtggccaggagatcacagaggccaccggcatctttgagttccacctgtggggcaacttcagcaccagctacatcttccccctcttcctgaccagcggcatgaccctggaggtgcctgaccagctgggctgggagaatgaccactacttcctgaggaagagccggctgagcagcggcctggtgacagctgccctgtatggccgcctgtatgaaagagactag

SEQ ID NO: 145215 - DNA, 1638 bp, Artificial Sequence
  Description of Artificial Sequence: Synthetic coding sequence
atggccaggaaggagacccagctgatcatcaagatgaaccacctggccaggtttgtggtgtgcatcatgtctggggcccggagcaagctggccctcttcctgtgtggctgctacgtggtggccctgggcgcccacactggagaggagagcgtggccgaccaccatgaagctgagtactacgtggccgctgtgtatgagcaccccagcatcctgagcctgaaccccctggccctgatcagccggcaggaggccctggagctgatgaaccagaacctggacatctatgagcagcaggtgatgacagctgcccagaaggatgtgcagatcatcgtgtttcctgaagatggcatccacggcttcaacttcaccaggaccagcatctaccccttcctggacttcatgcccagcccccaggtggtgcgctggaacccctgcctggagccccaccgcttcaatgacacagaggtgctgcagaggctgagctgcatggccatccggggggacatgttcctggtggccaacctgggcaccaaggagccctgccacagcagtgacccccgctgccccaaggatggccgctaccagttcaacaccaacgtggtgttcagcaacaacggcaccctggtggaccgctacaggaagcacaacctgtactttgaagctgcctttgatgtgcccctgaaggtggacctgatcacctttgacaccccatttgctggccgcttcggcatcttcacctgctttgacatcctcttctttgatcctgccatccgggtgctgcgggactacaaggtgaagcacgtggtgtaccccacagcctggatgaaccagctgcccctgctggccgccatcgagatccagaaggcctttgctgtggccttcggcatcaacgtgctggccgccaacgtgcaccaccctgtgctgggcatgactggaagtggcatccacacccccctggagagcttctggtaccatgacatggagaaccccaagagccacctgatcatcgcccaggtggccaagaaccctgtgggcctgattggagcagaaaatgccactggagaaacagaccccagccacagcaagttcctgaagatcctgagcggggacccctactgtgagaaggatgcccaggaggtgcactgtgatgaggccaccaagtggaatgtgaatgccccacccaccttccacagcgagatgatgtatgacaacttcaccctggtgcctgtgtggggcaaggagggctacctgcacgtgtgcagcaatggcctgtgctgctacctgctgtatgaaagacccaccctgagcaaggagctgtatgccctgggcgtgtttgatggcctgcacacagtgcacggcacctactacatccaggtgtgtgccctggtgcgctgtggcggcctgggctttgacacctgtggccaggagatcacagaggccaccggcatctttgagttccacctgtggggcaacttcagcaccagctacatcttccccctcttcctgaccagcggcatgaccctggaggtgcctgaccagctgggctgggagaatgaccactacttcctgaggaagagccggctgagcagcggcctggtgacagctgccctgtatggccgcctgtatgaaagagactag

SEQ ID NO: 145216 - DNA, 1638 bp, Artificial Sequence
  Description of Artificial Sequence: Synthetic coding sequence
atgcctgagggcggcggcaccagccggcggctgctgcccatgcagagcagatttgtggtgtgcatcatgtctggggcccggagcaagctggccctcttcctgtgtggctgctacgtggtggccctgggcgcccacactggagaggagagcgtggccgaccaccatgaagctgagtactacgtggccgctgtgtatgagcaccccagcatcctgagcctgaaccccctggccctgatcagccggcaggaggccctggagctgatgaaccagaacctggacatctatgagcagcaggtgatgacagctgcccagaaggatgtgcagatcatcgtgtttcctgaagatggcatccacggcttcaacttcaccaggaccagcatctaccccttcctggacttcatgcccagcccccaggtggtgcgctggaacccctgcctggagccccaccgcttcaatgacacagaggtgctgcagaggctgagctgcatggccatccggggggacatgttcctggtggccaacctgggcaccaaggagccctgccacagcagtgacccccgctgccccaaggatggccgctaccagttcaacaccaacgtggtgttcagcaacaacggcaccctggtggaccgctacaggaagcacaacctgtactttgaagctgcctttgatgtgcccctgaaggtggacctgatcacctttgacaccccatttgctggccgcttcggcatcttcacctgctttgacatcctcttctttgatcctgccatccgggtgctgcgggactacaaggtgaagcacgtggtgtaccccacagcctggatgaaccagctgcccctgctggccgccatcgagatccagaaggcctttgctgtggccttcggcatcaacgtgctggccgccaacgtgcaccaccctgtgctgggcatgactggaagtggcatccacacccccctggagagcttctggtaccatgacatggagaaccccaagagccacctgatcatcgcccaggtggccaagaaccctgtgggcctgattggagcagaaaatgccactggagaaacagaccccagccacagcaagttcctgaagatcctgagcggggacccctactgtgagaaggatgcccaggaggtgcactgtgatgaggccaccaagtggaatgtgaatgccccacccaccttccacagcgagatgatgtatgacaacttcaccctggtgcctgtgtggggcaaggagggctacctgcacgtgtgcagcaatggcctgtgctgctacctgctgtatgaaagacccaccctgagcaaggagctgtatgccctgggcgtgtttgatggcctgcacacagtgcacggcacctactacatccaggtgtgtgccctggtgcgctgtggcggcctgggctttgacacctgtggccaggagatcacagaggccaccggcatctttgagttccacctgtggggcaacttcagcaccagctacatcttccccctcttcctgaccagcggcatgaccctggaggtgcctgaccagctgggctgggagaatgaccactacttcctgaggaagagccggctgagcagcggcctggtgacagctgccctgtatggccgcctgtatgaaagagactag

SEQ ID NO: 145217 - DNA, 585 bp, Artificial Sequence
  Description of Artificial Sequence: Synthetic coding sequence
atgcccaggaacctgctgtacagcctgctgagcagccacctgagcccccacttcagcacctctgtgaccagcgccaaggtggccgtgaatggagtgcagctgcactaccagcagacaggagagggggaccatgctgtgctgctgctgcccggcatgctgggcagcggggagacagactttggcccccagctgaagaacctgaacaagaagctgttcaccgtggtggcctgggacccccggggctacggccacagccggcccccagaccgggacttccctgctgacttctttgaaagagatgccaaggatgctgtggacctgatgaaggccctgaagttcaagaaggtgtccctgctgggctggagcgatggcggcatcacagccctgattgctgctgccaagtaccccagctacatccacaagatggtgatctggggcgccaatgcctacgtgacagatgaggacagcatgatctatgagggcatcagagatgtgtccaagtggagcgagaggaccaggaagcccctggaggccctgtatggctggagcctgaccctgagccctggctggaatgccatggcctag

SEQ ID NO: 145218 - DNA, 825 bp, Artificial Sequence
  Description of Artificial Sequence: Synthetic coding sequence
atgcccaggaacctgctgtacagcctgctgagcagccacctgagcccccacttcagcacctctgtgaccagcgccaaggtggccgtgaatggagtgcagctgcactaccagcagacaggagagggggaccatgctgtgctgctgctgcccggcatgctgggcagcggggagacagactttggcccccagctgaagaacctgaacaagaagctgttcaccgtggtggcctgggacccccggggctacggccacagccggcccccagaccgggacttccctgctgacttctttgaaagagatgccaaggatgctgtggacctgatgaaggccctgaagttcaagaaggtgtccctgctgggctggagcgatggcggcatcacagccctgattgctgctgccaagtaccccagctacatccacaagatggtgatctggggcgccaatgcctacgtgacagatgaggacagcatgatctatgagggcatcagagatgtgtccaagtggagcgagaggaccaggaagcccctggaggccctgtatggctatgactactttgcccggacctgtgagaagtgggtggatggcatccggcagttcaagcacctgcctgatggcaacatctgccgccacctgctgccccgggtgcagtgcccagccctgattgtgcatggagagaaggaccccctggtgccccgcttccacgccgacttcatccacaagcacgtgaagggcagccggctgcacctgatgcctgagggcaagcacaacctgcacctgcgctttgctgatgagttcaacaagctggccgaggacttcctgcagtag

SEQ ID NO: 145219 - DNA, 876 bp, Artificial Sequence
  Description of Artificial Sequence: Synthetic coding sequence
atggtggccgtgctgggcggccggggcgtgctgcggctgcggctgctgctgagcgccctgaagccaggcatccacgtgcccagggctggccctgctgctgccttcggcacctctgtgaccagcgccaaggtggccgtgaatggagtgcagctgcactaccagcagacaggagagggggaccatgctgtgctgctgctgcccggcatgctgggcagcggggagacagactttggcccccagctgaagaacctgaacaagaagctgttcaccgtggtggcctgggacccccggggctacggccacagccggcccccagaccgggacttccctgctgacttctttgaaagagatgccaaggatgctgtggacctgatgaaggccctgaagttcaagaaggtgtccctgctgggctggagcgatggcggcatcacagccctgattgctgctgccaagtaccccagctacatccacaagatggtgatctggggcgccaatgcctacgtgacagatgaagattccatgatctatgagggcatcagagatgtgtccaagtggagcgagaggaccaggaagcccctggaggccctgtatggctatgactactttgcccggacctgtgagaagtgggtggatggcatccggcagttcaagcacctgcctgatggcaacatctgccgccacctgctgccccgggtgcagtgcccagccctgattgtgcacggggagaaggaccccctggtgccccgcttccacgccgacttcatccacaagcacgtgaagggcagccggctgcacctgatgcctgagggcaagcacaacctgcacctgcgctttgctgatgagttcaacaagctggccgaggacttcctgcagtag

SEQ ID NO: 145220 - DNA, 264 bp, Artificial Sequence
  Description of Artificial Sequence: Synthetic coding sequence
atgtactgcctgcagtggctgctgcctgtgctgctgatccccaagcccctgaacccagccctgtggttcagccacagcatgttcatgggcttctacctgctgtccttcctgctggagaggaagccctgcaccatctgtgccctggtgttcctggccgccctcttcctgatctgctacagctgctggggcaactgcttcctgtaccactgcagcgacagccccctgcctgagagcgcccatgaccccggggtggtgggcacctag

SEQ ID NO: 145221 - DNA, 264 bp, Artificial Sequence; identical to SEQ ID NO: 145220
  Description of Artificial Sequence: Synthetic coding sequence

SEQ ID NO: 145222 - DNA, 264 bp, Artificial Sequence; identical to SEQ ID NO: 145220
  Description of Artificial Sequence: Synthetic coding sequence

SEQ ID NO: 145223 - DNA, 264 bp, Artificial Sequence; identical to SEQ ID NO: 145220
  Description of Artificial Sequence: Synthetic coding sequence

SEQ ID NO: 145224 - DNA, 264 bp, Artificial Sequence; identical to SEQ ID NO: 145220
  Description of Artificial Sequence: Synthetic coding sequence

SEQ ID NO: 145225 - DNA, 189 bp, Artificial Sequence
  Description of Artificial Sequence: Synthetic coding sequence
atgtactgcctgcagtggctgctgcctgtgctgctgatccccaagcccctgaacccagccctgtggttcagccacagcatgttcatgggcttctacctgctgtccttcctgctggagaggaagccctgcaccatctgtgccctggtgttcctggccgccctcttcctgatctgctacagctgctggtag

SEQ ID NO: 145226 - DNA, 264 bp, Artificial Sequence; identical to SEQ ID NO: 145220
  Description of Artificial Sequence: Synthetic coding sequence

SEQ ID NO: 145227 - DNA, 264 bp, Artificial Sequence; identical to SEQ ID NO: 145220
  Description of Artificial Sequence: Synthetic coding sequence

SEQ ID NO: 145228 - DNA, 237 bp, Artificial Sequence
  Description of Artificial Sequence: Synthetic coding sequence
atgtactgcctgcagtggctgctgcctgtgctgctgatccccaagcccctgaacccagccctgtggttcagccacagcatgttcatgggcttctacctgctgtccttcctgctggagaggaagccctgcaccatctgtgccctggtgttcctggccgccctcttcctgatctgctacagctgctggggcaactgcttcctgtaccactgcagcgacagccccctgcctgagagctag

SEQ ID NO: 145229 - DNA, 24 bp, Artificial Sequence
  Description of Artificial Sequence: Synthetic coding sequence
atgtactgcctgcagtggctgtag

SEQ ID NO: 145230 - DNA, 1368 bp, Artificial Sequence
  Description of Artificial Sequence: Synthetic coding sequence
atgagcagcagcggcctgaacagcgagaaggtggccgccctgatccagaagctgaacagcgacccccagtttgtgctggcccagaatgtgggcaccacccatgacctgctggacatctgcctgaagagggccaccgtgcagagggcccagcacgtgttccagcacgctgtgccccaggagggcaagcccatcaccaaccagaagagcagcggccgctgctggatcttcagctgcctgaatgtgatgaggctgcccttcatgaagaagctgaacatcgaggagtttgagttcagccagagctacctgttcttctgggacaaggtggagcgctgctacttcttcctgagcgcctttgtggacacagcccagaggaaggagccagaagatggccgcctggtgcagttcctgctgatgaacccagccaatgatggcggccagtgggacatgctggtgaacatcgtggagaagtatggagtcatccccaagaagtgcttccctgagagctacaccacagaggccaccaggaggatgaatgacatcctgaaccacaagatgagggagttctgcatccggctgaggaacctggtgcacagcggggccaccaagggggagatcagcgccacccaggatgtgatgatggaggagatcttccgggtggtgtgcatctgcctgggcaaccccccagagaccttcacctgggagtacagagacaaggacaagaactaccagaagattggccccatcacccccctggagttctaccgggagcacgtgaagcccctcttcaacatggaggacaagatctgcctggtgaatgacccccggccccagcacaagtacaacaagctgtacacagtggagtacctgagcaacatggtgggcggcaggaagaccctgtacaacaaccagcccatcgacttcctgaagaagatggtggccgccagcatcaaggatggagaggccgtgtggtttggctgtgatgtgggcaagcacttcaacagcaagctgggcctgagtgacatgaacctgtatgaccacgagctggtgtttggagtgtccctgaagaacatgaacaaggccgagcggctgacctttggagagagcctgatgacccacgccatgaccttcaccgctgtgtctgagaaggatgaccaggatggagccttcaccaagtggagggtggagaacagctggggcgaggaccacggccacaagggctacctgtgcatgacagatgagtggttctctgaatatgtgtatgaggtggtggtggacaggaagcacgtgcctgaggaggtgctggccgtgctggagcaggagcccatcatcctgcctgcctgggaccccatgggcgccctggccgagtag

SEQ ID NO: 145231 - DNA, 1107 bp, Artificial Sequence
  Description of Artificial Sequence: Synthetic coding sequence
atgtgcagcagcaccccctgcccccggcgggccagccagagccccacccggcgggcccaggtggagcgctgctacttcttcctgagcgcctttgtggacacagcccagaggaaggagccagaagatggccgcctggtgcagttcctgctgatgaacccagccaatgatggcggccagtgggacatgctggtgaacatcgtggagaagtatggagtcatccccaagaagtgcttccctgagagctacaccacagaggccaccaggaggatgaatgacatcctgaaccacaagatgagggagttctgcatccggctgaggaacctggtgcacagcggggccaccaagggggagatcagcgccacccaggatgtgatgatggaggagatcttccgggtggtgtgcatctgcctgggcaaccccccagagaccttcacctgggagtacagagacaaggacaagaactaccagaagattggccccatcacccccctggagttctaccgggagcacgtgaagcccctcttcaacatggaggacaagatctgcctggtgaatgacccccggccccagcacaagtacaacaagctgtacacagtggagtacctgagcaacatggtgggcggcaggaagaccctgtacaacaaccagcccatcgacttcctgaagaagatggtggccgccagcatcaaggatggagaggccgtgtggtttggctgtgatgtgggcaagcacttcaacagcaagctgggcctgagtgacatgaacctgtatgaccacgagctggtgtttggagtgtccctgaagaacatgaacaaggccgagcggctgaccttcggggagagcctgatgacccacgccatgaccttcaccgctgtgtctgagaaggatgaccaggatggagccttcaccaagtggagggtggagaacagctggggagaagatcatggccacaagggctacctgtgcatgacagatgagtggttctctgaatatgtgtatgaggtggtggtggacaggaagcacgtgcctgaggaggtgctggccgtgctggagcaggagcccatcatcctgcctgcctgggaccccatgggcgccctggccgagtag

SEQ ID NO: 145232 - DNA, 2241 bp, Artificial Sequence
  Description of Artificial Sequence: Synthetic coding sequence
atggccggcagcagaggagctggccgcacagctgcccccagcgtgcggcctgagaagagaagaagtgagcctgagctggagcctgagcctgagcctgagccccccctgctgtgcaccagccccctgagccacagcacaggcagtgacagcggcgtgtctgattctgaggagagcgtcttcagcggcctggaggacagcggcagtgacagcagtgaagatgatgatgaaggagatgaggagggggaggatggagccctggatgatgagggccacagcggcatcaagaagaccacagaggagcaggtgcaggccagcaccccctgccccaggacagagatggccagcgccagaattggagatgaatatgcagaggacagcagtgatgaggaggacatccggaacacagtgggcaatgtgcccctggagtggtatgatgacttcccccacgtgggctatgacctggatggaagacgcatctacaagcccctgcggaccagagatgagctggaccagttcctggacaagatggatgatcctgactactggaggacagtgcaggaccccatgacaggccgggacctgcggctgacagatgagcaggtggccctggtgcggcggctgcagagcggccagtttggagatgtgggcttcaacccctatgagcctgctgtggacttcttctctggagatgtgatgatccaccctgtgaccaacagacctgctgacaagaggagcttcatccccagcctggtggagaaggagaaggtgtccaggatggtgcacgccatcaagatgggctggatccagccccggcggccccgggaccccacccccagcttctatgacctgtgggcccaggaggaccccaatgctgtgctgggccgccacaagatgcacgtgcctgcccccaagctggccctgcccggccatgctgagagctacaaccccccacctgagtacctgctgtctgaggaggagcggctggcctgggagcagcaggagcctggagagaggaagctgtccttcctgcccaggaagttccccagcctgcgggctgtgcctgcctacggccgcttcatccaggagagatttgagcgctgcctggacctgtacctgtgcccccggcagaggaagatgagggtgaatgtggaccctgaggacctgatccccaagctgccccggccccgggacctgcagcccttccccacctgccaggccctggtgtaccggggccacagcgacctggtgcgctgcctgtctgtgtccccaggcggccagtggctggtgtctggcagtgatgatggcagcctgcggctgtgggaggtggccacagcccgctgtgtgaggacagtgcctgtgggcggcgtggtgaagtctgtggcctggaaccccagccctgctgtgtgcctggtggccgctgctgtggaggacagcgtgctgctgctgaacccagccctgggggaccggctggtggccggcagcacagaccagctgctgagcgcctttgtgcccccagaggagccccccctgcagcctgcccgctggctggaggccagcgaggaggagcggcaggtgggcctgcggctgcgcatctgccacggcaagcctgtgacccaggtgacctggcacggccgcggggactacctggccgtggtgctggccacccagggccacacccaggtgctgatccaccagctgagcagaagaagaagccagagccccttccgccgcagccacggccaggtgcagagggtggccttccacccagcccggcccttcctgctggtggccagccagaggtctgtgcggctgtaccacctgctgcggcaggagctgaccaagaagctgatgcccaactgcaagtgggtgagcagcctggccgtgcaccctgctggggacaacgtcatctgtggcagctatgacagcaagctggtgtggtttgacctggacctgagcaccaagccctacaggatgctgcggcaccacaagaaggccctgcgggctgtggccttccacccccgctaccccctgtttgccagcggcagtgatgatggcagcgtcatcgtgtgccacggcatggtgtacaatgacctgctgcagaaccccctgctggtgcctgtgaaggtgctgaagggccacgtgctgacccgggacctgggcgtgctggatgtgatcttccaccccacccagccctgggtgttcagcagcggggctgatggcaccgtgcggctcttcacctag

SEQ ID NO: 145233 - DNA, 1083 bp, Artificial Sequence
  Description of Artificial Sequence: Synthetic coding sequence
atgaactacacagagagcagccccctgcgggagagcacagccatcggcttcaccccagagctggagagcatcatccctgtgcccagcaacaagaccacctgtgagaactggagggagatccaccacctggtgttccacgtggccaacatctgctttgctgtgggcctggtgatccccaccaccctgcacctgcacatgatcttcctgcggggcatgctgaccctgggctgcaccctgtacatcgtgtgggccaccctgtaccgctgtgccctggacatcatgatctggaacagcgtcttcctgggcgtgaacatcctgcacctgagctacctgctgtacaagaagaggcctgtgaagattgagaaggagctgagcggcatgtacagaagactctttgagcccctgcgggtgcccccagacctcttccggcggctgaccggccagttctgcatgatccagaccctgaagaagggccagacctacgccgctgaggacaagacctctgtggatgaccggctgagcatcctgctgaagggcaagatgaaggtgtcctaccggggccacttcctgcacaacatctacccctgtgccttcatcgacagccctgagttccgcagcacccagatgcacaagggggagaagttccaggtgaccatcatcgcagatgacaactgccgcttcctgtgctggagccgggagcggctgacctacttcctggagagcgagcccttcctgtatgagatcttccgctacctgattggcaaggacatcaccaacaagctgtacagcctgaatgaccccaccctgaatgacaagaaggccaagaagctggagcaccagctgagcctgtgcacccagatctccatgctggagatgagaaattccatcgccagcagcagtgacagtgatgatggcctgcaccagttcctgcggggcaccagctccatgagcagcctgcacgtgagcagcccccaccagagggccagcgccaagatgaagcccatcgaggagggcgcagaagatgatgatgatgtgtttgagcccgccagccccaacaccctgaaggtgcaccagctgccctag

SEQ ID NO: 145234 - DNA, 1083 bp, Artificial Sequence; identical to SEQ ID NO: 145233
  Description of Artificial Sequence: Synthetic coding sequence

SEQ ID NO: 145235 - DNA, 1083 bp, Artificial Sequence; identical to SEQ ID NO: 145233
  Description of Artificial Sequence: Synthetic coding sequence

SEQ ID NO: 145236 - DNA, 783 bp, Artificial Sequence
  Description of Artificial Sequence: Synthetic coding sequence
atggacagacacagcagctacatcttcatctggctgcagctggagctgtgtgccatggctgtgctgctgaccaagggggagatccgctgctactgtgatgctgcccactgtgtggccaccggctacatgtgcaagtctgagctgagcgcctgcttcagccggctgctggacccccagaacagcaacagccccctgacccacggctgcctggacagcctggccagcaccacagacatctgccaggccaagcaggccaggaaccacagcggcaccaccatccccaccctggagtgctgccacgaggacatgtgcaactaccggggcctgcatgatgtgctgagccccccaagaggagaggccagcggccagggcaaccgctaccagcatgatggcagcaggaacctgatcaccaaggtgcaggagctgaccagcagcaaggagctgtggttccgggctgctgtgattgctgtgcccatcgccggcggcctcatcctggtgctgctgatcatgctggccctgaggatgctgcggtctgagaacaagaggctgcaggaccagaggcagcagatgctgagccggctgcactacagcttccacggccaccacagcaagaagggccaggtggccaagctggacctggagtgcatggtgcctgtgtctggccacgagaactgctgcctgacctgtgacaagatgaggcaggccgacctgagcaatgacaagatcctgagcctggtgcactggggcatgtacagcggccacggcaagctggagtttgtgtag

SEQ ID NO: 145237 - DNA, 744 bp, Artificial Sequence
  Description of Artificial Sequence: Synthetic coding sequence
atggacagacacagcagctacatcttcatctggctgcagctggagctgtgtgccatggctgtgctgctgaccaagggggagatccgctgctactgtgatgctgcccactgtgtggccaccggctacatgtgcaagtctgagctgagcgcctgcttcagccggctgctggacccccagaacagcaacagcccccacatctgccaggccaagcaggccaggaaccacagcggcaccaccatccccaccctggagtgctgccacgaggacatgtgcaactaccggggcctgcatgatgtgctgagccccccaagaggagaggccagcggccagggcaaccgctaccagcatgatggcagcaggaacctgatcaccaaggtgcaggagctgaccagcagcaaggagctgtggttccgggctgctgtgattgctgtgcccatcgccggcggcctcatcctggtgctgctgatcatgctggccctgaggatgctgcggtctgagaacaagaggctgcaggaccagaggcagcagatgctgagccggctgcactacagcttccacggccaccacagcaagaagggccaggtggccaagctggacctggagtgcatggtgcctgtgtctggccacgagaactgctgcctgacctgtgacaagatgaggcaggccgacctgagcaatgacaagatcctgagcctggtgcactggggcatgtacagcggccacggcaagctggagtttgtgtag

SEQ ID NO: 145238 - DNA, 2058 bp, Artificial Sequence
  Description of Artificial Sequence: Synthetic coding sequence
atgctgtggttctctggagtgggcgccctggccgagcgctactgccgccgcagccctggcatcacctgctgcgtgctgctgctgctgaactgcagcggcgtgcccatgagcctggccagcagcttcctgaccggctctgtggccaagtgtgaaaatgaaggagaggtgctgcagatccccttcatcacagacaacccctgcatcatgtgtgtgtgcctgaacaaggaggtgacctgcaagcgggagaagtgccctgtgctgagccgggactgtgccctggccatcaagcagagaggagcctgctgtgagcagtgcaagggctgcacctatgagggcaacacctacaacagcagcttcaagtggcagagccctgctgagccctgtgtgctgcggcagtgccaggagggcgtggtgacagaaagtggagtgcgctgtgtggtgcactgcaagaaccccctggagcacctgggcatgtgctgccccacctgccccggctgtgtgtttgagggcgtgcagtaccaggagggggaggagttccagcctgagggcagcaagtgcaccaagtgcagctgcaccggcggccgcacccagtgtgtgcgggaggtgtgccccatcctgagctgcccccagcacctgagccacatccccccaggccagtgctgccccaagtgcctgggccagaggaaggtgtttgacctgcccttcggcagctgcctcttcagaagtgatgtgtatgacaatggcagcagcttcctgtatgacaactgcacagcctgcacctgccgggacagcacagtggtgtgcaagaggaagtgcagccaccctgggggctgtgaccagggccaggagggctgctgtgaggagtgcctgctgcgggtgcccccagaggacatcaaggtgtgcaagtttggaaacaagatcttccaggatggagagatgtggagcagcatcaactgcaccatctgtgcctgtgtgaagggccgcacagagtgcaggaacaagcagtgcatccccatcagcagctgcccccagggcaagatcctgaacaggaagggctgctgccccatctgcacagagaagccaggagtgtgcaccgtgtttggagacccccactacaacacctttgatggccgcaccttcaacttccagggcacctgccagtatgtgctgaccaaggactgcagcagccctgccagccccttccaggtgctggtgaagaatgatgcccggaggaccaggagcttctcctggaccaagtctgtggagctggtgctgggggagagccgggtgtccctgcagcagcacctgactgtgcgctggaatggcagcagaattgccctgccctgccgggccccccacttccacatcgacctggatggctacctgctgaaggtgaccaccaaggccggcctggagatctcctgggatggagacagctttgtggaggtgatggccgccccccacctgaagggcaagctgtgtggcctgtgtggcaactacaacggccacaagagagatgacctgattggaggagatggcaacttcaagtttgatgtggatgactttgctgagagctggagggtggagagcaatgagttctgcaaccggccccagaggaagcctgtgcctgagctgtgccagggcaccgtgaaggtgaagctgcgggcccaccgggagtgccagaagctgaagtcctgggagttccagacctgccacagcacagtggactatgccaccttctaccgcagctgtgtgacagacatgtgtgagtgccctgtgcacaagaactgctactgtgagagcttcctggcctacacccgggcctgccagcgggagggcatcaaggtgcactgggagccccagcagaactgtgccgccacccagtgcaagcatggagctgtgtatgacacctgtggccctggctgcatcaagacctgtgacaactggaatgagatcggcccctgcaacaagccctgtgtggccggctgccactgcccagccaacctggtgctgcacaagggccgctgcatcaagcctgtgctgtgcccccagaggtag

SEQ ID NO: 145239 - DNA, 2058 bp, Artificial Sequence; identical to SEQ ID NO: 145238
  Description of Artificial Sequence: Synthetic coding sequence

SEQ ID NO: 145240 - DNA, 2028 bp, Artificial Sequence
  Description of Artificial Sequence: Synthetic coding sequence
atggacaccaagagcatcctggaggagctgctgctgaagaggagccagcagaagaagaagatgagccccaacaactacaaggagcggctgtttgtgctgaccaagaccaacctgagctactatgaatatgacaagatgaagaggggcagcaggaagggcagcattgagatcaagaagatccgctgtgtggagaaggtgaacctggaggagcagacccctgtggagcggcagtaccccttccagatcgtgtacaaggatggcctgctgtatgtgtatgccagcaatgaggagagccgcagccagtggctgaaggccctgcagaaggagatccggggcaacccccacctgctggtgaagtaccacagcggcttctttgtggatggcaagttcctgtgctgccagcagagctgcaaggccgcccctggctgcaccctgtgggaggcctatgccaacctgcacacagctgtgaatgaggagaagcaccgggtgcccaccttcccagacagagtgctgaagatccccagggctgtgcctgtgctgaagatggatgcccccagcagcagcaccaccctggcccagtatgacaatgaaagcaagaagaactacggcagccagccccccagcagcagcaccagcctggcccagtatgacagcaacagcaagaagatctacggcagccagcccaacttcaacatgcagtacatcccccgggaggacttcccagactggtggcaggtgaggaagctgaagagcagcagcagcagtgaagatgtggccagcagcaaccagaaggagagaaatgtgaaccacaccaccagcaagatctcctgggagttccctgagagcagcagcagcgaggaggaggagaacctggatgattatgactggtttgctggcaacatcagccgcagccagagcgagcagctgctgcggcagaagggcaaggagggcgccttcatggtgaggaacagcagccaggtgggcatgtacacagtgtccctcttcagcaaggctgtgaatgacaagaagggcaccgtgaagcactaccacgtgcacaccaatgctgagaacaagctgtacctggccgagaactactgctttgacagcatccccaagctgatccactaccaccagcacaacagcgctggcatgatcacccggctgcggcaccctgtgtccaccaaggccaacaaggtgcctgacagcgtgtccctgggcaatggcatctgggagctgaagcgggaggagatcaccctgctgaaggagctgggcagcggccagtttggagtggtgcagctgggcaagtggaagggccagtatgatgtggccgtgaagatgatcaaggagggctccatgtctgaagatgagttcttccaggaggcccagaccatgatgaagctgagccaccccaagctggtgaagttctacggcgtgtgcagcaaggagtaccccatctacatcgtgacagagtacatcagcaatggctgcctgctgaactacctgcggagccacggcaagggcctggagcccagccagctgctggagatgtgctatgatgtgtgtgagggcatggccttcctggagagccaccagttcatccaccgggacctggccgccaggaactgcctggtggaccgggacctgtgtgtgaaggtgtctgactttggcatgacccgctacgtgctggatgaccagtatgtgtcctctgtgggcaccaagtttcctgtgaagtggagcgcccctgaggtgttccactacttcaagtacagcagcaagagtgatgtgtgggccttcggcatcctgatgtgggaggtgttcagcctgggcaagcagccctatgacctgtatgacaacagccaggtggtgctgaaggtgtcccagggccaccggctgtaccggccccacctggccagtgacaccatctaccagatcatgtacagctgctggcatgagctgcctgagaagaggcccaccttccagcagctgctgagcagcattgagcccctgcgggagaaggacaagcactag

SEQ ID NO: 145241 - DNA, 2028 bp, Artificial Sequence; identical to SEQ ID NO: 145240
  Description of Artificial Sequence: Synthetic coding sequence

SEQ ID NO: 145242 - DNA, 2028 bp, Artificial Sequence; identical to SEQ ID NO: 145240
  Description of Artificial Sequence: Synthetic coding sequence

SEQ ID NO: 145243 - DNA, 525 bp, Artificial Sequence
  Description of Artificial Sequence: Synthetic coding sequence
atgacagagctggagtaccccaagggcagcagcatcatgcctgctgctggcaccatgtacctgaccaccagcacaggctacccctacacctaccacaatggagtggcctacttccacaccccagaggtgacctctgtgcccccaccctggcccagccgctctgtgtgcagcagccctgtgatggtggcccagcccatctaccagcagcctgcctaccactaccaggccaccacccagtacctgcccggccagtggcagtggagcgtgccccagcccagcgccagcagcgcccccttcctgtacctgcagcccagcgaggtgatctaccagcctgtggagatcgcccaggacggcggctgtgtgcccccacccctgagcctgatggagacctctgtgcctgagccctacagcgaccatggagtgcaggccacctaccaccaggtgtatgcccccagcgccatcaccatgcctgcccctgtgatgcagcctgagcccatcaagacagtgtggagcatccactactag

SEQ ID NO: 145244 - DNA, 888 bp, Artificial Sequence
  Description of Artificial Sequence: Synthetic coding sequence
atggagacagaaagtggcccccagaccagcaaccagatgcagacagacagcctgagccccagccccaaccctgtgtcccctgtgcccctgaacaaccccaccagcgcccccaggtatggaacagtcatccccaaccgcatctttgtgggcggcatcgacttcaagaccaatgaaagtgacctgaggaagttcttcagccagtatggctctgtgaaggaggtgaagatcgtgaatgacagagctggggtgtccaagggctacggctttgtgacctttgagacccaggaggatgcccagaagatcctgcaggaggccgagaagctgaactacaaggacaagaagctgaacatcggccctgccatcaggaagcagcaggtgggcatccccaggagcagcatcatgcctgctgctggcaccatgtacctgaccaccagcacaggctacccctacacctaccacaacggggtggcctacttccacaccccagaggtgacctctgtgcccccaccctggcccagccgctctgtgtgcagcagccctgtgatggtggcccagcccatctaccagcagcctgcctaccactaccaggccaccacccagtacctgcccggccagtggcagtggagcgtgccccagcccagcgccagcagcgcccccttcctgtacctgcagcccagcgaggtgatctaccagcctgtggagatcgcccaggacggcggctgtgtgcccccacccctgagcctgatggagacctctgtgcctgagccctacagcgaccacggcgtgcaggccacctaccaccaggtgtatgcccccagcgccatcaccatgcctgcccctgtgatgcagcctgagcccatcaagacagtgtggagcatccactactag

SEQ ID NO: 145245 - DNA, 852 bp, Artificial Sequence
  Description of Artificial Sequence: Synthetic coding sequence
atgcagacagacagcctgagccccagccccaaccctgtgtcccctgtgcccctgaacaaccccaccagcgcccccaggtatggaacagtcatccccaaccgcatctttgtgggcggcatcgacttcaagaccaatgaaagtgacctgaggaagttcttcagccagtatggctctgtgaaggaggtgaagatcgtgaatgacagagctggggtgtccaagggctacggctttgtgacctttgagacccaggaggatgcccagaagatcctgcaggaggccgagaagctgaactacaaggacaagaagctgaacatcggccctgccatcaggaagcagcaggtgggcatccccaggagcagcatcatgcctgctgctggcaccatgtacctgaccaccagcacaggctacccctacacctaccacaacggggtggcctacttccacaccccagaggtgacctctgtgcccccaccctggcccagccgctctgtgtgcagcagccctgtgatggtggcccagcccatctaccagcagcctgcctaccactaccaggccaccacccagtacctgcccggccagtggcagtggagcgtgccccagcccagcgccagcagcgcccccttcctgtacctgcagcccagcgaggtgatctaccagcctgtggagatcgcccaggacggcggctgtgtgcccccacccctgagcctgatggagacctctgtgcctgagccctacagcgaccacggcgtgcaggccacctaccaccaggtgtatgcccccagcgccatcaccatgcctgcccctgtgatgcagcctgagcccatcaagacagtgtggagcatccactactag

SEQ ID NO: 145246 - DNA, 852 bp, Artificial Sequence; identical to SEQ ID NO: 145245
  Description of Artificial Sequence: Synthetic coding sequence

SEQ ID NO: 145247 - DNA, 414 bp, Artificial Sequence
  Description of Artificial Sequence: Synthetic coding sequence
atgctgagcggccgcctggtgctgggcctggtgtccatggccggccgggtgtgcctgtgccagggcagcgctggcagcggggccatcggccctgtggaggccgccatccgcaccaagctggaggaggccctgagccctgaggtgctggagctgagaaatgaaagtggcggccatgctgtgcccccaggcagcgagacccacttccgggtggccgtggtgagcagcagatttgagggcctgagccccctgcagaggcaccggctggtgcatgctgccctggccgaggagctgggcggccctgtgcacgccctggccatccaggcccggaccccagcccagtggagggagaacagccagctggacaccagccccccctgcctgggcggcaacaagaagaccctgggcaccccctag

SEQ ID NO: 145248 - DNA, 414 bp, Artificial Sequence; identical to SEQ ID NO: 145247
  Description of Artificial Sequence: Synthetic coding sequence

SEQ ID NO: 145249 - DNA, 414 bp, Artificial Sequence; identical to SEQ ID NO: 145247
  Description of Artificial Sequence: Synthetic coding sequence

SEQ ID NO: 145250 - DNA, 459 bp, Artificial Sequence
  Description of Artificial Sequence: Synthetic coding sequence
atggccagcgccaagagcctggaccgctggaaggcccggctgctggagggcggcagcacagccctgacctacgccctggtgcgggcagaggtgtccttccctgctgaggtggcccctgtgcggcagcagggctctgtggccggggcccgggccggcgtggtgtccctgctgggctgccgcagctcctggacagctgccatggagctgtctgctgagtacctgcgggagaagctgcagagggacctggaggccgagcacgtggaggtggaggacaccaccctgaaccgctgcagctgcagcttccgggtgctggtggtgtctgccaagtttgagggcaagcccctgctgcagaggcaccggctggtgaatgcctgcctggccgaggagctgccccacatccacgcctttgagcagaagaccctgaccccagaccagtgggcccgggagcggcagaagtag

SEQ ID NO: 145251 - DNA, 306 bp, Artificial Sequence
  Description of Artificial Sequence: Synthetic coding sequence
atggccgcctggagccctgctgctgctgcccccctgctgcggggcatccggggcctgcccctgcaccacaggatgtttgccacccagacagaaggagagctgcgggtgacccagatcctgaaggagaagttcccccgggccacagccatcaaggtgacagacatcagcggcaccaagagaagaaaccagagagatgcctggattgctgacatctacctgtgcccccagaccctgaccaccccctggctgcaccgctgctgctgcctgcggccctggatgaacttcacagacatcatcctgccctag

SEQ ID NO: 145252 - DNA, 324 bp, Artificial Sequence
  Description of Artificial Sequence: Synthetic coding sequence
atggccgcctggagccctgctgctgctgcccccctgctgcggggcatccggggcctgcccctgcaccacaggatgtttgccacccagacagaaggagagctgcgggtgacccagatcctgaaggagaagttcccccgggccacagccatcaaggtgacagacatcagcggcggctgtggggccatgtatgagatcaagattgaaagtgaggagttcaaggagaagaggacagtgcagcagcaccagatggtgaaccaggccctgaaggaggagatcaaggagatgcacggcctgcgcatcttcacctctgtgcccaagaggtag

SEQ ID NO: 145253 - DNA, 1200 bp, Artificial Sequence
  Description of Artificial Sequence: Synthetic coding sequence
atggcccagaggcagccccacagccccaaccagaccctcatcagcatcaccaatgacacagagagcagcagctctgtggtgtccaatgacaacaccaacaagggctggagcggggacaacagccctggcatcgaggccctgtgtgccatctacatcacctatgctgtgatcatctctgtgggcatcctgggcaatgccatcctgatcaaggtgttcttcaagaccaagtccatgcagacagtgcccaacatcttcatcaccagcctggcctttggagacctgctgctgctgctgacctgtgtgcctgtggatgccacccactacctggccgagggctggctgtttggccgcatcggctgcaaggtgctgtccttcatccggctgacctctgtgggcgtgtctgtgttcaccctgaccatcctgtctgctgaccgctacaaggctgtggtgaagcccctggagcggcagcccagcaatgccatcctgaagacctgtgtgaaggccggctgtgtgtggatcgtgtccatgatctttgccctgcctgaggccatcttcagcaatgtgtacaccttccgggaccccaacaagaacatgacctttgagagctgcaccagctaccctgtgtccaagaagctgctgcaggagatccacagcctgctgtgcttcctggtgttctacatcatccccctgagcatcatctctgtgtactacagcctcatcgcccggaccctgtacaagagcaccctgaacatccccacagaggagcagagccacgccaggaagcagatcgagagcaggaagagaattgccaggacagtgctggtgctggtggccctgtttgccctgtgctggctgcccaaccacctgctgtacctgtaccacagcttcaccagccagacctacgtggaccccagcgccatgcacttcatcttcaccatcttcagccgggtgctggccttcagcaacagctgtgtgaacccctttgccctgtactggctgagcaagagcttccagaagcacttcaaggcccagctgttctgctgcaaggccgagaggcctgagccccctgtggccgacaccagcctgaccaccctggccgtgatgggcaccgtgcccggcaccggcagcatccagatgtctgagatctctgtgaccagcttcaccggctgcagcgtgaagcaggccgaggaccgcttctag

SEQ ID NO: 145254 - DNA, 303 bp, Artificial Sequence
  Description of Artificial Sequence: Synthetic coding sequence
atgagggccctgaccctgctggccctgctggccctggccgccctgtgcatcgccggccaggccggggccaagcccagcggggctgagagcagcaagggggccgcctttgtgtccaagcaggagggcagcgaggtggtgaagaggccccggcgctacctgtaccagtggctgggcgcccctgtgccctacccagaccccctggagccccggcgggaggtgtgtgagctgaacccagactgtgatgagctggccgaccacatcggcttccaggaggcctaccgccgcttctacggccctgtgtag

SEQ ID NO: 145255 - DNA, 957 bp, Artificial Sequence
  Description of Artificial Sequence: Synthetic coding sequence
atggccgcccagggctgtgccgccagccggctgctgcagctgctgctgcagctgctgctgctgctgctgctgctggccgccggcggggcccgggcccgctggagaggagagggcaccagcgcccacctgcgggacatcttcctgggccgctgtgccgagtaccgggccctgctgagccctgagcagaggaacaagaactgcacagccatctgggaggccttcaaggtggccctggacaaggacccctgcagcgtgctgcccagcgactatgacctcttcatcaacctgagccgccacagcatcccccgggacaagagcctcttctgggagaacagccacctgctggtgaacagctttgctgacaacacccggcgcttcatgcccctgagtgatgtgctgtatggccgggtggccgacttcctgtcctggtgccggcagaagaatgacagcggcctggactaccagagctgccccaccagcgaggactgtgagaacaaccctgtggacagcttctggaagagggccagcatccagtacagcaaggacagcagcggggtcatccacgtgatgctgaatggcagcgagcccactggagcctaccccatcaagggcttctttgctgactatgagatccccaacctgcagaaggagaagatcacccgcatcgagatctgggtgatgcatgagatcggcggccccaacgtggagagctgtggggagggctccatgaaggtgctggagaagaggctgaaggacatgggcttccagtacagctgcatcaatgactacagacctgtgaagctgctgcagtgtgtggaccacagcacccacccagactgtgccctgaagtctgctgctgctgccacccagaggaaggcccccagcctgtacacagagcagagagctggcctcatcatccccctcttcctggtgctggccagcaggacccagctgtag

SEQ ID NO: 145256 - DNA, 543 bp, Artificial Sequence
  Description of Artificial Sequence: Synthetic coding sequence
atggccagcaccagctatgactactgccgggtgcccatggaggatggagacaagcgctgcaagctgctgctgggcatcggcatcctggtgctgctgatcatcgtcatcctgggcgtgcccctcatcatcttcaccatcaaggccaacagcgaggcctgcagagatggcctgcgggctgtgatggagtgcagaaatgtgacccacctgctgcagcaggagctgacagaggcccagaagggcttccaggatgtggaggcccaggccgccacctgcaaccacacagtgatggccctgatggccagcctggatgctgagaaggcccagggccagaagaaggtggaggagctggagggggagatcaccaccctgaaccacaagctgcaggatgccagcgctgaggtggagcggctgcggcgggagaaccaggtgctgtctgtgagaattgctgacaagaagtactaccccagcagccaggacagcagcagcgctgctgccccccagctgctgattgtgctgctgggcctgagcgccctgctgcagtag

SEQ ID NO: 145257 - DNA, 651 bp, Artificial Sequence
  Description of Artificial Sequence: Synthetic coding sequence
atggccagcaccagctatgactactgccgggtgcccatggaggatggagacaagcgctgcaagctgctgctgggcatcggcatcctggtgctgctgatcatcgtcatcctgggcgtgcccctcatcatcttcaccatcaaggccaacagcgaggcctgcagagatggcctgcgggctgtgatggagtgcagaaatgtgacccacctgctgcagcaggagctgacagaggcccagaagggcttccaggatgtggaggcccaggccgccacctgcaaccacacagtgatggccctgatggccagcctggatgctgagaaggcccagggccagaagaaggtggaggagctggagggggagatcaccaccctgaaccacaagctgcaggatgccagcgctgaggtggagcggctgcggcgggagaaccaggtgctgtctgtgagaattgctgacaagaagtactaccccagcagccacttccccagcaccccccagagccggctgcagacccagctgaccaccctgaagattgagatggatgaggccaaggcccagggcacccagatgggcgcagaaaatggagccctgaccggggccctgggctgcaagggcgtgggccgggacagaagtggccgcagcctgggggagagctag

SEQ ID NO: 145258 - DNA, 1179 bp, Artificial Sequence
  Description of Artificial Sequence: Synthetic coding sequence
atggtgctgctgagcatcctgcgcatcctcttcctgtgtgagctggtgctcttcatggagcaccgggcccagatggccgagggcggccagagcagcatcgccctgctggccgaggcccccaccctgcccctgattgaggagctgctggaggagagccctggagagcagcccaggaagccccggctgctgggccacagcctgcgctacatgctggagctgtacagaagatctgctgacagccacggccacccccgggagaacagaaccatcggggccaccatggtgcggctggtgaagcccctgaccaacgtggcccggccccaccggggcacctggcacatccagatcctgggcttccccctgcggcccaacagaggcctgtaccagctggtgcgggccaccgtggtgtaccgccaccacctgcagctgacccgcttcaacctgagctgccacgtggagccctgggtgcagaagaaccccaccaaccacttccccagcagcgagggggacagcagcaagcccagcctgatgagcaatgcctggaaggagatggacatcacccagctggtgcagcagcgcttctggaacaacaagggccaccgcatcctgcggctgcgcttcatgtgccagcagcagaaggacagcggcggcctggagctgtggcacggcaccagcagcctggacatcgccttcctgctgctgtacttcaatgacacccacaagagcatcaggaaggccaagttcctgccccggggcatggaggagttcatggagcgggagagcctgctgcggaggacccggcaggctgatggcatctctgctgaggtgacagccagcagcagcaagcacagcggccctgagaacaaccagtgcagcctgcaccccttccagatctccttccggcagctgggctgggaccactggatcatcgccccacccttctacacccccaactactgcaagggcacctgcctgcgggtgctgagagatggcctgaacagccccaaccacgccatcatccagaacctgatcaaccagctggtggaccagagcgtgccccggcccagctgtgtgccctacaagtatgtgcccatctctgtgctgatgattgaggccaacggcagcatcctgtacaaggagtatgagggcatgattgctgagagctgcacctgcaggtag

SEQ ID NO: 145259 - DNA, 1419 bp, Artificial Sequence
  Description of Artificial Sequence: Synthetic coding sequence
atggccggggccagccggctgctcttcctgtggctgggctgcttctgtgtgtccctggcccagggcgagcggcccaagccacccttccctgagctgaggaaggctgtgcctggggacagaacagctgggggcggccctgacagcgagctgcagccccaggacaaggtgtctgagcacatgctgcggctgtatgaccgctacagcacagtgcaggccgcccggaccccaggcagcctggagggcggcagccagccctggaggccccggctgctgcgggagggcaacacagtgcgctccttccgggctgctgctgctgagaccctggagaggaagggcctgtacatcttcaacctgaccagcctgaccaagtctgagaacatcctgagcgccaccctgtacttctgcatcggggagctgggcaacatcagcctgagctgccctgtgtctgggggctgcagccaccacgcccagaggaagcacatccagattgacctgagcgcctggaccctgaagttcagcaggaaccagagccagctgctgggccacctgtctgtggacatggccaagagccaccgggacatcatgtcctggctgagcaaggacatcacccagctgctgaggaaggccaaggaaaatgaggagttcctgattggcttcaacatcaccagcaagggccggcagctgcccaagaggcggctgcccttccctgagccctacatcctggtgtatgccaatgatgctgccatcagcgagcctgagagcgtggtgagcagcctgcagggccacaggaacttccccactggaacagtgcccaagtgggacagccacatccgggccgccctgagcattgaaagaaggaagaagaggagcactggagtgctgctgcccctgcagaacaatgagctgcctggagctgagtaccagtacaagaaggatgaggtgtgggaggagaggaagccctacaagaccctgcaggcccaggcccctgagaagagcaagaacaagaagaagcagaggaagggcccccacaggaagagccagaccctgcagtttgatgagcagaccctgaagaaggcccggaggaagcagtggattgagcccaggaactgtgcccggcgctacctgaaggtggactttgctgacatcggctggagcgagtggatcatcagccccaagagctttgatgcctactactgcagcggggcctgccagttccccatgcccaagagcctgaagcccagcaaccacgccaccatccagagcatcgtgcgggctgtgggcgtggtgcccggcatccctgagccctgctgcgtgcctgagaagatgagcagcctgagcatcctcttctttgatgagaacaagaatgtggtgctgaaggtgtaccccaacatgacagtggagagctgtgcctgcaggtag

SEQ ID NO: 145260 - DNA, 213 bp, Artificial Sequence
  Description of Artificial Sequence: Synthetic coding sequence
tgcttcttctactacctgaagagcctgaagcccagcaaccacgccaccatccagagcatcgtgcgggctgtgggcgtggtgcccggcatccctgagccctgctgcgtgcctgagaagatgagcagcctgagcatcctcttctttgatgagaacaagaatgtggtgctgaaggtgtaccccaacatgacagtggagagctgtgcctgcaggtag

SEQ ID NO: 145261 - DNA, 1227 bp, Artificial Sequence
  Description of Artificial Sequence: Synthetic coding sequence
atgatccctggcaacaggatgctgatggtggtgctgctgtgccaggtgctgctgggcggggccagccacgccagcctcatccctgagaccgggaagaagaaggtggccgagatccagggccacgccggcggcagaagaagtggccagagccatgagctgctgcgggactttgaggccaccctgctgcagatgtttggcctgcggcggcggccccagcccagcaagtctgctgtgatcccagactacatgagggacctgtaccgcctgcagagcggggaggaggaggaggagcagatccacagcacaggcctggagtacccagagaggcctgccagccgggccaacacagtgcgctccttccaccacgaggagcacctggagaacatccctggcaccagcgagaacagcgccttccgcttcctgttcaacctgagcagcatcccagaaaatgaggtgatcagcagcgctgagctgcggctcttccgggagcaggtggaccagggccctgactgggagcggggcttccaccgcatcaacatctatgaggtgatgaagcccccagctgaggtggtgcccggccacctgatcacccggctgctggacacccggctggtgcaccacaacgtgacccgctgggagacctttgatgtgtccccagctgtgctgcgctggacccgggagaagcagcccaactacggcctggccatcgaggtgacccacctgcaccagaccaggacccaccagggccagcacgtgcgcatcagccgcagcctgccccagggcagcggcaactgggcccagctgcggcccctgctggtgacctttggacatgatggccggggccacgccctgaccaggagaagaagagccaagaggagccccaagcaccacagccagagggccaggaagaagaacaagaactgcagaagacacagcctgtatgtggacttcagtgatgtgggctggaatgactggatcgtggcccctcctggctaccaggccttctactgccacggggactgccccttccccctggccgaccacctgaacagcaccaaccacgccatcgtgcagaccctggtgaacagcgtgaacagcagcatccccaaggcctgctgcgtgcccacagagctgagcgccatctccatgctgtacctggatgaatatgacaaggtggtgctgaagaactaccaggagatggtggtggagggctgcggctgcaggtag

SEQ ID NO: 145262 - DNA, 1227 bp, Artificial Sequence; identical to SEQ ID NO: 145261
  Description of Artificial Sequence: Synthetic coding sequence

SEQ ID NO: 145263 - DNA, 1227 bp, Artificial Sequence; identical to SEQ ID NO: 145261
  Description of Artificial Sequence: Synthetic coding sequence

SEQ ID NO: 145264 - DNA, 1227 bp, Artificial Sequence; identical to SEQ ID NO: 145261
  Description of Artificial Sequence: Synthetic coding sequence

SEQ ID NO: 145265 - DNA, 333 bp, Artificial Sequence
  Description of Artificial Sequence: Synthetic coding sequence
atgatccctggcaacaggatgctgatggtggtgctgctgtgccaggtgctgctgggcggggccagccacgccagcctcatccctgagaccgggaagaagaaggtggccgagatccagggccacgccggcggcagaagaagtggccagagccatgagctgctgcgggactttgaggccaccctgctgcagatgtttggcctgcggcggcggccccagcccagcaagtctgctgtgatcccagactacatgagggacctgtaccgcctgcagagcggggaggaggaggaggagcagatccacagcacaggcctggagtacccagagcggccctag

SEQ ID NO: 145266 - DNA, 1365 bp, Artificial Sequence
  Description of Artificial Sequence: Synthetic coding sequence
atgcacctgaccgtcttcctgctgaagggcatcgtgggcttcctgtggagctgctgggtgctggtgggctacgccaagggcggcctgggggacaaccacgtgcacagcagcttcatctacagaaggctgaggaaccacgagcggcgggagatccagcgggagatcctgagcatcctgggcctgccccaccggccccggcccttcagccctgggaagcaggccagcagcgcccccctcttcatgctggacctgtacaatgccatgaccaatgaggagaaccctgaggagagcgagtacagcgtgcgggccagcctggccgaggagaccaggggggccaggaagggctacccagccagccccaacggctacccccggcgcatccagctgagcaggaccacccccctgaccacccagagcccccccctggccagcctgcatgacaccaacttcctgaatgatgctgacatggtgatgagctttgtgaacctggtggagcgggacaaggacttcagccaccagaggaggcactacaaggagttccgctttgacctgacccagatcccccatggagaggccgtgacagctgctgagttccgcatctacaaggacaggagcaacaacagatttgaaaatgagaccatcaagatcagcatctaccagatcatcaaggagtacaccaacagagatgctgacctcttcctgctggacaccaggaaggcccaggccctggatgtgggctggctggtgtttgacatcaccgtgaccagcaaccactgggtgatcaacccccagaacaacctgggcctgcagctgtgtgccgagactggagatggccgcagcatcaacgtgaagtctgctggcctggtgggccggcagggcccccagagcaagcagcccttcatggtggccttcttcaaggccagcgaggtgctgctgcggtctgtgcgggccgccaacaagaggaagaaccagaacagaaacaagagcagcagccaccaggacagcagcaggatgagctctgtgggggactacaacaccagcgagcagaagcaggcctgcaagaagcatgagctgtatgtgtccttccgggacctgggctggcaggactggatcatcgcccctgagggctacgccgccttctactgtgatggagaatgttccttccccctgaatgcccacatgaatgccaccaaccacgccatcgtgcagaccctggtgcacctgatgtttcctgaccacgtgcccaagccctgctgtgcccccaccaagctgaatgccatctctgtgctgtactttgatgacagcagcaatgtcatcctgaagaagtacagaaacatggtggtgcgcagctgtggctgccactag

SEQ ID NO: 145267 - DNA, 1254 bp, Artificial Sequence
  Description of Artificial Sequence: Synthetic coding sequence
atgcacctgaccgtcttcctgctgaagggcatcgtgggcttcctgtggagctgctgggtgctggtgggctacgccaagggcggcctgggggacaaccacgtgcacagcagcttcatctacagaaggctgaggaaccacgagcggcgggagatccagcgggagatcctgagcatcctgggcctgccccaccggccccggcccttcagccctgggaagcaggccagcagcgcccccctcttcatgctggacctgtacaatgccatgaccaatgaggagaaccctgaggagagcgagtacagcgtgcgggccagcctggccgaggagaccaggggggccaggaagggctacccagccagccccaacggctacccccggcgcatccagctgagcaggaccacccccctgaccacccagagcccccccctggccagcctgcatgacaccaacttcctgaatgatgctgacatggtgatgagctttgtgaacctggtggagcgggacaaggacttcagccaccagaggaggcactacaaggagttccgctttgacctgacccagatcccccatggagaggccgtgacagctgctgagttccgcatctacaaggacaggagcaacaacagatttgaaaatgagaccatcaagatcagcatctaccagatcatcaaggagtacaccaacagagatgctgacctcttcctgctggacaccaggaaggcccaggccctggatgtgggctggctggtgtttgacatcaccgtgaccagcaaccactgggtgatcaacccccagaacaacctgggcctgcagctgtgtgccgagactggagatggccgcagcatcaacgtgaagtctgctggcctggtgggccggcagggcccccagagcaagcagcccttcatggtggccttcttcaaggccagcgaggtgctgctgcggtctgtgcgggccgccaacaagaggaagaaccagaacagaaacaagagcagcagccaccaggacagcagcaggatgagctctgtgggggactacaacaccagcgagcagaagcaggcctgcaagaagcatgagctgtatgtgtccttccgggacctgggctggcaggtgcacctgatgtttcctgaccacgtgcccaagccctgctgtgcccccaccaagctgaatgccatctctgtgctgtactttgatgacagcagcaatgtcatcctgaagaagtacagaaacatggtggtgcgcagctgtggctgccactag

SEQ ID NO: 145268 - DNA, 1542 bp, Artificial Sequence
  Description of Artificial Sequence: Synthetic coding sequence
atgcctggcctgggccggcgggcccagtggctgtgctggtggtggggcctgctgtgcagctgctgcggccccccacccctgcggccccccctgcctgctgctgctgctgctgctgctgggggccagctgctgggagatggcggcagccctggccgcacagagcagcccccacccagcccccagagcagcagcggcttcctgtacagaaggctgaagacccaggagaagcgggagatgcagaaggagatcctgtctgtgctgggcctgccccaccggccccggcccctgcacggcctgcagcagccccagcccccagccctgcggcagcaggaggagcagcagcagcagcagcagctgcccagaggagagcccccacctggccgcctgaagagcgcccccctcttcatgctggacctgtacaatgccctgtctgctgacaatgatgaagatggagccagcgagggggagcggcagcagagctggccccatgaagctgccagcagcagccagaggcggcagcccccacctggggccgcccaccccctgaacaggaagagcctgctggcccctggcagcggcagcggcggggccagccccctgaccagcgcccaggacagcgccttcctgaatgatgctgacatggtgatgagctttgtgaacctggtggagtatgacaaggagttcagcccccggcagaggcaccacaaggagttcaagttcaacctgagccagatccctgagggggaggtggtgacagctgctgagttccgcatctacaaggactgtgtgatgggcagcttcaagaaccagaccttcctgatcagcatctaccaggtgctgcaggagcaccagcaccgggacagcgacctcttcctgctggacaccagggtggtgtgggccagcgaggagggctggctggagtttgacatcacagccaccagcaacctgtgggtggtgaccccccagcacaacatgggcctgcagctgtctgtggtgaccagagatggagtgcacgtgcaccccagggctgctggcctggtgggcagagatggcccctatgacaagcagcccttcatggtggccttcttcaaggtgtctgaggtgcacgtgaggaccaccaggtctgccagcagcagaagacggcagcagagcaggaacagaagcacccagagccaggatgtggcccgggtgtcctctgccagtgactacaacagcagcgagctgaagacagcctgcaggaagcatgagctgtatgtgtccttccaggacctgggctggcaggactggatcatcgcccccaagggctatgctgccaactactgtgatggagagtgcagcttccccctgaatgcccacatgaatgccaccaaccacgccatcgtgcagaccctggtgcacctgatgaacccagaatatgtgcccaagccctgctgtgcccccaccaagctgaatgccatctctgtgctgtactttgatgacaacagcaatgtcatcctgaagaagtacagaaacatggtggtgcgggcctgtggctgccactag

SEQ ID NO: 145269 - DNA, 1308 bp, Artificial Sequence
  Description of Artificial Sequence: Synthetic coding sequence
atgcagaaggagatcctgtctgtgctgggcctgccccaccggccccggcccctgcacggcctgcagcagccccagcccccagccctgcggcagcaggaggagcagcagcagcagcagcagctgcccagaggagagcccccacctggccgcctgaagagcgcccccctcttcatgctggacctgtacaatgccctgtctgctgacaatgatgaagatggagccagcgagggggagcggcagcagagctggccccatgaagctgccagcagcagccagaggcggcagcccccacctggggccgcccaccccctgaacaggaagagcctgctggcccctggcagcggcagcggcggggccagccccctgaccagcgcccaggacagcgccttcctgaatgatgctgacatggtgatgagctttgtgaacctggtggagtatgacaaggagttcagcccccggcagaggcaccacaaggagttcaagttcaacctgagccagatccctgagggggaggtggtgacagctgctgagttccgcatctacaaggactgtgtgatgggcagcttcaagaaccagaccttcctgatcagcatctaccaggtgctgcaggagcaccagcaccgggacagcgacctcttcctgctggacaccagggtggtgtgggccagcgaggagggctggctggagtttgacatcacagccaccagcaacctgtgggtggtgaccccccagcacaacatgggcctgcagctgtctgtggtgaccagagatggagtgcacgtgcaccccagggctgctggcctggtgggcagagatggcccctatgacaagcagcccttcatggtggccttcttcaaggtgtctgaggtgcacgtgaggaccaccaggtctgccagcagcagaagacggcagcagagcaggaacagaagcacccagagccaggatgtggcccgggtgtcctctgccagtgactacaacagcagcgagctgaagacagcctgcaggaagcatgagctgtatgtgtccttccaggacctgggctggcaggactggatcatcgcccccaagggctatgctgccaactactgtgatggagagtgcagcttccccctgaatgcccacatgaatgccaccaaccacgccatcgtgcagaccctggtgcacctgatgaacccagaatatgtgcccaagccctgctgtgcccccaccaagctgaatgccatctctgtgctgtactttgatgacaacagcaatgtcatcctgaagaagtacagaaacatggtggtgcgggcctgtggctgccactag

SEQ ID NO: 145270 - DNA, 1431 bp, Artificial Sequence
  Description of Artificial Sequence: Synthetic coding sequence
gctgctgggggccagctgctgggagatggcggcagccctggccgcacagagcagcccccacccagcccccagagcagcagcggcttcctgtaccgccgcctgaagacccaggagaagcgggagatgcagaaggagatcctgtctgtgctgggcctgccccaccggccccggcccctgcacggcctgcagcagccccagcccccagccctgcggcagcaggaggagcagcagcagcagcagcagctgcccagaggagagcccccacctggccgcctgaagagcgcccccctcttcatgctggacctgtacaatgccctgtctgctgacaatgatgaagatggagccagcgagggggagcggcagcagagctggccccatgaggccgccagcagcagccagaggcggcagcccccacctggagctgcccaccccctgaacaggaagagcctgctggcccctggcagcggcagcggcggggccagccccctgaccagcgcccaggacagcgccttcctgaatgatgctgacatggtgatgagctttgtgaacctggtggagtatgacaaggagttcagcccccggcagaggcaccacaaggagttcaagttcaacctgagccagatccctgagggggaggtggtgacagctgctgagttccgcatctacaaggactgtgtgatgggcagcttcaagaaccagaccttcctgatcagcatctaccaggtgctgcaggagcaccagcaccgggacagcgacctcttcctgctggacaccagggtggtgtgggccagcgaggagggctggctggagtttgacatcacagccaccagcaacctgtgggtggtgaccccccagcacaacatgggcctgcagctgtctgtggtgaccagagatggagtgcacgtgcaccccagggctgctggcctggtgggcagagatggcccctatgacaagcagcccttcatggtggccttcttcaaggtgtctgaggtgcacgtgaggaccaccaggtctgccagcagcagaagacggcagcagagcaggaacagaagcacccagagccaggatgtggcccgggtgagcagcgccagtgactacaacagcagcgagctgaagacagcctgcaggaagcatgagctgtatgtgtccttccaggacctgggctggcaggactggatcatcgcccccaagggctacgccgccaactactgtgatggagaatgttccttccccctgaatgcccacatgaatgccaccaaccacgccatcgtgcagaccctggtgcacctgatgaacccagaatatgtgcccaagccctgctgtgcccccaccaagctgaatgccatctctgtgctgtactttgatgacaacagcaatgtcatcctgaagaagtacagaaacatggtggtgcgggcctgtggctgccactag

SEQ ID NO: 145271 - DNA, 2505 bp, Artificial Sequence
  Description of Artificial Sequence: Synthetic coding sequence
atggaggagaagacccagatcaagaccttcctgggcagcaagctgcccaagtatggcaccaagtctgtgcgcagcaccctgcagcccatgcccaacggcacccctgtgaacctgctgggcaccagcaagaacagcaatgtgaagagctacatcaagaacaacggcagtgactgccccagcagccacagcttcaactggaggaaggccaacaagtaccagctgtgtgcccagggcgtggaggagcccaacaacacccagaacagccatgacaagatcattgatcctgagaagagggtgcccacccagggcatgtttgacaagaatggcatcaagggcggcctgaagtctgtgtccctcttcaccagcaagctggccaagcccagcaccatgtttgtgagcagcacagaggagctgaaccagaagagcttcagcggccccagcaacctgggcaagttcaccaagggcaccctgctgggccgcaccagctacagcagcatcaacacccccaagagccagctgaatggcttctacggcaacagatctgctggctccatgcagaggccccgggccaacagctgtgccaccaggagcagcagtggagagagcctggcccagagcccagacagcagcaagagcatcaactgtgagaagatggtgcgcagccagagcttcagccacagcatccagaacagcttcctgccccccagcagcatcaccaggagccacagcttcaacagagctgtggacctgaccaagccctaccagaaccagcagctgagcatccgggtgcccctgcggagctccatgctgaccaggaacagccggcagcctgaggtgctgaatggaaatgagcacctgggctacggcttcaaccggccctatgctgctgggggcaagaagctggccctgcccaatggacctggggtgaccagcaccctgggctacaggatggtgcaccccagcctgctgaagagcagccgcagccccttcagcggcaccatgacagtggatggcaacaagaacagccctgctgacacctgtgtggaggaggatgccaccgtgctggccaaggaccgggccgccaacaaggaccaggagctgattgaaaatgaaagctaccgcaccaagaacaaccagaccatgaagcatgatgccaagatgagatacctgagtgatgatgtggatgacatcagcctgagcagcctgagcagcagtgacaagaatgacctgtctgaggacttcagtgatgacttcattgatattgaggacagcaacagaacccgcatcaccccagaggagatgagcctgaaggaggagaagcatgaaaatggaccaccccaggacatgtttgacagccccaaggaaaatgagaaggccttcagcaagacagatgagtggattgacatctctgtgtctgacagaagtgagtgcaccaagcacaccagcggcaacaacctggtgtccccagacacagactacagagctggcagcagctttgagctgagccccagcgacagcagtgatggcacctacatgtgggatgaggagggcctggagcccatcggaaatgtgcaccctgtgggcagctatgagagcagcgagatgaacagcattgacatcctgaacaacctggagagctgtgacctggaggatgatgacctgatgctggatgtggacctgcctgaagatgcccccctggagaatgtggagtgtgacaacatgaacagatttgacagaccagacagaaatgtgcggcagccccaggagggcttctggaagaggcctccccagcgctggagcggccaggagcactaccacctgagccacccagaccactaccaccaccacggcaagagtgacctgagccggggcagcccctaccgggagagccccctgggccactttgagagctatggaggcatgcccttcttccaggcccagaagatgtttgtggatgtgcctgaaaatacagtcatcctggatgagatgaccctgcggcacatggtgcaggactgcacagctgtgaagacccagctgctgaagctgaagaggctgctgcaccagcatgatggcagcggcagcctgcatgacatccagctgagcctgcccagcagccctgagccagaagatggagacaaggtgtacaagaatgaagacctgctgaatgagatcaagcagctgaaggatgagatcaagaagaaggatgagaagatccagctgctggagctgcagctggccacccagcacatctgccaccagaagtgcaaggaggagaagtgcacctatgctgacaagtacacccagaccccctggaggcgcatccctgggggctacagcgcccccagcttcagcccctggcagggcagcttccagggcatccccaggacagtgcccccccaccggcggcagaccagcagcaccacagccttccagcagcccagccagacccacaggagccaccctgggaagaccaacaaggccaccacctaccggggcccccagtag

SEQ ID NO: 145272 - DNA, 1599 bp, Artificial Sequence
  Description of Artificial Sequence: Synthetic coding sequence
atgccccagctgtacatctacatccggctgctgggcgcctacctgttcatcatcagccgggtgcagggccagaacctggacagcatgctgcatggaacaggcatgaagagtgacagcgaccagaagaagtcagaaaatggagtgaccctggcccctgaggacaccctgcccttcctgaagtgctactgcagcggccactgcccagatgatgccatcaacaacacctgcatcaccaacggccactgctttgccatcatcgaggaggatgaccagggcgagaccaccctggccagcggctgcatgaagtatgagggcagtgacttccagtgcaaggacagccccaaggcccagctgcggaggaccatcgagtgctgcaggaccaacctgtgcaaccagtacctgcagcccaccctgccccctgtggtgattggccccttctttgatggcagcatccgctggctggtgctgctgatctccatggctgtgtgcatcatcgccatgatcatcttcagcagctgcttctgctacaagcactactgcaagagcatcagcagcagaagacgctacaacagagacctggagcaggatgaggccttcatccctgtgggggagagcctgaaggacctgattgaccagagccagagcagcggcagcggcagcggcctgcccctgctggtgcagaggaccatcgccaagcagatccagatggtgcggcaggtgggcaagggccgctatggagaggtgtggatgggcaagtggagaggagagaaggtggccgtgaaggtgttcttcaccacagaggaggcctcctggttccgggagacagagatctaccagacagtgctgatgagacatgagaacatcctgggcttcatcgctgctgacatcaagggcaccggctcctggacccagctgtacctgatcacagactaccatgaaaatggcagcctgtatgacttcctgaagtgtgccaccctggacacccgggccctgctgaagctggcctacagcgctgcctgtggcctgtgccacctgcacacagagatctacggcacccagggcaagccagccatcgcccaccgggacctgaagagcaagaacatcctgatcaagaagaatggcagctgctgcatcgctgacctgggcctggccgtgaagttcaacagcgacaccaatgaggtggatgtgcccctgaacaccagggtgggcaccaagcgctacatggcccctgaggtgctggatgagagcctgaacaagaaccacttccagccctacatcatggctgacatctacagctttggcctcatcatctgggagatggcccggcgctgcatcaccggcggcatcgtggaggagtaccagctgccctactacaacatggtgcccagcgaccccagctatgaggacatgagggaggtggtgtgtgtgaagaggctgcggcccatcgtgagcaaccgctggaacagtgatgaatgtctgcgggctgtgctgaagctgatgtctgagtgctgggcccacaacccagccagccggctgacagccctgcgcatcaagaagaccctggccaagatggtggagagccaggatgtgaagatctag

SEQ ID NO: 145273 - DNA, 3117 bp, Artificial Sequence
  Description of Artificial Sequence: Synthetic coding sequence
atgaccagcagcctgcagaggccctggagggtgccctggctgccctggaccatcctgctggtgtccacagctgctgccagccagaaccaggagcggctgtgtgccttcaaggacccctaccagcaggacctgggcatcggggagagccgcatcagccatgaaaatggcaccatcctgtgcagcaagggcagcacctgctacggcctgtgggagaagagcaagggggacatcaacctggtgaagcagggctgctggagccacatcggggacccccaggagtgccactatgaggagtgtgtggtgaccaccaccccacccagcatccagaatggcacctaccgcttctgctgctgcagcacagacctgtgcaatgtgaacttcacagagaacttccccccaccagacaccacccccctgagccccccccacagcttcaacagagatgagaccatcatcatcgccctggcctctgtgtctgtgctggccgtgctgattgtggccctgtgcttcggctacaggatgctgaccggggacaggaagcagggcctgcacagcatgaacatgatggaggccgccgccagcgagcccagcctggacctggacaacctgaagctgctggagctgattggccggggccgctacggggctgtgtacaagggcagcctggatgagaggcctgtggccgtgaaggtgttctcctttgccaaccggcagaacttcatcaatgagaagaacatctacagagtgcccctgatggagcatgacaacatcgcccgcttcatcgtgggagatgagcgggtgacagcagatggccgcatggagtacctgctggtgatggagtactaccccaacggcagcctgtgcaagtacctgagcctgcacaccagtgactgggtgagcagctgccgcctggcccacagcgtgacccggggcctggcctacctgcacacagagctgcccaggggggaccactacaagccagccatcagccaccgggacctgaacagcagaaatgtgctggtgaagaatgatggcacctgtgtgatcagtgactttggcctgtccatgaggctgactggaaaccggctggtgcggcctggagaagaagataatgctgccatcagcgaggtgggcaccatccgctacatggcccctgaggtgctggagggcgctgtgaacctgcgggactgtgagagcgccctgaagcaggtggacatgtatgccctgggcctcatctactgggagatcttcatgcgctgcacagacctcttccctggagagagcgtgcctgagtaccagatggccttccagacagaggtgggcaaccaccccacctttgaggacatgcaggtgctggtgtcccgggagaagcagaggcccaagtttcctgaggcctggaaggagaacagcctggccgtgcgcagcctgaaggagaccatcgaggactgctgggaccaggatgctgaggcccggctgacagcccagtgtgccgaggagaggatggccgagctgatgatgatctgggagaggaacaagtctgtgagccccaccgtgaaccccatgagcacagccatgcagaatgaaagaaacctgagccacaacagaagagtgcccaagattggcccctacccagactacagcagcagcagctacattgaagattccatccaccacacagacagcatcgtgaagaacatcagcagcgagcacagcatgagcagcacccccctgaccatcggggagaagaacagaaacagcatcaactatgagcggcagcaggcccaggcccgcatccccagccctgagacctctgtgaccagcctgagcaccaacaccaccaccaccaacaccaccggcctgacccccagcacaggcatgaccaccatcagcgagatgccctacccagatgagaccaacctgcacaccaccaacgtggcccagagcatcggccccacccctgtgtgcctgcagctgacagaggaggacctggagaccaacaagctggaccccaaggaggtggacaagaacctgaaggagagcagtgatgagaacctgatggagcacagcctgaagcagttcagcggccctgaccccctgagcagcaccagcagcagcctgctgtaccccctcatcaagctggccgtggaggccaccggccagcaggacttcacccagacagccaacggccaggcctgcctgatcccagatgtgctgcccacccagatctaccccctgcccaagcagcagaacctgcccaagaggcccaccagcctgcccctgaacaccaagaacagcaccaaggagccccggctgaagtttggcagcaagcacaagagcaacctgaagcaggtggagaccggggtggccaagatgaacaccatcaatgctgctgagccccacgtggtgacagtgaccatgaatggagtggccggcaggaaccacagcgtgaacagccacgccgccaccacccagtatgccaatggaacagtgctgagcggccagaccaccaacatcgtgacccaccgggcccaggagatgctgcagaaccagttcatcggggaggacacccggctgaacatcaacagcagcccagatgaacatgagcccctgctgcggcgggagcagcaggccggccatgatgagggcgtgctggaccggctggtggaccggcgggagcggcccctggagggcggccgcaccaacagcaacaacaacaacagcaacccctgcagcgagcaggatgtgctggcccagggcgtgcccagcacagctgctgaccccggccccagcaagccccggcgggcccagaggcccaacagcctggacctgagcgccaccaacgtgctggatggcagcagcatccagatcggggagagcacccaggacggcaagagcggcagcggggagaagatcaagaagagggtgaagaccccctacagcctgaagcgctggaggcccagcacctgggtgatcagcacagagagcctggactgtgaggtgaacaacaacggcagcaacagagctgtgcacagcaagagcagcacagctgtgtacctggccgagggcggcacagccaccaccatggtgtccaaggacatcggcatgaactgcctgtag

SEQ ID NO: 145274 - DNA, 2337 bp, Artificial Sequence
  Description of Artificial Sequence: Synthetic coding sequence
atgagcagcggggccaaggagggcggcggcggcagccctgcctaccacctgccccacccccacccccaccccccccagcacgcccagtatgtgggcccctaccgcctggagaagaccctgggcaagggccagacaggcctggtgaagctgggcgtgcactgcatcaccggccagaaggtggccatcaagatcgtgaaccgggagaagctgtctgagagcgtgctgatgaaggtggagcgggagatcgccatcctgaagctgattgagcacccccacgtgctgaagctgcatgatgtgtatgagaacaagaagtacctgtacctggtgctggagcacgtgtctggaggagagctgtttgactacctggtgaagaagggccgcctgacccccaaggaggccaggaagttcttccggcagatcgtgtctgccctggacttctgccacagctacagcatctgccaccgggacctgaagccagagaacctgctgctggatgagaagaacaacatcagaattgctgactttggcatggccagcctgcaggtgggggacagcctgctggagaccagctgtggcagcccccactacgcctgcccagaggtgatcaagggggagaagtatgatggccggcgggctgacatgtggagctgtggggtcatcctgtttgccctgctggtgggcgccctgccctttgatgatgacaacctgcggcagctgctggagaaggtgaagaggggcgtcttccacatgccccacttcatccccccagactgccagagcctgctgcggggcatgattgaggtggagcctgagaagaggctgagcctggagcagatccagaagcacccctggtacctgggcggcaagcatgagccagacccctgcctggagcccgcccctggccggcgggtggccatgaggagcctgcccagcaatggagagctggaccctgatgtgctggagagcatggccagcctgggctgcttccgggaccgggagcggctgcaccgggagctgcggtctgaggaggagaaccaggagaagatgatctactacctgctgctggacaggaaggagcgctaccccagctgtgaggaccaggacctgcccccaagaaatgatgtggacccccccaggaagagggtggacagccccatgctgagccgccacggcaagagaagacctgagaggaagtccatggaggtgctgagcatcacagatgctgggggcggcggcagccctgtgcccacccggcgggccctggagatggcccagcacagccagaggagccgctctgtgtctggggccagcacaggcctgagcagcagccccctgagcagccccaggagccctgtgttctccttcagccctgagcctggagctggagatgaggcccggggcggcggcagccccaccagcaagacccagaccctgcccagccggggcccccggggcggcggggccggggagcagcccccaccacccagcgcccggagcacccccctgcccggccccccaggcagccccaggagcagcggcggcacccccctgcacagccccctgcacaccccccgggccagccccaccggcaccccaggcaccaccccaccacccagccctgggggcggcgtgggcggggccgcctggaggagccggctgaacagcatcagaaattccttcctgggcagcccccgcttccacaggaggaagatgcaggtgcccacagctgaggagatgagcagcctgaccccagagagcagccctgagctggccaagaggtcctggtttggaaacttcatcagcctggacaaggaggagcagatcttcctggtgctgaaggacaagcccctgagcagcatcaaggctgacatcgtgcacgccttcctgagcatccccagcctgagccacagcgtgctgagccagaccagcttccgggcagagtacaaggccagcggcggccccagcgtcttccagaagcctgtgcgcttccaggtggacatcagcagcagcgagggccctgagcccagccccaggagagatggcagcggcggcggcggcatctacagcgtgaccttcaccctcatcagcggccccagccgccgcttcaagagggtggtggagaccatccaggcccagctgctgagcacccatgaccagcccagcgtgcaggccctggctgatgagaagaatggagcccagaccaggcctgctggggccccacccaggagcctgcagcccccacctggccgcccagaccctgagctgagcagcagcccccggcggggcccccccaaggacaagaagctgctggccaccaacggcacccccctgccctag

SEQ ID NO: 145275 - DNA, 1422 bp, Artificial Sequence
  Description of Artificial Sequence: Synthetic coding sequence
atgaggagcctgcccagcaatggagagctggaccctgatgtgctggagagcatggccagcctgggctgcttccgggaccgggagcggctgcaccgggagctgcggtctgaggaggagaaccaggagaagatgatctactacctgctgctggacaggaaggagcgctaccccagctgtgaggaccaggacctgcccccaagaaatgatgtggacccccccaggaagagggtggacagccccatgctgagcagacatggcaagaggaggcctgagaggaagtccatggaggtgctgagcatcacagatgctgggggcggcggcagccctgtgcccacccggcgggccctggagatggcccagcacagccagaggagccgctctgtgtctggggccagcacaggcctgagcagcagccccctgagcagccccaggagccctgtgttctccttcagccctgagcccggggctggagatgaggcccggggcggcggcagccccaccagcaagacccagaccctgcccagccggggcccccggggcggcggggccggggagcagcccccacctccttctgcccggagcacccccctgcccggccccccaggcagccccaggagcagcggcggcacccccctgcacagccccctgcacaccccccgggccagccccaccggcaccccaggcaccaccccaccacccagccctgggggcggcgtgggcggggccgcctggaggagccggctgaacagcatccggaacagcttcctgggcagcccccgcttccacaggaggaagatgcaggtgcccacagctgaggagatgagcagcctgaccccagagagcagccctgagctggccaagaggtcctggtttggaaacttcatcagcctggacaaggaggagcagatcttcctggtgctgaaggacaagcccctgagcagcatcaaggctgacatcgtgcacgccttcctgagcatccccagcctgagccacagcgtgctgagccagaccagcttccgggcagagtacaaggccagcggcggccccagcgtcttccagaagcctgtgcgcttccaggtggacatcagcagcagcgagggccctgagcccagccccaggagagatggcagcggcggcggcggcatctacagcgtgaccttcaccctcatcagcggccccagccgccgcttcaagagggtggtggagaccatccaggcccagctgctgagcacccatgaccagcccagcgtgcaggccctggctgatgagaagaatggagcccagaccaggcctgctggggccccacccaggagcctgcagcccccacctggccgcccagaccctgagctgagcagcagcccccggcggggcccccccaaggacaagaagctgctggccaccaacggcacccccctgccctag

SEQ ID NO: 145276 - DNA, 1422 bp, Artificial Sequence; identical to SEQ ID NO: 145275
  Description of Artificial Sequence: Synthetic coding sequence

SEQ ID NO: 145277 - DNA, 2976 bp, Artificial Sequence
  Description of Artificial Sequence: Synthetic coding sequence
atgaggcaccgggtgtgccggggccgcagcggccagggcagaagaagaagcagcgtcatcccctggcctgtgcccaagcacgtgggctgggtggtgctgctgggctgcggcggcagcggcaccagcatcctggtggtgtccatcgtgggcagcggcctcatcaaggccatggccccagctgagatcctgaatggcaaggagatcagcgcccagatccgggcccggctgaagaaccaggtgacccagctgaaggagcaggtgcccggcttcaccccccggctggccatcctgcaggtgggcaacagagatgacagcaacctgtacatcaacgtgaagctgaaggctgctgaggagatcggcatcaaggccacccacatcaagctgcccaggaccaccacagaaagtgaggtgatgaagtacatcaccagcctgaatgaagacagcacagtgcacggcttcctggtgcagctgcccctggacagcgagaacagcatcaacacagaggaggtgatcaatgccatcgcccctgagaaggatgtggatggcctgaccagcatcaatgctgggaagctggcccggggggacctgaatgactgcttcatcccctgcacccccaagggctgcctggagctgatcaaggagactggagtgcccatcgccggcagacatgctgtggtggtgggccgcagcaagatcgtgggcgcccccatgcatgacctgctgctgtggaacaatgccaccgtgaccacctgccacagcaagacagcccacctggatgaggaggtgaacaagggggacatcctggtggtggccaccggccagcctgagatggtgaagggggagtggatcaagccaggggccatcgtcatcgactgtggcatcaactacgtgcctgatgacaagaagcccaacggcaggaaggtggtgggagatgtggcctatgatgaggccaaggagcgggccagcttcatcacccctgtgcctgggggcgtgggccccatgacagtggccatgctgatgcagagcacagtggagagcgccaagcgcttcctggagaagttcaagccaggcaagtggatgatccagtacaacaacctgaacctgaagacccctgtgcccagcgacatcgacatcagccgcagctgcaagcccaagcccatcggcaagctggcccgggagatcggcctgctgtctgaggaggtggagctgtatggagagaccaaggccaaggtgctgctgagcgccctggagcggctgaagcacaggccagatggcaagtatgtggtggtgacaggcatcacccccacccccctgggggagggcaagagcaccaccaccatcggcctggtgcaggccctgggcgcccacctgtaccagaatgtgtttgcctgtgtgcggcagcccagccagggccccaccttcggcatcaagggcggcgctgctgggggcggctacagccaggtgatccccatggaggagttcaacctgcacctgactggagacatccacgccatcacagctgccaacaacctggtggccgccgccattgatgcccgcatcttccacgagctgacccagacagacaaggccctcttcaaccggctggtgcccagcgtgaatggagtgcggcgcttcagtgacatccagatccggcggctgaagaggctgggcatcgagaagacagaccccaccaccctgacagatgaggagatcaacagatttgcccggctggacattgatcctgagaccatcacctggcagagggtgctggacaccaatgaccgcttcctgaggaagatcaccatcggccaggcccccacagagaagggccacaccaggacagcccagtttgacatctctgtggccagcgagatcatggctgtgctggccctgaccaccagcctggaggacatgagggagcggctgggcaagatggtggtggccagcagcaagaagggggagcctgtgtctgctgaggacctgggcgtgtctggggccctgactgtgctgatgaaggatgccatcaagcccaacctgatgcagaccctggagggcacccctgtgtttgtgcacgccggcccctttgccaacatcgcccacggcaacagcagcatcatcgctgaccgcatcgccctgaagctggtgggccctgagggctttgtggtgacagaagctggctttggagctgacatcggcatggagaagttcttcaacatcaagtgccgctacagcggcctgtgcccccacgtggtggtgctggtggccaccgtgcgggccctgaagatgcatggaggcggccccaccgtgacagctggcctgcccctgcccaaggcctacatccaggagaacctggagctggtggagaagggcttcagcaacctgaagaagcagattgaaaatgccaggatgtttggcatccctgtggtggtggccgtgaatgccttcaagacagacacagaaagtgagctggacctgatcagccggctgagccgggagcacggggcctttgatgctgtgaagtgcacccactgggccgagggcggcaaaggagccctggccctggcccaggccgtgcagagagctgcccaggcccccagcagcttccagctgctgtatgacctgaagctgcctgtggaggacaagatccgcatcatcgcccagaagatctacggggctgatgacatcgagctgctgcctgaggcccagcacaaggccgaggtgtacaccaagcagggctttggaaacctgcccatctgcatggccaagacccacctgagcctgagccacaaccctgagcagaagggcgtgcccaccggcttcatcctgcccatccgggacatccgggcctctgtgggcgccggcttcctgtaccccctggtgggcaccatgagcaccatgcctggcctgcccacccggccctgcttctatgacatcgacctggaccctgagacagagcaggtgaatggcctcttctag

SEQ ID NO: 145278 - DNA, 1176 bp, Artificial Sequence
  Description of Artificial Sequence: Synthetic coding sequence
atgttcagcccctggaagatctccatgttcctgtctgtgagagaagattctgtgcccaccacagccagcttctctgctgacatgctgaatgtgaccctgcagggccccaccctgaatggcacctttgcccagagcaagtgcccccaggtggagtggctgggctggctgaacaccatccagccccccttcctgtgggtgctgtttgtgctggccaccctggagaacatctttgtgctgagcgtcttctgcctgcacaagagcagctgcaccgtggccgagatctacctgggcaacctggccgctgctgacctgatcctggcctgtggcctgcccttctgggccatcaccatcagcaacaactttgactggctgtttggagagaccctgtgccgggtggtgaatgccatcatctccatgaacctgtacagcagcatctgcttcctgatgctggtgtccattgaccgctacctggccctggtgaagaccatgtccatgggccgcatgaggggcgtgcgctgggccaagctgtacagcctggtgatctggggctgcaccctgctgctgagcagccccatgctggtgttccgcaccatgaaggagtacagtgatgagggccacaacgtgacagcctgtgtgatctcctaccccagcctcatctgggaggtgttcaccaacatgctgctgaatgtggtgggcttcctgctgcccctgagcgtcatcaccttctgcaccatgcagatcatgcaggtgctgaggaacaatgagatgcagaagttcaaggagatccagacagagcggcgggccaccgtgctggtgctggtggtgctgctgctcttcatcatctgctggctgcccttccagatcagcaccttcctggacaccctgcaccggctgggcatcctgagcagctgccaggatgagcgcatcattgatgtgatcacccagatcgccagcttcatggcctacagcaacagctgcctgaaccccctggtgtatgtgattgtgggcaagcgcttcaggaagaagtcctgggaggtgtaccagggcgtgtgccagaagggcggctgccgctctgagcccatccagatggagaacagcatgggcaccctgcggaccagcatctctgtggagcggcagatccacaagctgcaggactgggccggcagccggcagtag

SEQ ID NO: 145279 - DNA, 1095 bp, Artificial Sequence
  Description of Artificial Sequence: Synthetic coding sequence
atgctgaatgtgaccctgcagggccccaccctgaatggcacctttgcccagagcaaatgtccccaggtggagtggctgggctggctgaacaccatccagccccccttcctgtgggtgctgtttgtgctggccaccctggagaacatctttgtgctgtctgtgttctgcctgcacaagagcagctgcaccgtggccgagatctacctgggcaacctggccgctgctgacctgatcctggcctgtggcctgcccttctgggccatcaccatcagcaacaactttgactggctgtttggagagaccctgtgccgggtggtgaatgccatcatctccatgaacctgtacagcagcatctgcttcctgatgctggtgtccattgaccgctacctggccctggtgaagaccatgtccatgggccgcatgagaggagtgcgctgggccaagctgtacagcctggtgatctggggctgcaccctgctgctgagcagccccatgctggtgttccgcaccatgaaggagtacagtgatgagggccacaacgtgacagcctgcgtcatctcctaccccagcctcatctgggaggtgttcaccaacatgctgctgaatgtggtgggcttcctgctgcccctgagcgtcatcaccttctgcaccatgcagatcatgcaggtgctgagaaataatgagatgcagaagttcaaggagatccagacagaaagaagagccaccgtgctggtgctggtggtgctgctgctcttcatcatctgctggctgcccttccagatcagcaccttcctggacaccctgcaccggctgggcatcctgagcagctgccaggatgagcgcatcattgatgtgatcacccagatcgccagcttcatggcctacagcaacagctgcctgaaccccctggtgtatgtgattgtgggcaagcgcttcaggaagaagtcctgggaggtgtaccagggcgtgtgccagaagggcggctgccgctctgagcccatccagatggagaacagcatgggcaccctgcggaccagcatctctgtggagcggcagatccacaagctgcaggactgggccggcagccggcagtag

SEQ ID NO: 145280 - DNA, 1095 bp, Artificial Sequence; identical to SEQ ID NO: 145279
  Description of Artificial Sequence: Synthetic coding sequence

SEQ ID NO: 145281 - DNA, 1176 bp, Artificial Sequence; identical to SEQ ID NO: 145278
  Description of Artificial Sequence: Synthetic coding sequence

SEQ ID NO: 145282 - DNA, 684 bp, Artificial Sequence
  Description of Artificial Sequence: Synthetic coding sequence
atgggcggcaagctgagcaagaagaagaagggctacaacgtgaatgatgagaaggccaaggagaaggacaagaaggccgagggcgccgccacagaggaggagggcacccccaaggagagcgagccccaggccgctgctgagcctgctgaggccaaggagggcaaggagaagccagaccaggatgctgagggcaaggccgaggagaaggagggggagaaggatgctgctgctgccaaggaggaggcccccaaggccgagcctgagaagacagagggcgctgctgaggccaaggccgagccccccaaggcccctgagcaggagcaggccgcccctggccctgctgctggaggagaggcccccaaggctgctgaggccgctgctgccccagctgagagcgctgccccagctgctggggaggagcccagcaaggaggagggggagcccaagaagacagaggccccagctgccccagctgcccaggagaccaagagtgatggagccccagccagtgacagcaagccaggcagcagcgaggccgcccccagcagcaaggagaccccagctgccacagaggcccccagcagcacccccaaggcccagggccctgctgccagcgctgaggagcccaagcctgtggaggccccagctgccaacagcgaccagacagtgacagtgaaggagtag

SEQ ID NO: 145283 - DNA, 522 bp, Artificial Sequence
  Description of Artificial Sequence: Synthetic coding sequence
atgggcggcaagctgagcaagaagaagaagggctacaacgtgaatgatgagaaggccaaggagaaggacaagaaggccgagggcgccgccacagaggaggagggcacccccaaggagagcgagccccaggccgctgctgagcctgctgaggccaaggagggcaaggagaagccagaccaggatgctgagggcaaggccgaggagaaggagggggagaaggatgctgctgctgccaaggaggaggcccccaaggccgagccagacaaggaggagggggagcccaagaagacagaggccccagctgccccagctgcccaggagaccaagagtgatggagccccagccagtgacagcaagccaggcagcagcgaggccgcccccagcagcaaggagaccccagctgccacagaggcccccagcagcacccccaaggcccagggccctgctgccagcgctgaggagcccaagcctgtggaggccccagctgccaacagcgaccagacagtgacagtgaaggagtag

SEQ ID NO: 145284 - DNA, 543 bp, Artificial Sequence
  Description of Artificial Sequence: Synthetic coding sequence
atgggctgcggcggcagcagagcagatgccatcgagccccgctactatgagagctggacccgggagacagagagcacctggctgacctacacagacagtgatgccccacccagcgctgctgccccagacagcggccctgaggccggcggcctgcacagcgtgctggaggccgagaagagcaagatcaaggcccccacagacagcgtgtctgatgagggcctcttcagcgccagcaagatggcccccctggccgtgttcagccacggcatgctggaggatggcctgcccagcaatggagtgcccaggagcacagcccctgggggcatccccaaccctgagaagaagaccaactgtgagacccagtgccccaacccccagagcctgagcagcggccccctgacccagaagcagaatggcctgcagaccacagaggccaagagagatgccaagaggatgcctgccaaggaggtgaccatcaacgtgacagacagcatccagcagatggacaggagccgccgcatcaccaagaactgtgtgaactag

SEQ ID NO: 145285 - DNA, 438 bp, Artificial Sequence
  Description of Artificial Sequence: Synthetic coding sequence
atgggctgcggcggcagcagagcagatgccatcgagccccgctactatgagagctggacccgggagacagagagcacctggctgacctacacagacagtgatgccccacccagcgctgctgccccagacagcggccctgaggccggcggcctgcacagcggcatgctggaggatggcctgcccagcaatggagtgcccaggagcacagcccctgggggcatccccaaccctgagaagaagaccaactgtgagacccagtgccccaacccccagagcctgagcagcggccccctgacccagaagcagaatggcctgcagaccacagaggccaagagagatgccaagaggatgcctgccaaggaggtgaccatcaacgtgacagacagcatccagcagatggacaggagccgccgcatcaccaagaactgtgtgaactag

SEQ ID NO: 145286 - DNA, 165 bp, Artificial Sequence
  Description of Artificial Sequence: Synthetic coding sequence
atgggctgcggcggcagcagagcagatgccatcgagccccgctactatgagagctggacccgggagacagagagcacctggctgacctacacagacagtgatgccccacccagcgctgctgccccagacagcggccctgaggccggcggcctgcacagcggctag

SEQ ID NO: 145287 - DNA, 387 bp, Artificial Sequence
  Description of Artificial Sequence: Synthetic coding sequence
atggagagcaaggaggagcgggccctgaacaacctgattgtggagaatgtgaaccaggagaatgatgagaaggatgagaaggagcaggtggccaacaagggggagcccctggccctgcccctgaatgtgtctgagtactgtgtgccccggggcaacagaagacgcttccgggtgcggcagcccatcctgcagtaccgctgggacatcatgcaccggctgggggagccccaggccaggatgagggaggagaacatggagcgcatcggggaggaggtgcggcagctgatggagaagctgcgggagaagcagctgagccacagcctgcgggctgtgtccacagatcctccccaccacgaccaccatgatgagttctgcctgatgccctag

SEQ ID NO: 145288 - DNA, 387 bp, Artificial Sequence; identical to SEQ ID NO: 145287
  Description of Artificial Sequence: Synthetic coding sequence

SEQ ID NO: 145289 - DNA, 306 bp, Artificial Sequence
  Description of Artificial Sequence: Synthetic coding sequence
atggagagcaaggaggagcgggccctgaacaacctgattgtggagaatgtgaaccaggagaatgatgagaaggatgagaaggagcaggtggccaacaagggggagcccctggccctgcccctgaatgtgtctgagtactgtgtgccccggggcaacagaagacgcttccgggtgcggcagcccatcctgcagtaccgctgggacatcatgcaccggctgggggagccccaggccaggatgagggaggagaacatggagcgcatcggggaggaggtgcggcagctgatggagaagctgcgggagtag

SEQ ID NO: 145290 - DNA, 483 bp, Artificial Sequence
  Description of Artificial Sequence: Synthetic coding sequence
atgcagaagatggtggtgtgtggggccaagtgctgcggagatgcccctcatgtggagaaccgggaggaggagacagcccgcatcggccctggggtgatggagagcaaggaggagcgggccctgaacaacctgattgtggagaatgtgaaccaggagaatgatgagaaggatgagaaggagcaggtggccaacaagggggagcccctggccctgcccctgaatgtgtctgagtactgtgtgccccggggcaacagaagacgcttccgggtgcggcagcccatcctgcagtaccgctgggacatcatgcaccggctgggggagccccaggccaggatgagggaggagaacatggagcgcatcggggaggaggtgcggcagctgatggagaagctgcgggagaagcagctgagccacagcctgcgggctgtgtccacagatcctccccaccacgaccaccatgatgagttctgcctgatgccctag

SEQ ID NO: 145291 - DNA, 378 bp, Artificial Sequence
  Description of Artificial Sequence: Synthetic coding sequence
atggagagcaaggagaagagagctgtgaacagcctgtccatggagaatgccaaccaggagaatgaggagaaggagcaggtggccaacaagggggagcccctggccctgcccctggatgctggggagtactgtgtgccccggggcaacagaagacgcttccgggtgcggcagcccatcctgcagtaccgctgggacatgatgcaccggctgggggagccccaggccaggatgagggaggagaacatggagagaattggagaggaggtgcggcagctgatggagaagctgcgggagaagcagctgagccacagcctgcgggctgtgtccacagaccccccccaccacgaccaccatgatgagttctgcctgatgccctag

SEQ ID NO: 145292 - DNA, 363 bp, Artificial Sequence
  Description of Artificial Sequence: Synthetic coding sequence
atggagagcaaggaggagctggccgccaacaacctgaatggagaaaatgcccagcaggagaatgaaggaggagagcaggcccccacccagaatgaggaggagagccgccacctgggcggcggggagggccagaagccaggcggcaacatcagaagaggccgggtgcggcggctggtgcccaacttccgctgggccatccccaacagacacatcgagcacaatgaggccagagatgatgtggagagatttgtgggccagatgatggagatcaagaggaagacccgggagcagcagatgaggcactacatgaggttccagaccccagagccagacaaccactatgacttctgcctgatcccctag

SEQ ID NO: 145293 - DNA, 363 bp, Artificial Sequence; identical to SEQ ID NO: 145292
  Description of Artificial Sequence: Synthetic coding sequence

SEQ ID NO: 145294 - DNA, 336 bp, Artificial Sequence
  Description of Artificial Sequence: Synthetic coding sequence
atggagaatgtgcccaaggagaacaaggtggtggagaaggcccctgtgcagaatgaggccccagccctgggcggcggggagtaccaggagcccggcggcaatgtgaagggcgtgtgggcccccccagcccctggctttggagaagatgtgcccaaccggctggtggacaacatcgacatgattgatggagatggagatgacatggagcgcttcatggaggagatgagggagctgcggaggaagatccgggagctgcagctgcgctacagcctgcgcatcctgattggagaccccccccaccacgaccaccatgatgagttctgcctgatgccctag

SEQ ID NO: 145295 - DNA, 336 bp, Artificial Sequence; identical to SEQ ID NO: 145294
  Description of Artificial Sequence: Synthetic coding sequence

SEQ ID NO: 145296 - DNA, 378 bp, Artificial Sequence
  Description of Artificial Sequence: Synthetic coding sequence
atggaccacaagcccctgctgcaggagcggcccccagcctacaacctggaggccggccagggcgactatgcctgtggcccccacggctacggggccatcccagctgcccctcctcctccaccctacccctacctggtgacaggcatccccacccaccacccccgggtgtacaacatccacagcaggacagtgacccgctacccagccaacagcatcgtggtggtgggcggctgccctgtgtgccgggtgggcgtgctggaggactgcttcaccttcctgggcatcttcctggccatcatcctcttccccttcggcttcatctgctgctttgccctgaggaagaggcgctgccccaactgtggggccacctttgcctag

SEQ ID NO: 145297 - DNA, 297 bp, Artificial Sequence
  Description of Artificial Sequence: Synthetic coding sequence
atggaccacaagcccctgctgcaggagcggcccccagcctacaacctggaggccggccagggcgactatgcctgtggcccccacggctacggggccatcccagctgcccctcctcctccaccctacccctacctggtgacaggcatccccacccaccacccccgggtgtacaacatccacagcaggacagtgacccgctacccagccaacagcatcgtggtggtgggcggctgccctgtgtgccgccaccagaggagctcctggctgtacacctaccccctgcgggtgtgcacctag

SEQ ID NO: 145298 - DNA, 1536 bp, Artificial Sequence
  Description of Artificial Sequence: Synthetic coding sequence
atgagccggggccctgaggaggtgaaccggctgacagagagcacctacagaaatgtgatggagcagttcaaccctggcctgaggaacctgatcaacctgggcaagaactatgagaaggctgtgaatgccatgatcctggccggcaaggcctactatgatggagtggccaagatcggggagatcgccaccggcagccctgtgtccacagagctgggccacgtgctgattgagatcagcagcacccacaagaagctgaatgaaagcctggatgagaacttcaagaagttccacaaggagatcatccacgagctggagaagaagattgagctggatgtgaagtacatgaatgccaccctgaagcgctaccagacagagcacaagaacaagctggagagcctggagaagagccaggccgagctgaagaagatccggaggaagagccagggcagcagaaatgccctgaagtatgagcacaaggagattgaatatgtggagaccgtgaccagccggcagagcgagatccagaagttcatcgcagatggctgcaaggaggccctgctggaggagaagaggcgcttctgcttcctggtggacaagcactgcggctttgccaaccacatccactactaccacctgcagagcgctgagctgctgaacagcaagctgccccgctggcaggagacctgtgtggatgccatcaaggtgcctgagaagatcatgaacatgattgaggagatcaagaccccagccagcacccctgtgtctggcaccccccaggccagccccatgattgaaagaagcaatgtggtgaggaaggactatgacaccctgagcaagtgcagccccaagatgcccccagcccccagcggccgggcctacaccagccccctgattgacatgttcaacaacccagccacagctgcccccaacagccagagggtgaacaacagcacaggcaccagcgaggaccccagcctgcagaggtctgtgtctgtggccaccggcctgaacatgatgaagaagcagaaggtgaagaccatcttcccccacacagctggcagcaacaagaccctgctgagctttgcccagggagatgtgatcaccctgctgatccctgaggagaaggatggctggctgtatggagaacatgatgtgtccaaggcccggggctggttccccagcagctacaccaagctgctggaggagaatgaaacagaagctgtgacagtgcccacccccagccccacccctgtgcgcagcatcagcacagtgaacctgtctgagaacagctctgtggtgattcctcctccagactacctggagtgcctgtccatgggcgctgctgctgacagaagagctgacagcgcccggaccaccagcaccttcaaggccccagccagcaagccagagacagctgccccaaatgatgccaacggcacagccaagccacccttcctgtctggagagaacccctttgccaccgtgaagctgcggcccaccgtgaccaatgacagaagtgcccccatcatcagatag

SEQ ID NO: 145299 - DNA, 4656 bp, Artificial Sequence
  Description of Artificial Sequence: Synthetic coding sequence
atggagaacacaggctggatgggcaagggccacaggatgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgctgctggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaagaatgtggccgggccgccggccgggcctgtggctttgcccagcccggctgcagctgccctggagaggccggggccggcagcaccaccaccaccagccctggccccccagctgcccacaccctgagcaatgccctggtgcctgggggccctgcccccccagctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacaggagaccctgctgctgaggagtggagcccctggagcgtgtgcagcctgacctgtggccagggcctgcaggtgaggaccaggagctgtgtgagcagcccctacggcaccctgtgcagcggccccctgcgggagacccggccctgcaacaacagcgccacctgccctgtgcacggcgtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaaaggagtgtgcaccatgacagctgccttcctgcacttcttcttcctgagcagcttctgctgggtgctgacagaggcctggcagagctacctggccgtcatcggccgcatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggggccagcctgtggagcagctgtgtggtgctgcccctgctggccctgacctggatgtctgctgtgctggccatgacagacagaagatctgtgctcttccaggccctgtttgctgtgttcaacagcgcccagggctttgtgatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggggaggatgccccccgggcccggcctgagggcaccccccggcgggccgccaagacagtggcccacacagagggctaccccagcttcctgtctgtggaccacagcggcctgggcctgggccctgcctacggcagcctgcagaacccctacggcatgaccttccagcccccaccacccacccccagcgcccggcaggtgcctgagcctggagagaggagcaggaccatgcccaggacagtgcccggcagcaccatgaagatgggcagcctggagaggaagaagctgcgctacagcgacctggactttgaggtgatgcacaccaggaagaggcacagcgagctgtaccacgagctgaaccagaagttccacacctttgaccgctaccgcagccagagcacagccaagcgggagaagcgctggagcgtgagcagcggcggcgctgctgagaggtctgtgtgcacagacaagcccagccctggagagcggcccagcctgagccagcacagaagacaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145300 - DNA, 4755 bp, Artificial Sequence
  Description of Artificial Sequence: Synthetic coding sequence
atggagaacacaggctggatgggcaagggccacaggatgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgctgctggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaagaatgtggccgggccgccggccgggcctgtggctttgcccagcccggctgcagctgccctggagaggccggggccggcagcaccaccaccaccagccctggccccccagctgcccacaccctgagcaatgccctggtgcctgggggccctgcccccccagctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacaggagaccctgctgctgaggagtggagcccctggagcgtgtgcagcctgacctgtggccagggcctgcaggtgaggaccaggagctgtgtgagcagcccctacggcaccctgtgcagcggccccctgcgggagacccggccctgcaacaacagcgccacctgccctgtgcacggcgtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaaaggagtgtgcaccatgacagctgccttcctgcacttcttcttcctgagcagcttctgctgggtgctgacagaggcctggcagagctacctggccgtcatcggccgcatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggcagcgagcgctgcccctgggccagcctgctgctgccctgcagcgcctgtggggctgtgcccagccccctgctgagcagcgccagcgccagaaatgccatggccagcctgtggagcagctgtgtggtgctgcccctgctggccctgacctggatgtctgctgtgctggccatgacagaccggcgctctgtgctcttccaggccctgtttgctgtgttcaacagcgcccagggcttcgtcatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggagaagatgccccccgggcccggcctgagggcaccccaagaagagctgccaagacagtggcccacacagagggctaccccagcttcctgtctgtggaccacagcggcctgggcctgggccctgcctacggcagcctgcagaacccctacggcatgaccttccagcccccaccacccaccccatctgcccggcaggtgcctgagcccggggagaggagcaggaccatgcccaggacagtgcccggcagcaccatgaagatgggcagcctggagaggaagaagctgcgctacagcgacctggactttgaggtgatgcacaccaggaagaggcacagcgagctgtaccacgagctgaaccagaagttccacacctttgaccgctaccgcagccagagcacagccaagcgggagaagcgctggagcgtgtcctctggaggagctgctgagaggtctgtgtgcacagacaagcccagccctggagagcggcccagcctgagccagcaccggcggcaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145301 - DNA, 4758 bp, Artificial Sequence
  Description of Artificial Sequence: Synthetic coding sequence
atggagaacacaggctggatgggcaagggccacaggatgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgctgctggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaagaatgtggccgggccgccggccgggcctgtggctttgcccagcccggctgcagctgccctggagaggccggggccggcagcaccaccaccaccagccctggccccccagctgcccacaccctgagcaatgccctggtgcctgggggccctgcccccccagctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacaggagaccctgctgctgaggagtggagcccctggagcgtgtgcagcctgacctgtggccagggcctgcaggtgaggaccaggagctgtgtgagcagcccctacggcaccctgtgcagcggccccctgcgggagacccggccctgcaacaacagcgccacctgccctgtgcacggcgtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaaaggagtgtgcaccatgacagctgccttcctgcacttcttcttcctgagcagcttctgctgggtgctgacagaggcctggcagagctacctggccgtcatcggccgcatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggcagcgagcgctgcccctgggccagcctgctgctgccctgcagcgcctgtggggctgtgcccagccccctgctgagcagcgccagcgccagaaatgccatggccagcctgtggagcagctgtgtggtgctgcccctgctggccctgacctggatgtctgctgtgctggccatgacagaccggcgctctgtgctcttccaggccctgtttgctgtgttcaacagcgcccagggcttcgtcatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggagaagatgccccccgggcccggcctgagggcaccccaagaagagctgccaagacagtggcccacacagagggctaccccagcttcctgtctgtggaccacagcggcctgggcctgggccctgcctacggcagcctgcagaacccctacggcatgaccttccagcccccaccacccaccccatctgcccggcaggtgcctgagcccggggagaggagcaggaccatgcccaggacagtgcccggcagcaccatgaagatgggcagcctggagaggaagaagctgcgctacagcgacctggactttgagaaggtgatgcacaccaggaagaggcacagcgagctgtaccacgagctgaaccagaagttccacacctttgaccgctaccgcagccagagcacagccaagcgggagaagcgctggagcgtgagcagcggcggcgctgctgagaggtctgtgtgcacagacaagcccagccctggagagcggcccagcctgagccagcacagaagacaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145302 - DNA, 4665 bp, Artificial Sequence
  Description of Artificial Sequence: Synthetic coding sequence
atgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgctgctggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaagaatgtggccgggccgccggccgggcctgtggctttgcccagcccggctgcagctgccctggagaggccggggccggcagcaccaccaccaccagccctggccccccagctgcccacaccctgagcaatgccctggtgcctgggggccctgcccccccagctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacaggagaccctgctgctgaggagtggagcccctggagcgtgtgcagcctgacctgtggccagggcctgcaggtgaggaccaggagctgtgtgagcagcccctacggcaccctgtgcagcggccccctgcgggagacccggccctgcaacaacagcgccacctgccctgtgcacggcgtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaaaggagtgtgcaccatgacagctgccttcctgcacttcttcttcctgagcagcttctgctgggtgctgacagaggcctggcagagctacctggccgtcatcggccgcatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggcagcgagcgctgcccctgggccagcctgctgctgccctgcagcgcctgtggggctgtgcccagccccctgctgagcagcgccagcgccagaaatgccatggccagcctgtggagcagctgtgtggtgctgcccctgctggccctgacctggatgtctgctgtgctggccatgacagaccggcgctctgtgctcttccaggccctgtttgctgtgttcaacagcgcccagggcttcgtcatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggagaagatgccccccgggcccggcctgagggcaccccaagaagagctgccaagacagtggcccacacagagggctaccccagcttcctgtctgtggaccacagcggcctgggcctgggccctgcctacggcagcctgcagaacccctacggcatgaccttccagcccccaccacccaccccatctgcccggcaggtgcctgagcccggggagaggagcaggaccatgcccaggacagtgcccggcagcaccatgaagatgggcagcctggagaggaagaagctgcgctacagcgacctggactttgagaaggtgatgcacaccaggaagaggcacagcgagctgtaccacgagctgaaccagaagttccacacctttgaccgctaccgcagccagagcacagccaaggacaagcccagccctggagagcggcccagcctgagccagcaccggcggcaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145303 - DNA, 4401 bp, Artificial Sequence
  Description of Artificial Sequence: Synthetic coding sequence
atgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgctgctggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaagaatgtggccgggccgccggccgggcctgtggctttgcccagcccggctgcagctgccctggagaggccggggccggcagcaccaccaccaccagccctggccccccagctgcccacaccctgagcaatgccctggtgcctgggggccctgcccccccagctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacaggagaccctgctgctgaggagtggagcccctggagcgtgtgcagcctgacctgtggccagggcctgcaggtgaggaccaggagctgtgtgagcagcccctacggcaccctgtgcagcggccccctgcgggagacccggccctgcaacaacagcgccacctgccctgtggagggccagtggctggagtggggcccctggggcccctgcagcaccagctgtgccaacggcacccagcagaggagcaggaagtgcagcgtggccggccctgcctgggccacctgcaccggggccctgacagacacccgggagtgcagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcaccggggaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctcatcgtgacagacaacctggtgatcagcatccagcgggagcctgtgtctgctgtgtccagtgacatcaccttccccatgaggggccggcggggcatgaaggactgggtgcgccacagtgaagatagactcttcctgcccaaggaggtgctgagcctgagcagccctgggaagccagccaccagcggggctgctggcagccctggccggggccggggccctggcaccgtgcccccaggccctggccacagccaccagaggctgctgcctgctgaccctgatgagagcagctactttgtgattggagctgtgctgtaccgcaccctgggcctcatcctgcccccaccccggccccccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaagggcgtgtgcaccatgacagctgccttcctgcacttcttcttcctgagcagcttctgctgggtgctgacagaggcctggcagagctacctggccgtgattggaaggatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggggccagcctgtggagcagctgtgtggtgctgcccctgctggccctgacctggatgtctgctgtgctggccatgacagaccggcgctctgtgctcttccaggccctgtttgctgtgttcaacagcgcccagggcttcgtcatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggagaagatgccccccgggcccggcctgagggcaccccaagaagagctgccaagacagtggcccacacagagggctaccccagcttcctgtctgtggaccacagcggcctgggcctgggccctgcctacggcagcctgcagaacccctacggcatgaccttccagcccccaccacccaccccatctgcccggcaggtgcctgagcccggggagaggagcaggaccatgcccaggacagtgcccggcagcaccatgaagatgggcagcctggagaggaagaagctgcgctacagcgacctggactttgagaaggtgatgcacaccaggaagaggcacagcgagctgtaccacgagctgaaccagaagttccacacctttgaccgctaccgcagccagagcacagccaaggacaagcccagccctggagagcggcccagcctgagccagcaccggcggcaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145304 - DNA, 4500 bp, Artificial Sequence
  Description of Artificial Sequence: Synthetic coding sequence
atgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgctgctggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaagaatgtggccgggccgccggccgggcctgtggctttgcccagcccggctgcagctgccctggagaggccggggccggcagcaccaccaccaccagccctggccccccagctgcccacaccctgagcaatgccctggtgcctgggggccctgcccccccagctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacagtgcatggagtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaagtgcagcgtggccggccctgcctgggccacctgcaccggggccctgacagacacccgggagtgcagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcaccggggaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctcatcgtgacagacaacctggtgatcagcatccagcgggagcctgtgtctgctgtgtccagtgacatcaccttccccatgaggggccggcggggcatgaaggactgggtgcgccacagtgaagatagactcttcctgcccaaggaggtgctgagcctgagcagccctgggaagccagccaccagcggggctgctggcagccctggccggggccggggccctggcaccgtgcccccaggccctggccacagccaccagaggctgctgcctgctgaccctgatgagagcagctactttgtgattggagctgtgctgtaccgcaccctgggcctcatcctgcccccaccccggccccccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaagggcgtgtgcaccatgacagctgccttcctgcacttcttcttcctgagcagcttctgctgggtgctgacagaggcctggcagagctacctggccgtgattggaaggatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggcagcgagcgctgcccctgggccagcctgctgctgccctgcagcgcctgtggggctgtgcccagccccctgctgagcagcgccagcgccagaaatgccatggccagcctgtggagcagctgtgtggtgctgcccctgctggccctgacctggatgtctgctgtgctggccatgacagacagaagatctgtgctcttccaggccctgtttgctgtgttcaacagcgcccagggctttgtgatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggggaggatgccccccgggcccggcctgagggcaccccccggcgggccgccaagacagtggcccacacagagggctaccccagcttcctgtctgtggaccacagcggcctgggcctgggccctgcctacggcagcctgcagaacccctacggcatgaccttccagcccccaccacccacccccagcgcccggcaggtgcctgagcctggagagaggagcaggaccatgcccaggacagtgcccggcagcaccatgaagatgggcagcctggagaggaagaagctgcgctacagcgacctggactttgagaaggtgatgcacaccaggaagaggcacagcgagctgtaccacgagctgaaccagaagttccacacctttgaccgctaccgcagccagagcacagccaaggacaagcccagccctggagagcggcccagcctgagccagcacagaagacaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145305 - DNA, 4503 bp, Artificial Sequence
  Description of Artificial Sequence: Synthetic coding sequence
atgctgagcctgcggggccctgacacccacggcaagggccacaggatgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgccgccggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaggagtgtggccgggctgctggccgggcctgtggctttgcccagcccggctgcagctgccctggagaggccggggccggcagcaccaccaccaccagccctggccccccagctgcccacaccctgagcaatgccctggtgcctgggggccctgcccctcctgctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacagtgcacggcgtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaaaggagtgtgcaccatgacagctgccttcctgcacttcttcttcctgagcagcttctgctgggtgctgacagaggcctggcagagctacctggccgtcatcggccgcatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggggccagcctgtggagcagctgtgtggtgctgcccctgctggccctgacctggatgtctgctgtgctggccatgacagacagaagatctgtgctcttccaggccctgtttgctgtgttcaacagcgcccagggctttgtgatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggggaggatgccccccgggcccggcctgagggcaccccccggcgggccgccaagacagtggcccacacagagggctaccccagcttcctgtctgtggaccacagcggcctgggcctgggccctgcctacggcagcctgcagaacccctacggcatgaccttccagcccccaccacccacccccagcgcccggcaggtgcctgagcctggagagaggagcaggaccatgcccaggacagtgcccggcagcaccatgaagatgggcagcctggagaggaagaagctgcgctacagcgacctggactttgagaaggtgatgcacaccaggaagaggcacagcgagctgtaccacgagctgaaccagaagttccacacctttgaccgctaccgcagccagagcacagccaagcgggagaagcgctggagcgtgtcctctggaggagctgctgagaggtctgtgtgcacagacaagcccagccctggagagcggcccagcctgagccagcaccggcggcaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145306 - DNA, 2544 bp, Artificial Sequence
  Description of Artificial Sequence: Synthetic coding sequence
gggaagggccacaggatgaccccagcctgccccctgctgctgagcgtcatcctgagcctgcggctggccacagcctttgatcctgcccccagcgcctgcagcgccctggccagcggcgtgctgtatggagccttcagcctgcaggacctcttccccaccatcgccagcggctgctcctggaccctggagaacccagaccccaccaagtacagcctgtacctgcgcttcaaccggcaggagcaggtgtgtgcccactttgccccccggctgctgcccctggaccactacctggtgaacttcacctgcctgcggcccagccctgaggaggccgtggcccaggccgagagcgaggtgggccggcctgaggaggaggaggccgaggccgccgccggcctggagctgtgcagcggcagcggccccttcaccttcctgcactttgacaagaactttgtgcagctgtgcctgtctgctgagcccagcgaggccccccggctgctggccccagctgccctggccttccgctttgtggaggtgctgctgatcaacaacaacaacagcagccagttcacctgtggggtgctgtgccgctggagcgaggagtgtggccgggctgctggccgggcctgtggctttgcccagcccggctgcagctgccctggagaggccggggccggcagcaccaccaccaccagccctggccccccagctgcccacaccctgagcaatgccctggtgcctgggggccctgcccctcctgctgaggccgacctgcacagcggcagcagcaatgacctcttcaccacagagatgagatatggagaggagcctgaggaggagcccaaggtgaagacccagtggcccaggtctgcagatgagcccggcctgtacatggcccagacaggagaccctgctgctgaggagtggagcccctggagcgtgtgcagcctgacctgtggccagggcctgcaggtgaggaccaggagctgtgtgagcagcccctacggcaccctgtgcagcggccccctgcgggagacccggccctgcaacaacagcgccacctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagtag

SEQ ID NO: 145307 - DNA, 6 bp, Artificial Sequence
  Description of Artificial Sequence: Synthetic coding sequence
atgtag

SEQ ID NO: 145308 - DNA, 3528 bp, Artificial Sequence
  Description of Artificial Sequence: Synthetic coding sequence
atggcccagacagtgcacggcgtgtgggaggagtggggctcctggagcctgtgcagccgcagctgtggccggggcagccgcagcaggatgaggacctgtgtgcccccccagcacggcggcaaggcctgtgagggccctgagctgcagaccaagctgtgcagcatggccgcctgccctgtggagggccagtggctggagtggggcccctggggcccctgcagcaccagctgtgccaacggcacccagcagaggagcaggaaatgttctgtggccggccctgcctgggccacctgcacaggagccctgacagacaccagagaatgtagcaacctggagtgcccagccacagacagcaagtggggcccctggaatgcctggagcctgtgcagcaagacctgtgacaccggctggcagaggcgcttcaggatgtgccaggccaccggcacccagggctacccctgtgagggcactggagaggaggtgaagccctgcagcgagaagcgctgcccagccttccacgagatgtgcagagatgaatatgtgatgctgatgacctggaagaaggctgctgctggggagatcatctacaacaagtgccccccaaatgccagcggcagcgccagccgccgctgcctgctgagcgcccagggcgtggcctactggggcctgcccagctttgcccgctgcatcagccatgagtaccgctacctgtacctgagcctgcgggagcacctggccaagggccagaggatgctggccggggagggcatgagccaggtggtgcgcagcctgcaggagctgctggcccggaggacctactacagcggggacctgctcttctctgtggacatcctgagaaatgtgacagacaccttcaagagggccacctacgtgcccagcgcagatgatgtgcagcgcttcttccaggtggtgtccttcatggtggatgctgagaacaaggagaagtgggatgatgcccagcaggtgtccccaggctctgtgcacctgctgcgggtggtggaggacttcatccacctggtgggagatgccctgaaggccttccagagcagcctgattgtgacagacaacctggtgatcagcatccagcgggagcctgtgtctgctgtgtccagtgacatcaccttccccatgagaggaagaagaggcatgaaggactgggtgcgccacagcgaggacaggctcttcctgcccaaggaggtgctgagcctgagcagccctgggaagccagccaccagcggggccgccggcagccctggccggggccggggccctggcaccgtgcccccaggccctggccacagccaccagaggctgctgcctgctgaccctgatgagagcagctacttcgtcatcggggctgtgctgtaccgcaccctgggcctcatcctgcccccacccaggcctcccctggccgtgaccagccgggtgatgacagtgacagtgcggccccccacccagcccccagctgagcccctcatcaccgtggagctgagctacatcatcaatggcaccacagacccccactgtgcctcctgggactacagcagagcagatgccagcagcggggactgggacacagagaactgccagaccctggagacccaggccgcccacacccgctgccagtgccagcacctgagcacctttgctgtgctggcccagccccccaaggacctgaccctggagctggccggcagccccagcgtgcccctggtgattggctgtgctgtgtcctgcatggccctgctgaccctgctggccatctatgctgccttctggaggttcatcaagtctgagaggagcatcatcctgctgaacttctgcctgagcatcctggccagcaacatcctgatcctggtgggccagagccgggtgctgagcaaaggagtgtgcaccatgacagctgccttcctgcacttcttcttcctgagcagcttctgctgggtgctgacagaggcctggcagagctacctggccgtcatcggccgcatgaggacccggctggtgaggaagcgcttcctgtgcctgggctggggcctgcctgccctggtggtggccgtgtctgtgggcttcaccaggaccaagggctacggcaccagcagctactgctggctgagcctggagggcggcctgctgtatgcctttgtgggccctgctgctgtgattgtgctggtgaacatgctgattggcatcatcgtgttcaacaagctgatggccagagatggcatcagtgacaagagcaagaagcagagagctggggccagcctgtggagcagctgtgtggtgctgcccctgctggccctgacctggatgtctgctgtgctggccatgacagacagaagatctgtgctcttccaggccctgtttgctgtgttcaacagcgcccagggctttgtgatcacagctgtgcactgcttcctgcggcgggaggtgcaggatgtggtgaagtgccagatgggcgtgtgcagagcagatgaaagtgaggacagcccagacagctgcaagaatggccagctgcagatcctgagtgactttgagaaggatgtggacctggcctgccagacagtgctcttcaaggaggtgaacacctgcaaccccagcaccatcaccggcaccctgagccggctgagcctggatgaagatgaggagcccaagagctgcctggtgggccctgagggcagcctgtccttcagccccctgcccggcaacatcctggtgcccatggccgccagccctggcctgggggagcccccaccaccccaggaggccaaccctgtgtacatgtgtggggagggcggcctgcggcagctggacctgacctggctgcggcccacagagcccggcagcgagggggactacatggtgctgcccaggaggaccctgagcctgcagcccggcggcggcggcggcggcggggaggatgccccccgggcccggcctgagggcaccccccggcgggccgccaagacagtggcccacacagagggctaccccagcttcctgtctgtggaccacagcggcctgggcctgggccctgcctacggcagcctgcagaacccctacggcatgaccttccagcccccaccacccacccccagcgcccggcaggtgcctgagcctggagagaggagcaggaccatgcccaggacagtgcccggcagcaccatgaagatgggcagcctggagaggaagaagctgcgctacagcgacctggactttgagaaggtgatgcacaccaggaagaggcacagcgagctgtaccacgagctgaaccagaagttccacacctttgaccgctaccgcagccagagcacagccaaggacaagcccagccctggagagcggcccagcctgagccagcacagaagacaccagagctggagcaccttcaagtccatgaccctgggcagcctgccccccaagccccgggagcggctgaccctgcacagagctgctgcctgggagcccacagagcccccagatggagacttccagacagaggtgtag

SEQ ID NO: 145309 - DNA, 4656 bp, Artificial Sequence; identical to SEQ ID NO: 145299
  Description of Artificial Sequence: Synthetic coding sequence

SEQ ID NO: 145310 - DNA, 2187 bp, Artificial Sequence
  Description of Artificial Sequence: Synthetic coding sequence
atgctgctgccccagggcaaggaggccgtggagggcaagaagtgccagggccggcagaggcgggccggcctgtctgaggtgtggagcaggaagctgagaaatgaaagcctgggcacctggagcacccagggctgcaagacagtgctgacagatgccagccacaccaagtgcctgtgtgaccggctgagcacctttgccatcctggcccagcagccccgggagatcatcatggagagcagcggcacccccagcgtgaccctcatcgtgggcagcggcctgagctgcctggccctgatcaccctggccgtggtgtatgctgccctgtggagatacatccgctctgagaggagcatcatcctgatcaacttctgcctgagcatcatcagcagcaacatcctgatcctggtgggccagacccagacccacaacaagagcatctgcaccaccaccacagccttcctgcacttcttcttcctggccagcttctgctgggtgctgacagaggcctggcagagctacatggctgtgacaggcaagatccgcaccaggctcatcaggaagcgcttcctgtgcctgggctggggcctgcctgccctggtggtggccacctctgtgggcttcaccaggaccaagggctatggaacagaccactactgctggctgagcctggagggcggcctgctgtatgcctttgtgggccctgctgctgctgtggtgctggtgaacatggtgattggcatcctggtgttcaacaagctggtgtccagagatggcatcctggacaagaagctgaagcaccgggccggccagatgtctgagccccacagcggcctgaccctgaagtgtgccaagtgtggggtggtgtccaccacagccctgagcgccaccacagccagcaatgccatggccagcctgtggagcagctgtgtggtgctgcccctgctggccctgacctggatgtctgctgtgctggccatgacagacaagaggagcatcctcttccagatcctgtttgctgtgtttgacagcctgcagggctttgtgattgtgatggtgcactgcatcctgcggcgggaggtgcaggatgccttccgctgccgcctgaggaactgccaggaccccatcaatgctgacagcagcagcagcttccccaatggacatgcccagatcatgacagactttgagaaggatgtggacatcgcctgccgctctgtgctgcacaaggacatcggcccctgcagagctgccaccatcaccggcaccctgagccgcatcagcctgaatgatgatgaggaggagaagggcaccaaccctgagggcctgagctacagcaccctgcctggaaatgtcatcagcaaggtgatcatccagcagcccaccggcctgcacatgcccatgtccatgaatgagctgagcaacccctgcctgaagaaggaaaattctgagctgcggaggacagtgtacctgtgcacagatgacaacctgcggggagctgacatggacatcgtgcacccccaggagaggatgatggagagtgactacatcgtgatgcccaggagctctgtgaacaaccagcccagcatgaaggaggagagcaagatgaacatcggcatggagaccctgccccatgagcggctgctgcactacaaggtgaaccctgagttcaacatgaacccccctgtgatggaccagttcaacatgaacctggagcagcacctggccccccaggagcacatgcagaacctgccctttgagcccaggacagctgtgaagaacttcatggccagcgagctggatgacaatgccggcctgagccgctcagaaacaggcagcaccatctccatgagcagcctggagaggaggaagagccgctacagcgacctggactttgagaaggtgatgcacaccaggaagaggcacatggagctgttccaggagctgaaccagaagttccagaccctggaccgcttccgggacatccccaacaccagctccatggagaacccagcccccaacaagaacccctgggacaccttcaagaaccccagcgagtacccccactacaccaccatcaacgtgctggacacagaggccaaggatgccctggagctgcggcctgctgagtgggagaagtgcctgaacctgcccctggatgtgcaggagggggacttccagacagaggtgtag

SEQ ID NO: 145311 - DNA, 4569 bp, Artificial Sequence
  Description of Artificial Sequence: Synthetic coding sequence
atgaaggctgtgaggaacctgctgatctacatcttcagcacctacctgctggtgatgtttggcttcaatgctgcccaggacttctggtgcagcaccctggtgaagggcgtcatctacggcagctacagcgtgtctgagatgttccccaagaacttcaccaactgcacctggaccctggagaacccagaccccaccaagtacagcatctacctgaagttcagcaagaaggacctgagctgcagcaacttcagcctgctggcctaccagtttgaccacttcagccatgagaagatcaaggacctgctgaggaagaaccacagcatcatgcagctgtgcaacagcaagaatgcctttgtgttcctgcagtatgacaagaacttcatccagatcagaagagtcttccccaccaacttccctggcctgcagaagaagggggaggaggaccagaagagcttctttgagttcctggtgctgaacaaggtgagccccagccagtttggctgccacgtgctgtgcacctggctggagagctgcctgaagtcagaaaatggaagaacagagagctgtggcatcatgtacaccaagtgcacctgcccccagcacctgggggagtggggcattgatgaccagagcctcatcctgctgaacaacgtggtgctgcccctgaatgagcagacagagggctgcctgacccaggagctgcagaccacccaggtgtgcaacctgacccgggaggccaagaggcctcccaaggaggagtttggcatgatgggagaccacaccatcaagagccagaggcccaggtctgtgcatgagaagagggtgccccaggagcaggctgatgctgccaagttcatggcccagacaggagagagcggcgtggaggagtggagccagtggagcacctgcagcgtgacctgtggccagggcagccaggtgaggaccaggacctgtgtgagcccctacggcacccactgcagcggccccctgcgggagagccgggtgtgcaacaacacagccctgtgccctgtgcatggagtgtgggaggagtggagcccctggagcctgtgcagcttcacctgtggccggggccagaggaccaggaccaggagctgcaccccaccccagtatggaggccggccctgtgagggccctgagacccaccacaagccctgcaacatcgccctgtgccctgtggatggccagtggcaggagtggagctcctggagccagtgcagcgtgacctgcagcaatggcacccagcagaggagccggcagtgcacagctgctgcccacggcggcagcgagtgccggggcccctgggccgagagccgggagtgctacaacccagaatgtacagccaacggccagtggaaccagtggggccactggagcggctgcagcaagagctgtgatggcggctgggagcggcgcatccgcacctgccagggcgctgtgatcaccggccagcagtgtgagggcactggagaggaggtgcggcgctgcaatgagcagcgctgcccagccccctatgagatctgcccagaggactacctgatgtccatggtgtggaagaggaccccagctggggacctggccttcaaccagtgccccctgaatgccaccggcaccaccagccgccgctgcagcctgagcctgcacggcgtggccttctgggagcagcccagctttgcccgctgcatcagcaatgagtaccgccacctgcagcacagcatcaaggagcacctggccaagggccagaggatgctggccggagatggcatgagccaggtgaccaagaccctgctggacctgacccagaggaagaacttctacgccggggacctgctgatgtctgtggagatcctgagaaatgtgacagacaccttcaagagggccagctacatcccagccagtgatggagtgcagaacttcttccagatcgtgagcaacctgctggatgaggagaacaaggagaagtgggaggatgcccagcagatctacccaggcagcattgagctgatgcaggtgattgaggacttcatccacatcgtgggcatgggcatgatggacttccagaacagctacctgatgactggaaatgtggtggccagcatccagaagctgcctgctgcctctgtgctgacagacatcaacttccccatgaagggcaggaagggcatggtggactgggccagaaattctgaggacagagtggtgatccccaagagcatcttcacccctgtgagcagcaaggagctggatgagagctctgtgtttgtgctgggcgctgtgctgtacaagaacctggacctgatcctgcccaccctgaggaactacaccgtcatcaacagcaagatcatcgtggtgaccatccggcctgagcccaagaccacagacagcttcctggagattgagctggcccacctggccaacggcaccctgaacccctactgtgtgctgtgggatgacagcaagaccaatgaaagcctgggcacctggagcacccagggctgcaagacagtgctgacagatgccagccacaccaagtgcctgtgtgaccggctgagcacctttgccatcctggcccagcagccccgggagatcatcatggagagcagcggcacccccagcgtgaccctcatcgtgggcagcggcctgagctgcctggccctgatcaccctggccgtggtgtatgctgccctgtggagatacatccgctctgagaggagcatcatcctgatcaacttctgcctgagcatcatcagcagcaacatcctgatcctggtgggccagacccagacccacaacaagagcatctgcaccaccaccacagccttcctgcacttcttcttcctggccagcttctgctgggtgctgacagaggcctggcagagctacatggctgtgacaggcaagatccgcaccaggctcatcaggaagcgcttcctgtgcctgggctggggcctgcctgccctggtggtggccacctctgtgggcttcaccaggaccaagggctatggaacagaccactactgctggctgagcctggagggcggcctgctgtatgcctttgtgggccctgctgctgctgtggtgctggtgaacatggtgattggcatcctggtgttcaacaagctggtgtccagagatggcatcctggacaagaagctgaagcaccgggccggccagatgtctgagccccacagcggcctgaccctgaagtgtgccaagtgtggggtggtgtccaccacagccctgagcgccaccacagccagcaatgccatggccagcctgtggagcagctgtgtggtgctgcccctgctggccctgacctggatgtctgctgtgctggccatgacagacaagaggagcatcctcttccagatcctgtttgctgtgtttgacagcctgcagggctttgtgattgtgatggtgcactgcatcctgcggcgggaggtgcaggatgccttccgctgccgcctgaggaactgccaggaccccatcaatgctgacagcagcagcagcttccccaatggacatgcccagatcatgacagactttgagaaggatgtggacatcgcctgccgctctgtgctgcacaaggacatcggcccctgcagagctgccaccatcaccggcaccctgagccgcatcagcctgaatgatgatgaggaggagaagggcaccaaccctgagggcctgagctacagcaccctgcctggaaatgtcatcagcaaggtgatcatccagcagcccaccggcctgcacatgcccatgtccatgaatgagctgagcaacccctgcctgaagaaggaaaattctgagctgcggaggacagtgtacctgtgcacagatgacaacctgcggggagctgacatggacatcgtgcacccccaggagaggatgatggagagtgactacatcgtgatgcccaggagctctgtgaacaaccagcccagcatgaaggaggagagcaagatgaacatcggcatggagaccctgccccatgagcggctgctgcactacaaggtgaaccctgagttcaacatgaacccccctgtgatggaccagttcaacatgaacctggagcagcacctggccccccaggagcacatgcagaacctgccctttgagcccaggacagctgtgaagaacttcatggccagcgagctggatgacaatgccggcctgagccgctcagaaacaggcagcaccatctccatgagcagcctggagaggaggaagagccgctacagcgacctggactttgagaaggtgatgcacaccaggaagaggcacatggagctgttccaggagctgaaccagaagttccagaccctggaccgcttccgggacatccccaacaccagctccatggagaacccagcccccaacaagaacccctgggacaccttcaagaaccccagcgagtacccccactacaccaccatcaacgtgctggacacagaggccaaggatgccctggagctgcggcctgctgagtgggagaagtgcctgaacctgcccctggatgtgcaggagggggacttccagacagaggtgtag

SEQ ID NO: 145312 - DNA, 1461 bp, Artificial Sequence
  Description of Artificial Sequence: Synthetic coding sequence
atggtgattggcatcctggtgttcaacaagctggtgtccagagatggcatcctggacaagaagctgaagcaccgggccggccagatgtctgagccccacagcggcctgaccctgaagtgtgccaagtgtggggtggtgtccaccacagccctgagcgccaccacagccagcaatgccatggccagcctgtggagcagctgtgtggtgctgcccctgctggccctgacctggatgtctgctgtgctggccatgacagacaagaggagcatcctcttccagatcctgtttgctgtgtttgacagcctgcagggctttgtgattgtgatggtgcactgcatcctgcggcgggaggtgcaggatgccttccgctgccgcctgaggaactgccaggaccccatcaatgctgacagcagcagcagcttccccaatggacatgcccagatcatgacagactttgagaaggatgtggacatcgcctgccgctctgtgctgcacaaggacatcggcccctgcagagctgccaccatcaccggcaccctgagccgcatcagcctgaatgatgatgaggaggagaagggcaccaaccctgagggcctgagctacagcaccctgcctggaaatgtcatcagcaaggtgatcatccagcagcccaccggcctgcacatgcccatgtccatgaatgagctgagcaacccctgcctgaagaaggaaaattctgagctgcggaggacagtgtacctgtgcacagatgacaacctgcggggagctgacatggacatcgtgcacccccaggagaggatgatggagagtgactacatcgtgatgcccaggagctctgtgaacaaccagcccagcatgaaggaggagagcaagatgaacatcggcatggagaccctgccccatgagcggctgctgcactacaaggtgaaccctgagttcaacatgaacccccctgtgatggaccagttcaacatgaacctggagcagcacctggccccccaggagcacatgcagaacctgccctttgagcccaggacagctgtgaagaacttcatggccagcgagctggatgacaatgccggcctgagccgctcagaaacaggcagcaccatctccatgagcagcctggagaggaggaagagccgctacagcgacctggactttgagaaggtgatgcacaccaggaagaggcacatggagctgttccaggagctgaaccagaagttccagaccctggaccgcttccgggacatccccaacaccagctccatggagaacccagcccccaacaagaacccctgggacaccttcaagaaccccagcgagtacccccactacaccaccatcaacgtgctggacacagaggccaaggatgccctggagctgcggcctgctgagtgggagaagtgcctgaacctgcccctggatgtgcaggagggggacttccagacagaggtgtag

SEQ ID NO: 145313 - DNA, 978 bp, Artificial Sequence
  Description of Artificial Sequence: Synthetic coding sequence
atgaaggccaaggacctgattgtgaccccagccaccatcctgaaggagaagccagaccccaacaacctggtgtttggaacagtgttcacagaccacatgctgactgtggagtggagcagcgagtttggctgggagaagccccacatcaagcccctgcagaacctgagcctgcaccctggcagcagcgccctgcactatgctgtggaggtgtttgacaaggaggagctgctggagtgcatccagcagctggtgaagctggaccaggagtgggtgccctacagcaccagcgccagcctgtacatccggcccaccttcatcggcacagagcccagcctgggcgtgaagaagcccaccaaggccctgctgtttgtgctgctgagccctgtgggcccctacttcagcagcggcaccttcaaccctgtgtccctgtgggccaaccccaagtatgtgcgggcctggaagggcggcactggagactgcaagatgggcggcaactacggcagcagcctgtttgcccagtgtgaggccgtggacaatggctgccagcaggtgctgtggctgtatggagaggaccaccagatcacagaggtgggcaccatgaacctcttcctgtactggatcaatgaagatggagaggaggagctggccaccccacccctggatggcatcatcctgcccggggtgacccggcgctgcatcctggacctggcccaccagtggggcgagttcaaggtgtctgagcgctacctgaccatggatgacctgaccacagccctggagggcaacagagtgcgggagatgtttggcagcggcacagcctgtgtggtgtgccctgtgtctgacatcctgtacaagggggagaccatccacatccccaccatggagaatggccccaagctggccagccgcatcctgagcaagctgacagacatccagtatggccgggaggagagtgactggaccatcgtgctgtcctag

SEQ ID NO: 145314 - DNA, 1158 bp, Artificial Sequence
  Description of Artificial Sequence: Synthetic coding sequence
atggactgcagcaatggctgcagcgctgagtgcaccggggagggcggcagcaaggaggtggtgggcaccttcaaggccaaggacctgattgtgaccccagccaccatcctgaaggagaagccagaccccaacaacctggtgtttggcaccgtcttcacagaccacatgctgactgtggagtggagcagcgagtttggctgggagaagccccacatcaagcccctgcagaacctgagcctgcaccctggcagcagcgccctgcactatgctgtggagctgtttgagggcctgaaggccttccggggcgtggacaacaagatccgcctcttccagcccaacctgaacatggacaggatgtacagatctgctgtgcgggccaccctgcctgtgtttgacaaggaggagctgctggagtgcatccagcagctggtgaagctggaccaggagtgggtgccctacagcaccagcgccagcctgtacatccggcccaccttcatcggcacagagcccagcctgggcgtgaagaagcccaccaaggccctgctgtttgtgctgctgagccctgtgggcccctacttcagcagcggcaccttcaaccctgtgtccctgtgggccaaccccaagtatgtgcgggcctggaagggcggcactggagactgcaagatgggcggcaactacggcagcagcctgtttgcccagtgtgaggccgtggacaatggctgccagcaggtgctgtggctgtatggagaggaccaccagatcacagaggtgggcaccatgaacctcttcctgtactggatcaatgaagatggagaggaggagctggccaccccacccctggatggcatcatcctgcccggggtgacccggcgctgcatcctggacctggcccaccagtggggcgagttcaaggtgtctgagcgctacctgaccatggatgacctgaccacagccctggagggcaacagagtgcgggagatgtttggcagcggcacagcctgtgtggtgtgccctgtgtctgacatcctgtacaagggggagaccatccacatccccaccatggagaatggccccaagctggccagccgcatcctgagcaagctgacagacatccagtatggccgggaggagagtgactggaccatcgtgctgtcctag

SEQ ID NO: 145315 - DNA, 1197 bp, Artificial Sequence
  Description of Artificial Sequence: Synthetic coding sequence
atggccagccccctgcggtctgctgctgccctggcccggcaggactgcagcaatggctgcagcgcagaatgtactggagagggcggcagcaaggaggtggtgggcaccttcaaggccaaggacctgattgtgaccccagccaccatcctgaaggagaagccagaccccaacaacctggtgtttggaacagtgttcacagaccacatgctgactgtggagtggagcagcgagtttggctgggagaagccccacatcaagcccctgcagaacctgagcctgcaccctggcagcagcgccctgcactatgctgtggagctgtttgagggcctgaaggccttccggggcgtggacaacaagatccgcctcttccagcccaacctgaacatggacaggatgtacagatctgctgtgcgggccaccctgcctgtgtttgacaaggaggagctgctggagtgcatccagcagctggtgaagctggaccaggagtgggtgccctacagcaccagcgccagcctgtacatccggcccaccttcatcggcacagagcccagcctgggcgtgaagaagcccaccaaggccctgctgtttgtgctgctgagccctgtgggcccctacttcagcagcggcaccttcaaccctgtgtccctgtgggccaaccccaagtatgtgcgggcctggaagggcggcaccggggactgcaagatgggcggcaactacggcagcagcctgtttgcccagtgtgaggccgtggacaatggctgccagcaggtgctgtggctgtatggagaggaccaccagatcacagaggtgggcaccatgaacctcttcctgtactggatcaatgaagatggagaggaggagctggccaccccacccctggatggcatcatcctgcccggggtgacccggcgctgcatcctggacctggcccaccagtggggcgagttcaaggtgtctgagcgctacctgaccatggatgacctgaccacagccctggagggcaacagagtgcgggagatgtttggaagtggcacagcctgtgtggtgtgccctgtgtctgacatcctgtacaagggggagaccatccacatccccaccatggagaatggccccaagctggccagccgcatcctgagcaagctgacagacatccagtatggccgggaggagagtgactggaccatcgtgctgtcctag

SEQ ID NO: 145316 - DNA, 1050 bp, Artificial Sequence
  Description of Artificial Sequence: Synthetic coding sequence
atgaaggactgcagcaatggctgcagcgcagaatgtactggagagggcggcagcaaggaggtggtgggcaccttcaaggccaaggacctgattgtgaccccagccaccatcctgaaggagaagccagaccccaacaacctggtgtttggaacagtgttcacagaccacatgctgactgtggagtggagcagcgagtttggctgggagaagccccacatcaagcccctgcagaacctgagcctgcaccctggcagcagcgccctgcactatgctgtggaggtgtttgacaaggaggagctgctggagtgcatccagcagctggtgaagctggaccaggagtgggtgccctacagcaccagcgccagcctgtacatccggcccaccttcatcggcacagagcccagcctgggcgtgaagaagcccaccaaggccctgctgtttgtgctgctgagccctgtgggcccctacttcagcagcggcaccttcaaccctgtgtccctgtgggccaaccccaagtatgtgcgggcctggaagggcggcactggagactgcaagatgggcggcaactacggcagcagcctgtttgcccagtgtgaggccgtggacaatggctgccagcaggtgctgtggctgtatggagaggaccaccagatcacagaggtgggcaccatgaacctcttcctgtactggatcaatgaagatggagaggaggagctggccaccccacccctggatggcatcatcctgcccggggtgacccggcgctgcatcctggacctggcccaccagtggggcgagttcaaggtgtctgagcgctacctgaccatggatgacctgaccacagccctggagggcaacagagtgcgggagatgtttggcagcggcacagcctgtgtggtgtgccctgtgtctgacatcctgtacaagggggagaccatccacatccccaccatggagaatggccccaagctggccagccgcatcctgagcaagctgacagacatccagtatggccgggaggagagtgactggaccatcgtgctgtcctag

SEQ ID NO: 145317 - DNA, 1161 bp, Artificial Sequence
  Description of Artificial Sequence: Synthetic coding sequence
atgaaggactgcagcaatggctgcagcgcagaatgtactggagagggcggcagcaaggaggtggtgggcaccttcaaggccaaggacctgattgtgaccccagccaccatcctgaaggagaagccagaccccaacaacctggtgtttggaacagtgttcacagaccacatgctgactgtggagtggagcagcgagtttggctgggagaagccccacatcaagcccctgcagaacctgagcctgcaccctggcagcagcgccctgcactatgctgtggagctgtttgagggcctgaaggccttccggggcgtggacaacaagatccgcctcttccagcccaacctgaacatggacaggatgtacagatctgctgtgcgggccaccctgcctgtgtttgacaaggaggagctgctggagtgcatccagcagctggtgaagctggaccaggagtgggtgccctacagcaccagcgccagcctgtacatccggcccaccttcatcggcacagagcccagcctgggcgtgaagaagcccaccaaggccctgctgtttgtgctgctgagccctgtgggcccctacttcagcagcggcaccttcaaccctgtgtccctgtgggccaaccccaagtatgtgcgggcctggaagggcggcaccggggactgcaagatgggcggcaactacggcagcagcctgtttgcccagtgtgaggccgtggacaatggctgccagcaggtgctgtggctgtatggagaggaccaccagatcacagaggtgggcaccatgaacctcttcctgtactggatcaatgaagatggagaggaggagctggccaccccacccctggatggcatcatcctgcccggggtgacccggcgctgcatcctggacctggcccaccagtggggcgagttcaaggtgtctgagcgctacctgaccatggatgacctgaccacagccctggagggcaacagagtgcgggagatgtttggaagtggcacagcctgtgtggtgtgccctgtgtctgacatcctgtacaagggggagaccatccacatccccaccatggagaatggccccaagctggccagccgcatcctgagcaagctgacagacatccagtatggccgggaggagagtgactggaccatcgtgctgtcctag

SEQ ID NO: 145318 - DNA, 1179 bp, Artificial Sequence
  Description of Artificial Sequence: Synthetic coding sequence
atggctgctgctgccctgggccagatctgggccaggaagctgctgtctgtgccctggctgctgtgtggccccaggagatatgccagcagcagcttcaaggctgctgacctgcagctggagatgacccagaagccccacaagaagccaggccctggagagcccctggtgtttgggaagaccttcacagaccacatgctgatggtggagtggaatgacaagggctggggccagccccgcatccagcccttccagaacctgaccctgcacccagccagcagcagcctgcactacagcctgcagctgtttgagggcatgaaggccttcaagggcaaggaccagcaggtgcggctcttccggccctggctgaacatggacaggatgctgcggagcgccatgaggctgtgcctgcccagctttgacaagctggagctgctggagtgcatcagaagactcatcgaggtggacaaggactgggtgcctgatgctgctggcaccagcctgtatgtgcggcctgtgctgattggaaatgagcccagcctgggcgtgtcccagcccacccgggccctgctgtttgtgatcctgtgccctgtgggcgcctacttccctgggggctctgtgacccctgtgtccctgctggccgaccctgccttcatccgggcctgggtgggcggcgtgggcaactacaagctgggcggcaactacggccccaccgtgctggtgcagcaggaggccctgaagaggggctgtgagcaggtgctgtggctgtatggccctgaccaccagctgacagaggtgggcaccatgaacatctttgtgtactggacccatgaagatggagtgctggagctggtgaccccacccctgaatggagtcatcctgcccggggtggtgcggcagagcctgctggacatggcccagacctggggcgagttccgggtggtggagaggaccatcaccatgaagcagctgctgcgggccctggaggagggccgggtgcgggaggtgtttggcagcggcacagcctgccaggtgtgccctgtgcaccgcatcctgtacaaggacaggaacctgcacatccccaccatggagaatggacctgagctgatcctgcgcttccagaaggagctgaaggagatccagtatggcatccgggcccacgagtggatgtttcctgtgtag

SEQ ID NO: 145319 - DNA, 1059 bp, Artificial Sequence
  Description of Artificial Sequence: Synthetic coding sequence
atgacccagaagccccacaagaagccaggccctggagagcccctggtgtttgggaagaccttcacagaccacatgctgatggtggagtggaatgacaagggctggggccagccccgcatccagcccttccagaacctgaccctgcacccagccagcagcagcctgcactacagcctgcagctgtttgagggcatgaaggccttcaagggcaaggaccagcaggtgcggctcttccggccctggctgaacatggacaggatgctgcggagcgccatgaggctgtgcctgcccagctttgacaagctggagctgctggagtgcatcagaagactcatcgaggtggacaaggactgggtgcctgatgctgctggcaccagcctgtatgtgcggcctgtgctgattggaaatgagcccagcctgggcgtgtcccagcccacccgggccctgctgtttgtgatcctgtgccctgtgggcgcctacttccctgggggctctgtgacccctgtgtccctgctggccgaccctgccttcatccgggcctgggtgggcggcgtgggcaactacaagctgggcggcaactacggccccaccgtgctggtgcagcaggaggccctgaagaggggctgtgagcaggtgctgtggctgtatggccctgaccaccagctgacagaggtgggcaccatgaacatctttgtgtactggacccatgaagatggagtgctggagctggtgaccccacccctgaatggagtcatcctgcccggggtggtgcggcagagcctgctggacatggcccagacctggggcgagttccgggtggtggagaggaccatcaccatgaagcagctgctgcgggccctggaggagggccgggtgcgggaggtgtttggcagcggcacagcctgccaggtgtgccctgtgcaccgcatcctgtacaaggacaggaacctgcacatccccaccatggagaatggacctgagctgatcctgcgcttccagaaggagctgaaggagatccagtatggcatccgggcccacgagtggatgtttcctgtgtag

SEQ ID NO: 145320 - DNA, 903 bp, Artificial Sequence
  Description of Artificial Sequence: Synthetic coding sequence
atggctgctgctgccctgggccagctgtttgagggcatgaaggccttcaagggcaaggaccagcaggtgcggctcttccggccctggctgaacatggacaggatgctgcggagcgccatgaggctgtgcctgcccagctttgacaagctggagctgctggagtgcatcagaagactcatcgaggtggacaaggactgggtgcctgatgctgctggcaccagcctgtatgtgcggcctgtgctgattggaaatgagcccagcctgggcgtgtcccagcccacccgggccctgctgtttgtgatcctgtgccctgtgggcgcctacttccctgggggctctgtgacccctgtgtccctgctggccgaccctgccttcatccgggcctgggtgggcggcgtgggcaactacaagctgggcggcaactacggccccaccgtgctggtgcagcaggaggccctgaagaggggctgtgagcaggtgctgtggctgtatggccctgaccaccagctgacagaggtgggcaccatgaacatctttgtgtactggacccatgaagatggagtgctggagctggtgaccccacccctgaatggagtcatcctgcccggggtggtgcggcagagcctgctggacatggcccagacctggggcgagttccgggtggtggagaggaccatcaccatgaagcagctgctgcgggccctggaggagggccgggtgcgggaggtgtttggcagcggcacagcctgccaggtgtgccctgtgcaccgcatcctgtacaaggacaggaacctgcacatccccaccatggagaatggacctgagctgatcctgcgcttccagaaggagctgaaggagatccagtatggcatccgggcccacgagtggatgtttcctgtgtag

SEQ ID NO: 145321 - DNA, 1338 bp, Artificial Sequence
  Description of Artificial Sequence: Synthetic coding sequence
atggctgtggccatcgctgctgcccgggtgtggaggctgaacagaggcctgagccaggccgccctgctgctgctgcggcagcccggggcccggggcctggcccggagccaccccccccggcagcagcagcagttcagcagcctggatgacaagccccagtttcctggggccagcgctgagttcatcgacaagctggagttcatccagcccaacgtcatcagcggcatccccatctacagagtgatggaccggcagggccagatcatcaaccccagcgaggacccccacctgcccaaggagaaggtgctgaagctgtacaagtccatgaccctgctgaacaccatggaccgcatcctgtatgagagccagaggcagggccgcatctccttctacatgaccaactatggagaggagggcacccacgtgggcagcgctgctgccctggacaacacagacctggtgtttggccagtaccgggaggccggcgtgctgatgtacagagactaccccctggagctgttcatggcccagtgctacggcaacatcagtgacctgggcaagggccggcagatgcctgtgcactacggctgcaaggagcggcactttgtgaccatcagcagccccctggccacccagatcccccaggccgtgggcgccgcctatgctgccaagagggccaatgccaacagagtggtgatctgctactttggagagggcgccgcctctgaaggagatgcccacgccggcttcaactttgctgccaccctggagtgccccatcatcttcttctgcagaaataatggctacgccatcagcacccccaccagcgagcagtacagaggagatggcattgctgcccggggccctggctacggcatcatgagcatccgggtggatggaaatgatgtgtttgctgtgtacaatgccaccaaggaggccaggagaagagctgtggccgagaaccagcccttcctgattgaggccatgacctacagaattggccaccacagcaccagtgatgacagcagcgcctacagatctgtggatgaggtgaactactgggacaagcaggaccaccccatcagccggctgcggcactacctgctgagccagggctggtgggatgaggagcaggagaaggcctggaggaagcagagcaggaggaaggtgatggaggcctttgagcaggccgagaggaagcccaagcccaaccccaacctgctcttcagtgatgtgtaccaggagatgcctgcccagctgaggaagcagcaggagagcctggcccggcacctgcagacctacggggagcactaccccctggaccactttgacaagtag

SEQ ID NO: 145322 - DNA, 1212 bp, Artificial Sequence
  Description of Artificial Sequence: Synthetic coding sequence
atggctgtggccatcgctgctgcccgggtgtggaggctgaacagaggcctgagccaggccgccctgctgctgctgcggcagcccggggcccggggcctggcccggagccaccccccccggcagcagcagcagttcagcagcctggatgacaagccccagtttcctggggccagcgctgagttcatcgacaagctggagttcatccagcccaacgtcatcagcggcatccccatctacagagtgatggaccggcagggccagatcatcaaccccagcgaggacccccacctgcccaaggagaaggtgctgaagctgtacaagtccatgaccctgctgaacaccatggaccgcatcctgtatgagagccagaggcagggccgcatctccttctacatgaccaactatggagaggagggcacccacgtgggcagcgctgctgccctggacaacacagacctggtgtttggccagtaccgggaggccggcgtgctgatgtacagagactaccccctggagctgttcatggcccagtgctacggcaacatcagtgacctgggcaagggccggcagatgcctgtgcactacggctgcaaggagcggcactttgtgaccatcagcagccccctggccacccagatcccccaggccgtgggcgccgcctatgctgccaagagggccaatgccaacagagtggtgatctgctactttggagagggcgccgcctctgaaggagatgcccacgccggcttcaactttgctgccaccctggagtgccccatcatcttcttctgcagaaataatggctacgccatcagcacccccaccagcgagcagtacagaggagatggcattgctgcccggggccctggctacggcatcatgagcatccgggtggatggaaatgatgtgtttgctgtgtacacagccaccggcggccccaaggcccgggcctctgtgggccccagcagccccagcaccaccggcacctgtggcatcatgatgcccctgcacgccatgggcctgtggcaccctgtgagccaccagcaggagctgtctgctgcccccaagcccaagggcaccaccaagcccatcctggagagctacctgaagagccacctgctgggccacagccgctaccagctgtacatccaccaggatgctgtgagaagagagaagccccagagcaacctgaaccgggagagcctcatctag

SEQ ID NO: 145323 - DNA, 1179 bp, Artificial Sequence
  Description of Artificial Sequence: Synthetic coding sequence
atggctgtggtggccgctgctgctggctggctgctgcggctgcgggctgctggagctgagggccactggaggcggctgcctggagctggcctggcccggggcttcctgcaccctgctgccaccgtggaggatgctgcccagaggcggcaggtggcccacttcaccttccagcctgaccctgagccccgggagtatggccagacccagaagatgaacctcttccagagcgtgaccagcgccctggacaacagcctggccaaggaccccacagctgtgatctttggagaagatgtggccttcggcggcgtcttccgctgcaccgtgggcctgcgggacaagtatggcaaggacagagtcttcaacacccccctgtgtgagcagggcatcgtgggcttcggcatcggcattgctgtgactggagccacagccatcgccgagatccagtttgctgactacatcttccctgcctttgaccagatcgtgaatgaggccgccaagtaccgctacagaagtggggacctcttcaactgtggcagcctgaccatccgcagcccctggggctgtgtgggccatggagccctgtaccacagccagagccctgaggccttctttgcccactgccccggcatcaaggtggtgatccccaggagccccttccaggccaagggcctgctgctgagctgcatcgaggacaagaacccctgcatcttctttgagcccaagatcctgtacagagctgctgctgaggaggtgcccatcgagccctacaacatccccctgagccaggccgaggtgatccaggagggcagtgatgtgaccctggtggcctggggcacccaggtgcacgtgatccgggaggtggcctccatggccaaggagaagctgggcgtgtcctgtgaggtgattgacctgcggaccatcatcccctgggatgtggacaccatctgcaagagcgtcatcaagacaggccgcctgctgatcagccatgaggcccccctgaccggcggctttgccagcgagatcagcagcacagtgcaggaggagtgcttcctgaacctggaggcccccatcagccgggtgtgtggctatgacacccccttcccccacatctttgagcccttctacatcccagacaagtggaagtgctatgatgccctgaggaagatgatcaactactag

SEQ ID NO: 145324 - DNA, 1179 bp, Artificial Sequence; identical to SEQ ID NO: 145323
  Description of Artificial Sequence: Synthetic coding sequence

SEQ ID NO: 145325 - DNA, 657 bp, Artificial Sequence
  Description of Artificial Sequence: Synthetic coding sequence
atggctgtggtggccgctgctgctggctggctgctgcggctgcgggctgctggagctgagggccactggaggcggctgcctggagctggcctggcccggggcttcctgcaccctgctgccaccgtggaggatgctgcccagaggcggcaggtggcccacttcaccttccagcctgaccctgagccccgggagtatggccagacccagaagatgaacctcttccagagcgtgaccagcgccctggacaacagcctggccaaggaccccacagctgtgatctttggagaagatgtggccttcggcggcgtcttccgctgcaccgtgggcctgcgggacaagtatggcaaggacagagtcttcaacacccccctgtgtgagcagggcatcgtgggcttcggcatcggcattgctgtgactggagccacagccatcgccgagatccagtttgctgactacatcttccctgcctttgaccagatcgtgaatgaggccgccaagtaccgctacagaagtggggacctcttcaactgtggcagcctgaccatccgcagcccctggggctgtgtgggccatggagccctgtaccacagccagagccctgaggccttctttgcccactgccccggcatcaagatcaaggtgatcagcctgtcctag

SEQ ID NO: 145326 - DNA, 969 bp, Artificial Sequence
  Description of Artificial Sequence: Synthetic coding sequence
atgaacctcttccagagcgtgaccagcgccctggacaacagcctggccaaggaccccacagctgtgatctttggagaagatgtggccttcggcggcgtcttccgctgcaccgtgggcctgcgggacaagtatggcaaggacagagtcttcaacacccccctgtgtgagcagggcatcgtgggcttcggcatcggcattgctgtgactggagccacagccatcgccgagatccagtttgctgactacatcttccctgcctttgaccagatcgtgaatgaggccgccaagtaccgctacagaagtggggacctcttcaactgtggcagcctgaccatccgcagcccctggggctgtgtgggccatggagccctgtaccacagccagagccctgaggccttctttgcccactgccccggcatcaaggtggtgatccccaggagccccttccaggccaagggcctgctgctgagctgcatcgaggacaagaacccctgcatcttctttgagcccaagatcctgtacagagctgctgctgaggaggtgcccatcgagccctacaacatccccctgagccaggccgaggtgatccaggagggcagtgatgtgaccctggtggcctggggcacccaggtgcacgtgatccgggaggtggcctccatggccaaggagaagctgggcgtgtcctgtgaggtgattgacctgcggaccatcatcccctgggatgtggacaccatctgcaagagcgtcatcaagacaggccgcctgctgatcagccatgaggcccccctgaccggcggctttgccagcgagatcagcagcacagtgcaggaggagtgcttcctgaacctggaggcccccatcagccgggtgtgtggctatgacacccccttcccccacatctttgagcccttctacatcccagacaagtggaagtgctatgatgccctgaggaagatgatcaactactag

SEQ ID NO: 145327 - DNA, 657 bp, Artificial Sequence; identical to SEQ ID NO: 145325
  Description of Artificial Sequence: Synthetic coding sequence

SEQ ID NO: 145328 - DNA, 1779 bp, Artificial Sequence
  Description of Artificial Sequence: Synthetic coding sequence
atgtctgtgtccctggtggtgatccggctggagctggccgagcacagccctgtgcctgctggcttcggcttctctgctgctgctggggagatgtctgatgaggagatcaagaagaccaccctggccagcgctgtggcctgcctggagggcaagagccctggagagaaggtggccatcatccaccagcacctgggccggcgggagatgacagatgtgatcatcgagaccatgaagagcaacccagatgagctgaagaccaccgtggaggagaggaagagcagcgaggccagccccacagcccagaggagcaaggaccacagcaaagaatgcatcaatgctgccccagacagccccagcaagcagctgcctgaccagatctccttcttcagcggcaaccccagcgtggagatcgtgcacggcatcatgcacctgtacaagaccaacaagatgaccagcctgaaggaggatgtgcggcgcagcgccatgctgtgcatcctgactgtgcctgctgccatgaccagccatgacctgatgaagtttgtggcccccttcaatgaagtcatcgagcagatgaagatcatccgggacagcacccccaaccagtacatggtgctgatcaagttccgggcccaggctgatgctgacagcttctacatgacctgcaatggccggcagttcaacagcattgaagatgatgtgtgccagctggtgtatgtggagcgggcagaggtgctgaagtcagaagatggagccagcctgcctgtgatggacctgacagagctgcccaagtgcaccgtgtgcctggagaggatggatgagagcgtgaatggcatcctgaccaccctgtgcaaccacagcttccacagccagtgcctgcagcgctgggatgacaccacctgccctgtgtgccgctactgccagaccccagagcctgtggaggagaacaagtgctttgaatgtggggtgcaggagaacctgtggatctgcctgatctgtggccacatcggctgcggccgctacgtgtccagacatgcctacaagcactttgaggagacccagcacacctacgccatgcagctgaccaaccaccgggtgtgggactatgctggggacaactacgtgcaccggctggtggccagcaagacagatggcaagatcgtgcagtatgaatgtgagggggacacctgccaggaggagaagattgatgccctgcagctggagtacagctacctgctgaccagccagctggagagccagaggatctactgggagaacaagatcgtgcgcatcgagaaggacacagctgaggagatcaacaacatgaagaccaagttcaaggagaccattgaaaaatgtgacaacctggagcacaagctgaatgacctgctgaaggagaagcagagcgtggagaggaagtgcacccagctgaacaccaaggtggccaagctgaccaatgagctgaaggaggagcaggagatgaacaagtgcctgcgggccaaccaggtgctgctgcagaacaagctgaaggaggaggagcgggtgctgaaggagacctgtgaccagaaggacctgcagatcacagagatccaggagcagctgagagatgtgatgttctacctggagacccagcagaagatcaaccacctgcctgctgagacccggcaggagatccaggagggccagatcaacatcgccatggccagcgccagcagccctgccagcagcggcggcagcggcaagctgcccagcaggaagggccgcagcaagaggggcaagtag

SEQ ID NO: 145329 - DNA, 1242 bp, Artificial Sequence
  Description of Artificial Sequence: Synthetic coding sequence
atgcacctgtacaagaccaacaagatgaccagcctgaaggaggatgtgagaagaagtgccatgctgtgcatcctgactgtgcctgctgccatgaccagccatgacctgatgaagtttgtggcccccttcaatgaggtgattgagcagatgaagatcatccgggacagcacccccaaccagtacatggtgctgatcaagttccgggcccagggcgccagcctgcctgtgatggacctgacagagctgcccaagtgcaccgtgtgcctggagaggatggatgaatctgtgaatggcatcctgaccaccctgtgcaaccacagcttccacagccagtgcctgcagcgctgggatgacaccacctgccctgtgtgccgctactgccagaccccagagcctgtggaggagaacaagtgctttgaatgtggggtgcaggagaacctgtggatctgcctgatctgtggccacatcggctgcggccgctacgtgtccagacatgcctacaagcactttgaggagacccagcacacctacgccatgcagctgaccaaccaccgggtgtgggactatgctggggacaactacgtgcaccggctggtggccagcaagacagatggcaagatcgtgcagtatgaatgtgagggggacacctgccaggaggagaagattgatgccctgcagctggagtacagctacctgctgaccagccagctggagagccagaggatctactgggagaacaagatcgtgagaattgagaaggacacagctgaggagatcaacaacatgaagaccaagttcaaggagaccatcgagaagtgtgacaacctggagcacaagctgaatgacctgctgaaggagaagcagagcgtggagaggaagtgcacccagctgaacaccaaggtggccaagctgaccaatgagctgaaggaggagcaggagatgaacaagtgcctgcgggccaaccaggtgctgctgcagaacaagctgaaggaggaggagcgggtgctgaaggagacctgtgaccagaaggacctgcagatcacagagatccaggagcagctgagagatgtgatgttctacctggagacccagcagaagatcaaccacctgcctgctgagacccggcaggagatccaggagggccagatcaacatcgccatggccagcgccagcagccctgccagcagcggcggcagcggcaagctgcccagcaggaagggccgcagcaagaggggcaagtag

SEQ ID NO: 145330 - DNA, 2136 bp, Artificial Sequence
  Description of Artificial Sequence: Synthetic coding sequence
atgaacaagggctggctggagctggagagtgaccccggcctcttcaccctgctggtggaggactttggagtgaagggcgtgcaggtggaggagatctatgacctgcagagcaagtgccagggccctgtgtatggcttcatcttcctgttcaagtggattgaggagcggcgcagcaggaggaaggtgtccaccctggtggatgacacctctgtgattgatgatgacatcgtgaacaacatgttctttgcccaccagctgatccccaacagctgtgccacccacgccctgctgtctgtgctgctgaactgcagctctgtggacctgggccccaccctgagcaggatgaaggacttcaccaagggcttcagccctgagagcaagggctacgccatcggaaatgcccctgagctggccaaggcccacaacagccacgcccggcctgagcccaggcacctgcctgagaagcagaatggcctgtctgctgtgaggaccatggaggccttccactttgtgtcctatgtgcccatcaccggccgcctgtttgagctggatggcctgaaggtgtaccccatcgaccacggcccctggggagaagatgaggagtggacagacaaggcccggcgggtcatcatggagcgcatcggcctggccacagctggcatcaagtatgaggcccggctgcacgtgctgaaggtgaaccggcagacagtgctggaggccctgcagcagctgatccgggtgacccagcctgagctgatccagacccacaagagccaggagagccagctgcctgaggagagcaagagcgccagcaacaagagccccctggtgctggaggccaacagagccccagctgccagcgagggcaaccacacagatggagctgaggaggccgccggcagctgtgcccaggcccccagccacagcccccccaacaagcccaagctggtggtgaagcccccaggcagcagcctgaatggagtgcaccccaaccccacccccatcgtgcagaggctgcctgccttcctggacaaccacaactatgccaagagccccatgcaggaggaggaggacctggccgccggcgtgggccgcagccgggtgcctgtgcggcccccccagcagtacagtgatgatgaagatgattatgaagatgatgaggaggatgatgtgcagaacaccaacagcgccctgcgctacaagggcaaaggaacaggcaagccaggggccctgagcggcagcgcagatggccagctgtctgtgctgcagcccaacaccatcaacgtgctggccgagaagctgaaggagagccagaaggacctgagcatccccctgagcatcaagaccagcagtggagctggcagccctgctgtggccgtgcccacccacagccagcccagccccacccccagcaatgaaagcacagacacagccagcgagatcggcagcgccttcaacagccccctgcggagccccatccgcagcgccaaccccacccggcccagcagccctgtgaccagccacatcagcaaggtgctgtttggagaagatgacagcctgctgcgggtggactgcatccgctacaacagagctgtgcgggacctgggccctgtgatcagcacaggcctgctgcacctggccgaggatggagtgctgagccccctggccctgacagagggcggcaagggcagcagccccagcatccggcccatccagggcagccagggcagcagcagccctgtggagaaggaggtggtggaggccacagacagccgggagaagacaggcatggtgcggcctggagagcccctgtctggagagaagtacagccccaaggagctgctggccctgctgaagtgtgtggaggccgagatcgccaactatgaggcctgcctgaaggaggaggtggagaagaggaagaagttcaagattgatgaccagaggaggacccacaactatgatgagttcatctgcaccttcatctccatgctggcccaggagggcatgctggccaacctggtggagcagaacatctctgtgagaagacggcagggcgtgtccatcggccgcctgcacaagcagaggaagccagacaggaggaagaggagccggccctacaaggccaagaggcagtag

SEQ ID NO: 145331 - DNA, 2190 bp, Artificial Sequence
  Description of Artificial Sequence: Synthetic coding sequence
atgaacaagggctggctggagctggagagtgaccccggcctcttcaccctgctggtggaggactttggagtgaagggcgtgcaggtggaggagatctatgacctgcagagcaagtgccagggccctgtgtatggcttcatcttcctgttcaagtggattgaggagcggcgcagcaggaggaaggtgtccaccctggtggatgacacctctgtgattgatgatgacatcgtgaacaacatgttctttgcccaccagctgatccccaacagctgtgccacccacgccctgctgtctgtgctgctgaactgcagctctgtggacctgggccccaccctgagcaggatgaaggacttcaccaagggcttcagccctgagagcaagggctacgccatcggaaatgcccctgagctggccaaggcccacaacagccacgcccggcctgagcccaggcacctgcctgagaagcagaatggcctgtctgctgtgaggaccatggaggccttccactttgtgtcctatgtgcccatcaccggccgcctgtttgagctggatggcctgaaggtgtaccccatcgaccacggcccctggggagaagatgaggagtggacagacaaggcccggcgggtcatcatggagcgcatcggcctggccacagctggggagccctaccatgacatccgcttcaacctgatggctgtggtgcctgaccggcgcatcaagtatgaggcccggctgcacgtgctgaaggtgaaccggcagacagtgctggaggccctgcagcagctgatccgggtgacccagcctgagctgatccagacccacaagagccaggagagccagctgcctgaggagagcaagagcgccagcaacaagagccccctggtgctggaggccaacagagccccagctgccagcgagggcaaccacacagatggagctgaggaggccgccggcagctgtgcccaggcccccagccacagcccccccaacaagcccaagctggtggtgaagcccccaggcagcagcctgaatggagtgcaccccaaccccacccccatcgtgcagaggctgcctgccttcctggacaaccacaactatgccaagagccccatgcaggaggaggaggacctggccgccggcgtgggccgcagccgggtgcctgtgcggcccccccagcagtacagtgatgatgaagatgattatgaagatgatgaggaggatgatgtgcagaacaccaacagcgccctgcgctacaagggcaaaggaacaggcaagccaggggccctgagcggcagcgcagatggccagctgtctgtgctgcagcccaacaccatcaacgtgctggccgagaagctgaaggagagccagaaggacctgagcatccccctgagcatcaagaccagcagtggagctggcagccctgctgtggccgtgcccacccacagccagcccagccccacccccagcaatgaaagcacagacacagccagcgagatcggcagcgccttcaacagccccctgcggagccccatccgcagcgccaaccccacccggcccagcagccctgtgaccagccacatcagcaaggtgctgtttggagaagatgacagcctgctgcgggtggactgcatccgctacaacagagctgtgcgggacctgggccctgtgatcagcacaggcctgctgcacctggccgaggatggagtgctgagccccctggccctgacagagggcggcaagggcagcagccccagcatccggcccatccagggcagccagggcagcagcagccctgtggagaaggaggtggtggaggccacagacagccgggagaagacaggcatggtgcggcctggagagcccctgtctggagagaagtacagccccaaggagctgctggccctgctgaagtgtgtggaggccgagatcgccaactatgaggcctgcctgaaggaggaggtggagaagaggaagaagttcaagattgatgaccagaggaggacccacaactatgatgagttcatctgcaccttcatctccatgctggcccaggagggcatgctggccaacctggtggagcagaacatctctgtgagaagacggcagggcgtgtccatcggccgcctgcacaagcagaggaagccagacaggaggaagaggagccggccctacaaggccaagaggcagtag

SEQ ID NO: 145332 - DNA, 879 bp, Artificial Sequence
  Description of Artificial Sequence: Synthetic coding sequence
atggctgtgcaggtggtgcaggccgtgcaggccgtgcacctggagagtgatgccttcctggtgtgcctgaaccacgccctgagcacagagaaggaggaggtgatgggcctgtgcattggagagctgaatgatgacaccagcagaagtgacagcaagtttgcctacacaggaacagagatgaggacagtggccgagaaggtggatgctgtgcgcatcgtgcacatccacagcgtcatcatcctgcggcggagtgacaagaggaaggacagagtggagatcagccctgagcagctgtctgctgccagcacagaagctgagcggctggccgagctgaccggccggcccatgagggtggtgggctggtaccacagccacccccacatcaccgtgtggcccagccacgtggatgtgaggacccaggccatgtaccagatgatggaccagggctttgtgggcctcatcttcagctgcttcatcgaggacaagaacaccaagacaggccgggtgctgtacacctgcttccagagcatccaggcccagaagagcagtgaatatgagcgcatcgagatccccatccacatcgtgccccacgtgaccatcggcaaggtgtgcctggagagcgctgtggagctgcccaagatcctgtgccaggaggagcaggatgcctaccgccgcatccacagcctgacccacctggacagcgtgaccaagatccacaacggcagcgtcttcaccaagaacctgtgcagccagatgtctgctgtgtctggccccctgctgcagtggctggaggaccggctggagcagaaccagcagcacctgcaggagctgcagcaggagaaggaggagctgatgcaggagctgagcagcctggagtag

SEQ ID NO: 145333 - DNA, 876 bp, Artificial Sequence
  Description of Artificial Sequence: Synthetic coding sequence
atggctgtgcaggtggtgcaggccgtgcaggccgtgcacctggagagtgatgccttcctggtgtgcctgaaccacgccctgagcacagagaaggaggaggtgatgggcctgtgcattggagagctgaatgatgacaccaggagtgacagcaagtttgcctacacaggaacagagatgaggacagtggccgagaaggtggatgctgtgagaattgtgcacatccacagcgtcatcatcctgcggcggagtgacaagaggaaggacagagtggagatcagccctgagcagctgtctgctgccagcacagaggccgagcggctggccgagctgaccggccggcccatgagggtggtgggctggtaccacagccacccccacatcaccgtgtggcccagccacgtggatgtgaggacccaggccatgtaccagatgatggaccagggctttgtgggcctcatcttcagctgcttcatcgaggacaagaacaccaagacaggccgggtgctgtacacctgcttccagagcatccaggcccagaagagcagtgaatatgaaagaattgagatccccatccacatcgtgccccacgtgaccatcggcaaggtgtgcctggagagcgctgtggagctgcccaagatcctgtgccaggaggagcaggatgcctaccgccgcatccacagcctgacccacctggacagcgtgaccaagatccacaatggatctgtgttcaccaagaacctgtgcagccagatgtctgctgtgtctggccccctgctgcagtggctggaggaccggctggagcagaaccagcagcacctgcaggagctgcagcaggagaaggaggagctgatgcaggagctgagcagcctggagtag

SEQ ID NO: 145334 - DNA, 951 bp, Artificial Sequence
  Description of Artificial Sequence: Synthetic coding sequence
atggctgtgcaggtggtgcaggccgtgcaggccgtgcacctggagagtgatgccttcctggtgtgcctgaaccacgccctgagcacagagaaggaggaggtgatgggcctgtgcattggagagctgaatgatgacaccaggagtgacagcaagtttgcctacacaggaacagagatgaggacagtggccgagaaggtggatgctgtgagaattgtgcacatccacagcgtcatcatcctgcggcggagtgacaagaggaaggacagagtggagatcagccctgagcagctgtctgctgccagcacagaggccgagcggctggccgagctgaccggccggcccatgagggtggtgggctggtaccacagccacccccacatcaccgtgtggcccagccacgtggatgtgaggacccaggccatgtaccagatgatggaccagggctttgtgggcctcatcttcagctgcttcatcgaggacaagaacaccaagacaggccgggtgctgtacacctgcttccagagcatccaggcccagaagagcagcgagagcctgcacggcccccgggacttctggagcagcagccagcacatcagcattgagggccagaaggaggaggagagatatgagcgcatcgagatccccatccacatcgtgccccacgtgaccatcggcaaggtgtgcctggagagcgctgtggagctgcccaagatcctgtgccaggaggagcaggatgcctaccgccgcatccacagcctgacccacctggacagcgtgaccaagatccacaacggcagcgtcttcaccaagaacctgtgcagccagatgtctgctgtgtctggccccctgctgcagtggctggaggaccggctggagcagaaccagcagcacctgcaggagctgcagcaggagaaggaggagctgatgcaggagctgagcagcctggagtag

SEQ ID NO: 145335 - DNA, 954 bp, Artificial Sequence
  Description of Artificial Sequence: Synthetic coding sequence
atggctgtgcaggtggtgcaggccgtgcaggccgtgcacctggagagtgatgccttcctggtgtgcctgaaccacgccctgagcacagagaaggaggaggtgatgggcctgtgcattggagaggtgagcagccccagcagaagtgacagcaagtttgcctacacaggaacagagatgaggacagtggccgagaaggtggatgctgtgagaattgtgcacatccacagcgtcatcatcctgcggcggagtgacaagaggaaggacagagtggagatcagccctgagcagctgtctgctgccagcacagagacccaccggctggccgagctgaccggccggcccatgagggtggtgggctggtaccacagccacccccacatcaccgtgtggcccagccacgtggatgtgaggacccaggccatgtaccagatgatggaccagggctttgtgggcctcatcttcagctgcttcatcgaggacaagaacaccaagacaggccgggtgctgtacacctgcttccagagcatccaggcccagaagagcagcgagagcctgcacggcccccgggacttctggagcagcagccagcacatcagcattgagggccagaaggaggaggagagatatgagcgcatcgagatccccatccacatcgtgccccacgtgaccatcggcaaggtgtgcctggagagcgctgtggagctgcccaagatcctgtgccaggaggagcaggatgcctaccgccgcatccacagcctgacccacctggacagcgtgaccaagatccacaacggcagcgaggtgttcaccaagaacctgtgcagccagatgtctgctgtgtctggccccctgctgcagtggctggaggaccggctggagcagaaccagcagcacctgcaggagctgcagcaggagaaggaggagctgatgcaggagctgagcagcctggagtag

SEQ ID NO: 145336 - DNA, 747 bp, Artificial Sequence
  Description of Artificial Sequence: Synthetic coding sequence
atggctgtgcaggtggtgcaggccgtgcaggccgtgcacctggagagtgatgccttcctggtgtgcctgaaccacgccctgagcacagagaaggaggaggtgatgggcctgtgcattggagaggtgagcagccccagcagaagtgacagcaagtttgcctacacaggaacagagatgaggacagtggccgagaaggtggatgctgtgagaattgtgcacatccacagcgtcatcatcctgcggcggagtgacaagaggaaggacagagtggagatcagccctgagcagctgtctgctgccagcacagagacccaccggctggccgagctgaccggccggcccatgagggtggtgggctggtaccacagccacccccacatcaccgtgtggcccagccacgtggatgtgaggacccaggccatgtaccagatgatggaccagggctttgtgggcctcatcttcagctgcttcatcgaggacaagaacaccaagacaggccgggtgctgtacacctgcttccagagcatccaggcccagaagagcagtgacctgacccacctggacagcgtgaccaagatccacaatggaagtgaggtgttcaccaagaacctgtgcagccagatgtctgctgtgtctggccccctgctgcagtggctggaggaccggctggagcagaaccagcagcacctgcaggagctgcagcaggagaaggaggagctgatgcaggagctgagcagcctggagtag

SEQ ID NO: 145337 - DNA, 1845 bp, Artificial Sequence
  Description of Artificial Sequence: Synthetic coding sequence
atgggcaaccagatgtctgtgccccagagggtggaggaccaggagaatgaacctgaggccgagacctaccaggacaatgccagcgccctgaatggagtgcctgtggtggtgtccacccacacagtgcagcacctggaggaggtggacctgggcatctctgtgaagacagacaacgtggccaccagcagccctgagaccacagagatctctgctgtggctgatgccaacgggaagaacctgggcaaggaggccaagccagaggccccagctgccaagagccgcttcttcctgatgctgagcaggcctgtgcccggccgcactggagaccaggccgctgacagcagcctgggctctgtgaagctggatgtgagcagcaacaaggccccagccaacaaggaccccagcgagagctggaccctgcctgtggccgccggccctggccaggacacagacaagaccccaggccacgccccagcccaggacaaggtgctgtctgctgcccgggaccccaccctgctgcccccagagactggaggagctggaggagaggcccccagcaagcccaaggacagcagcttctttgacaagttcttcaagctggacaagggccaggagaaggtgcctggggacagccagcaggaggccaagagagctgagcaccaggacaaggtggatgaggtgcccggcctgagcggccagagtgatgatgtgcctgctgggaaggacatcgtggatggcaaggagaaggagggccaggagctgggcacagctgactgcagcgtgcctggggaccctgagggcctggagacagccaaggatgacagccaggccgccgccatcgccgagaacaacaacagcatcatgtccttcttcaagaccctggtgagccccaacaaggccgagaccaagaaggaccctgaggacacagccagcaaggccgagagcgtgtgtgatggccaggccggccagaagaccagcgagatccaggcccggggcaccaagaagaagcacctggacagcccccggctgggcctggccttcaggaagttcttccgccacaagggagctgagaagagccccaccaccagcgctgacctgaagagtgacaaggccaacttcaccagccaggagacccagggcgccggcaagaacagcaagggctgcaaccccagcggccacacccagagcgtgaccaccccagagcccgccaaggagggcaccaaggagaagagcggccccaccagcctgcccctgggcaagctgttctggaagaaggtggtgtgtgagagccctgtggagatcatcaagagcaaggaggtggagagcgccctgcagacagtggacctgaatgaaggagatgctgcccctgagcccacagaggccaagctgaagcgggaggagagcaagcccaggaccagcctgatggccttcctgcggcagatgaccagtgacagcacagagaagaccatcaccccacctgagcctgagcccaccggggccccccagaagggcaaggagggcagcagcaaggacaagaagtctgctgctgagatgaacaagcagaagagcaacaagcaggaggccaaggagcccgcccagtgcacagagcaggccaccgtggacaccaacagcctgcagaatggagacaagctgcagaagaggcctgagaagaggcagcagagcctgggcggcttcttcaagggcctgggccccaagaggatgctggatgcccaggtgcagacagatcctgtgtccatcggccctgtgggcaagagcaagtacacaggaaaatgtgtgttcagccacgtgaagaagaagtggcccttccaggagtggagctactag

SEQ ID NO: 145338 - DNA, 1755 bp, Artificial Sequence
  Description of Artificial Sequence: Synthetic coding sequence
atgggcaaccagatgtctgtgccccagagggtggaggaccaggagaatgaacctgaggccgagacctaccaggacaatgccagcgccctgaatggagtgcctgtggtggtgtccacccacacagtgcagcacctggaggaggtggacctgggcatctctgtgaagacagacaacgtggccaccagcagccctgagaccacagagatctctgctgtggctgatgccaacgggaagaacctgggcaaggaggccaagccagaggccccagctgccaagagccgcttcttcctgatgctgagcaggcctgtgcccggccgcactggagaccaggccgctgacagcagcctgggctctgtgaagctggatgtgagcagcaacaaggccccagccaacaaggaccccagcgagagctggaccctgcctgtggccgccggccctggccaggacacagacaagaccccaggccacgccccagcccaggacaaggtgctgtctgctgcccgggaccccaccctgctgcccccagagactggaggagctggaggagaggcccccagcaagcccaaggacagcagcttctttgacaagttcttcaagctggacaagggccaggagaaggtgcctggggacagccagcaggaggccaagagagctgagcaccaggacaaggtggatgaggtgcccggcctgagcggccagagtgatgatgtgcctgctgggaaggacatcgtggatggcaaggagaaggagggccaggagctgggcacagctgactgcagcgtgcctggggaccctgagggcctggagacagccaaggatgacagccaggccgccgccatcgccgagaacaacaacagcatcatgtccttcttcaagaccctggtgagccccaacaaggccgagaccaagaaggaccctgaagatactggagctgagaagagccccaccaccagcgctgacctgaagagtgacaaggccaacttcaccagccaggagacccagggcgctgggaagaacagcaagggctgcaaccccagcggccacacccagagcgtgaccaccccagagcccgccaaggagggcaccaaggagaagagcggccccaccagcctgcccctgggcaagctgttctggaagaagtctgtgaaggaggacagcgtgcccactggagcagaagaaaatgtggtgtgtgagagccctgtggagatcatcaagagcaaggaggtggagagcgccctgcagacagtggacctgaatgaaggagatgctgcccctgagcccacagaggccaagctgaagcgggaggagagcaagcccaggaccagcctgatggccttcctgcggcagatgtctgtgaagggagatggcggcatcacccacagcgaggagatcaatggcaaggacagcagctgccagaccagtgacagcacagagaagaccatcaccccacctgagcctgagcccactggagccccccagaagggcaaggagggcagcagcaaggacaagaagtctgctgctgagatgaacaagcagaagagcaacaagcaggaggccaaggagcccgcccagtgcacagagcaggccaccgtggacaccaacagcctgcagaatggagacaagctgcagaagaggcctgagaagaggcagcagagcctgggcggcttcttcaagggcctgggccccaagaggatgctggatgcccaggtgcagacagatcctgtgtccatcggccctgtgggcaagagcaagtag

SEQ ID NO: 145339 - DNA, 495 bp, Artificial Sequence
  Description of Artificial Sequence: Synthetic coding sequence
atgctgagcaggcctgtgcccggccgcactggagaccaggccgctgacagcagcctgggctctgtgaagctggatgtgagcagcaacaaggccccagccaacaaggaccccagcgagagctggaccctgcctgtggccgccggccctggccaggacacagacaagaccccaggccacgccccagcccaggacaaggtgctgtctgctgcccgggaccccaccctgctgcccccagagaccggcggggccggcggggaggcccccagcaagcccaaggacagcagcttctttgacaagttcttcaagctggacaagggccaggagaaggtgcctggggacagccagcaggaggccaagagagctgagcaccaggacaaggtggatgaggtgcccggcctgagcggccagagtgatgatgtgcctgctgggaaggtgtctgtgccccgctgcatccacctggtgctgaatgcctgcagcggggccctgatgggctag

SEQ ID NO: 145340 - DNA, 753 bp, Artificial Sequence
  Description of Artificial Sequence: Synthetic coding sequence
atgtccttcttcaagaccctggtgagccccaacaaggccgagaccaagaaggaccctgaggacacagccagcaaggccgagagcgtgtgtgatggccaggccggccagaagaccagcgagatccaggcccggggcaccaagaagaagcacctggacagcccccggctgggcctggccttcaggaagttcttccgccacaagggagctgagaagagccccaccaccagcgctgacctgaagagtgacaaggccaacttcaccagccaggagacccagggcgctgggaagaacagcaagggctgcaaccccagcggccacacccagagcgtgaccaccccagagcccgccaaggagggcaccaaggagaagagcggccccaccagcctgcccctgggcaagctgttctggaagaagaccagtgacagcacagagaagaccatcaccccacctgagcctgagcccactggagccccccagaagggcaaggagggcagcagcaaggacaagaagtctgctgctgagatgaacaagcagaagagcaacaagcaggaggccaaggagcccgcccagtgcacagagcaggccaccgtggacaccaacagcctgcagaatggagacaagctgcagaagaggcctgagaagaggcagcagagcctgggcggcttcttcaagggcctgggccccaagaggatgctggatgcccaggtgcagacagatcctgtgtccatcggccctgtgggcaagagcaagtag

SEQ ID NO: 145341 - DNA, 1155 bp, Artificial Sequence
  Description of Artificial Sequence: Synthetic coding sequence
atgtctgcccccatcaagctgcagaggaccaagacccaggtgcgggccggccacttccgctggcagctggaccggggccgcacccagatcaagccccagggcaccccccggcccaagaccaggagcagcctgcccccaggcatcccccgcttcagccacctgcggcagggcgagcaggaggagaagctgccccccagccccaggacccccttctttgacaagttcttcaagctggacaagggccaggagaaggtgcctggggacagccagcaggaggccaagagagctgagcaccaggacaaggtggatgaggtgcccggcctgagcggccagagtgatgatgtgcctgctgggaaggacatcgtggatggcaaggagaaggagggccaggagctgggcacagctgactgcagcgtgcctggggaccctgagggcctggagacagccaaggatgacagccaggccgccgccatcgccgagaacaacaacagcatcatgtccttcttcaagaccctggtgagccccaacaaggccgagaccaagaaggaccctgaagatactggagctgagaagagccccaccaccagcgctgacctgaagagtgacaaggccaacttcaccagccaggagacccagggcgctgggaagaacagcaagggctgcaaccccagcggccacacccagagcgtgaccaccccagagcccgccaaggagggcaccaaggagaagagcggccccaccagcctgcccctgggcaagctgttctggaagaagtctgtgaaggaggacagcgtgcccactggagctgaggagaacaccagtgacagcacagagaagaccatcaccccacctgagcctgagcccactggagccccccagaagggcaaggagggcagcagcaaggacaagaagtctgctgctgagatgaacaagcagaagagcaacaagcaggaggccaaggagcccgcccagtgcacagagcaggccaccgtggacaccaacagcctgcagaatggagacaagctgcagaagaggcctgagaagaggcagcagagcctgggcggcttcttcaagggcctgggccccaagaggatgctggatgcccaggtgcagacagatcctgtgtccatcggccctgtgggcaagagcaagtag

SEQ ID NO: 145342 - DNA, 678 bp, Artificial Sequence
  Description of Artificial Sequence: Synthetic coding sequence
atggccggcaccggcctggtggccggggaggtggtggtggatgccctgccctactttgaccagggctatgaggcccctggggtgcgggaggccgctgctgccctggtggaggaggagacccggcgctaccggcccaccaagaactacctgagctacctgacagccccagactacagcgcctttgaaacagacatcatgagaaatgaatttgagcggctggccgcccggcagcccatcgagctgctgtccatgaagagatatgagctgcctgcccccagcagcggccagaagaatgacatcacagcctggcaggagtgtgtgaacaacagcatggcccagctggagcaccaggccgtgagaattgagaacctggagctgatgagccagcacggctgcaatgcctggaaggtgtacaatgaaaacctggtgcacatgattgagcacgcccagaaggagctgcagaagctgaggaagcacatccaggacctgaactggcagaggaagaacatgcagctgacagctggcagcaagctgcgggagatggagagcaactgggtgtccctggtgtccaagaactatgaaattgaaagaaccatcgtgcagctggagaatgagatctaccagatcaagcagcagcacggggaggccaacaaggagaacatccggcaggacttctag

SEQ ID NO: 145343 - DNA, 477 bp, Artificial Sequence
  Description of Artificial Sequence: Synthetic coding sequence
atgcagaggactggaggaggagcccccaggcctggaagaaatcatggcctgcccggcagcctgcggcagcctgaccctgtggccctgctgatgctgctggtggatgctgaccagcctgagcccatgaggtctggggcccgggagctggccctcttcctgaccccagagcctggagctgaggccaaggaggtggaggagaccatcgagggcatgctgctgcggctggaggagttctgcagcctggccgacctgatccgcagtgacaccagccagatcctggaggagaacatccctgtgctgaaggccaagctgacagagatgaggggcatctatgccaaggtggaccggctggagaagagccctgcccctgtgcctgtgacctatgagctgcccaccctgtacagaacagaggactacttccctgtggatgctggggaggcccagcaccaccccaggacctgcccccggcccctgtag

SEQ ID NO: 145344 - DNA, 570 bp, Artificial Sequence
  Description of Artificial Sequence: Synthetic coding sequence
atgcagaggactggaggaggagcccccaggcctggaagaaatcatggcctgcccggcagcctgcggcagcctgaccctgtggccctgctgatgctgctggtggatgctgaccagcctgagcccatgaggtctggggcccgggagctggccctcttcctgaccccagagcctggagctgaggccaaggaggtggaggagaccatcgagggcatgctgctgcggctggaggagttctgcagcctggccgacctgatccgcagtgacaccagccagatcctggaggagaacatccctgtgctgaaggccaagctgacagagatgaggggcatctatgccaaggtggaccggctggaggcctttgtgaagatggtgggccaccacgtggccttcctggaggctgatgtgctgcaggccgagcgggaccacggggccttcccccaggccctgcggcgctggctgggcagcgctggcctgcccagcttcaggaacctggagtgcagcggggccatcctggcccactgcaacctgcggctgagcggcagcagtgacagccctgccagcgccagctag

SEQ ID NO: 145345 - DNA, 636 bp, Artificial Sequence
  Description of Artificial Sequence: Synthetic coding sequence
atgcagaggactggaggaggagcccccaggcctggaagaaatcatggcctgcccggcagcctgcggcagcctgaccctgtggccctgctgatgctgctggtggatgctgaccagcctgagcccatgaggtctggggcccgggagctggccctcttcctgaccccagagcctggagctgaggccaaggaggtggaggagaccatcgagggcatgctgctgcggctggaggagttctgcagcctggccgacctgatccgcagtgacaccagccagatcctggaggagaacatccctgtgctgaaggccaagctgacagagatgaggggcatctatgccaaggtggaccggctggaggcctttgtgaagatggtgggccaccacgtggccttcctggaggctgatgtgctgcaggccgagcgggaccacggggccttcccccaggccctgcggcgctggctgggcagcgctggcctgcccagcttcagaaatgtggagtgcagcggcaccatcccagcccgctgcaacctgcggctgcccggcagcagtgacagccctgccagcgccagccaggtggccggcatcacagaggtgacctgcaccggggccagagatgtgcgggccgcccacacagtgtag

SEQ ID NO: 145346 - DNA, 612 bp, Artificial Sequence
  Description of Artificial Sequence: Synthetic coding sequence
atgcagaggactggaggaggagcccccaggcctggaagaaatcatggcctgcccggcagcctgcggcagcctgaccctgtggccctgctgatgctgctggtggatgctgaccagcctgagcccatgaggtctggggcccgggagctggccctcttcctgaccccagagcctggagctgaggccaaggaggtggaggagaccatcgagggcatgctgctgcggctggaggagttctgcagcctggccgacctgatccgcagtgacaccagccagatcctggaggagaacatccctgtgctgaaggccaagctgacagagatgaggggcatctatgccaaggtggaccggctggaggcctttgtgaagatggtgggccaccacgtggccttcctggaggctgatgtgctgcaggccgagcgggaccacggggccttcccccaggccctgcggcgctggctgggcagcgctggcctgcccagcttcaggaacaagagccctgcccctgtgcctgtgacctatgagctgcccaccctgtacagaacagaggactacttccctgtggatgctggggaggcccagcaccaccccaggacctgcccccggcccctgtag

SEQ ID NO: 145347 - DNA, 627 bp, Artificial Sequence
  Description of Artificial Sequence: Synthetic coding sequence
atgacaggccgggtgtgccggggctgcggcggcacagacatcgagctggatgctgcccggggagatgctgtgtgcacagcctgtggctctgtgctggaggacaacatcatcgtgtctgaggtgcagtttgtggagagcagcggcggcggcagcagcgctgtgggccagtttgtgtccctggatggagctgggaagacccccaccctgggcggcggcttccacgtgaacctgggcaaggagagccgggcccagaccctgcagaatggccgccgccacatccaccacctgggcaaccagctgcagctgaaccagcactgcctggacacagccttcaacttcttcaagatggctgtgagccgccacctgacccggggcaggaagatggcccacgtgattgctgcctgcctgtacctggtgtgcaggacagagggcaccccccacatgctgctggacctgagtgacctgctgcaggtggacagcctgcggcctgccagcttccccacctggggctgtgacctgggcgtggtgaccagggtggtgactggagtgtacccccgctgcctgcacgccagccagtggcctgtgtgtgccgcctgccctgtgaggaagttctggagcgtgggctag

SEQ ID NO: 145348 - DNA, 1689 bp, Artificial Sequence
  Description of Artificial Sequence: Synthetic coding sequence
atggctgtgagccgccacctgacccggggcaggaagatggcccacgtgattgctgcctgcctgtacctggtgtgcaggacagagggcaccccccacatgctgctggacctgagtgacctgctgcaggtgaatgtgtatgtgctgggcaagaccttcctgctgctggcccgggagctgtgcatcaatgccccagccatcgacccctgcctgtacatccccaggtttgcccacctgctggagtttggagagaagaaccacgaggtgtccatgacagccctgcggctgctgcagaggatgaagagggactggatgcacacaggccggcggcccagcggcctgtgtggggccgccctgctggtggccgccaggatgcatgacttccggaggacagtgaaggaggtgatctctgtggtgaaggtgtgtgagagcaccctgaggaagaggctgacagaatttgaggacacccccaccagccagctgaccattgatgagttcatgaagattgacctggaggaggagtgtgacccccccagctacacagctggccagaggaagctgaggatgaagcagctggagcaggtgctgagcaagaagctggaggaggtggagggggagatcagcagctaccaggatgccattgaaattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccaaggatgccagcggagatggagagctggacctgtctggaattgatgacctggagattgaccgctacatcctgaatgaaagtgaggcccgggtgaaggccgagctgtggatgagagaaaatgctgagtacctgcgggagcagcgggagaaggaggccagaattgccaaggagaaggagctgggcatctacaaggagcacaagcccaagaagagctgcaagagaagagagcccatccaggccagcacagcccgggaggccatcgagaagatgctggagcagaagaagatcagcagcaagatcaactacagcgtgctgcggggcctgagcagcgctgggggcggcagcccccaccgggaggatgcccagcctgagcacagcgccagcgccaggaagctgagcagaagaaggaccccagccagccgctctggagctgaccctgtgacctctgtgggcaagaggctgcggcccctggtgtccacccagcctgccaagaaggtggccactggagaggccctgctgcccagcagccccaccctgggcgctgagcccgcccggccccaggccgtgctggtggagagcggccctgtgtcctaccacgcagatgaggaggctgatgaggaggagccagatgaagaagatggagagccctgtgtgtctgccctgcagatgatgggcagcaatgactatggctgtgatggagatgaagatgatggctactag

SEQ ID NO: 145349 - DNA, 408 bp, Artificial Sequence
  Description of Artificial Sequence: Synthetic coding sequence
atgacagccctgcggctgctgcagaggatgaagagggactggatgcacactggaagaagacccagcggcctgtgtggggccgccctgctggtggccgccaggatgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccacccatcgaggagggcggccagacagaggcccgggagcccccccaggccagctcctgggagggccccagcaccaccaggagaagaagccagctgtggcacggctgccccggctgcggccggggcggcttcaccctgtgcccctag

SEQ ID NO: 145350 - DNA, 723 bp, Artificial Sequence
  Description of Artificial Sequence: Synthetic coding sequence
atgacaggccgggtgtgccggggctgcggcggcacagacatcgagctggatgctgcccggggagatgctgtgtgcacagcctgtggctctgtgctggaggacaacatcatcgtgtctgaggtgcagtttgtggagagcagcggcggcggcagcagcgctgtgggccagtttgtgtccctggatggagctgggaagacccccaccctgggcggcggcttccacgtgaacctgggcaaggagagccgggcccagaccctgcagaatggccgccgccacatccaccacctgggcaaccagctgcagctgaaccagcactgcctggacacagccttcaacttcttcaagatggctgtgagccgccacctgacccggggcaggaagatggcccacgtgattgctgcctgcctgtacctggtgtgcaggacagagggcaccccccacatgctgctggacctgagtgacctgctgcaggtggacagcctgcggcctgccagcttccccacctggggctgtgacctgggcgtggtgaccagggtggtgactggagtgtacccccgctgcccccgcatctctgtggccggcctgtgctgcctgcccagccaggaggtgctggtgtgcaggatgaggggcctgcatgacatgggcgtgacagtgcgggacctgtgggagtgtggcagcccctggcaggagcacctgcccatgctgggcaccgtgggctgctag

SEQ ID NO: 145351 - DNA, 555 bp, Artificial Sequence
  Description of Artificial Sequence: Synthetic coding sequence
atgacagccctgcggctgctgcagaggatgaagagggactggatgcacactggaagaagacccagcggcctgtgtggggccgccctgctggtggccgccaggatgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccatcctacacagctggccagaggaagctgaggatgaagcagctggagcaggtgctgagcaagaagctggaggaggtggagggggagatcagcagctaccaggatgccatcgagattgagctggagaacagcccccccagcagaagagagggcagaagaagacctgagagcctgccccggcccctgcggggcaaggcccctgtgcccctggtgggcggcctgagcagcggcatggccgccccagatgtggccgagggcgccagcccctgtgtgctgcggcggggctggccctag

SEQ ID NO: 145352 - DNA, 1953 bp, Artificial Sequence
  Description of Artificial Sequence: Synthetic coding sequence
atgacaggccgggtgtgccggggctgcggcggcacagacatcgagctggatgctgcccggggagatgctgtgtgcacagcctgtggctctgtgctggaggacaacatcatcgtgtctgaggtgcagtttgtggagagcagcggcggcggcagcagcgctgtgggccagtttgtgtccctggatggaagaagacacatccaccacctgggcaaccagctgcagctgaaccagcactgcctggacacagccttcaacttcttcaagatggctgtgagccgccacctgacccggggcaggaagatggcccacgtgattgctgcctgcctgtacctggtgtgcaggacagagggcaccccccacatgctgctggacctgagtgacctgctgcaggtgaatgtgtatgtgctgggcaagaccttcctgctgctggcccgggagctgtgcatcaatgccccagccatcgacccctgcctgtacatccccaggtttgcccacctgctggagtttggagagaagaaccacgaggtgtccatgacagccctgcggctgctgcagaggatgaagagggactggatgcacacaggccggcggcccagcggcctgtgtggggccgccctgctggtggccgccaggatgcatgacttccggaggacagtgaaggaggtgatctctgtggtgaaggtgtgtgagagcaccctgaggaagaggctgacagaatttgaggacacccccaccagccagctgaccattgatgagttcatgaagattgacctggaggaggagtgtgacccccccagctacacagctggccagaggaagctgaggatgaagcagctggagcaggtgctgagcaagaagctggaggaggtggagggggagatcagcagctaccaggatgccattgaaattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccaaggatgccagcggagatggagagctggacctgtctggaattgatgacctggagattgaccgctacatcctgaatgaaagtgaggcccgggtgaaggccgagctgtggatgagagaaaatgctgagtacctgcgggagcagcgggagaaggaggccagaattgccaaggagaaggagctgggcatctacaaggagcacaagcccaagaagagctgcaagagaagagagcccatccaggccagcacagcccgggaggccatcgagaagatgctggagcagaagaagatcagcagcaagatcaactacagcgtgctgcggggcctgagcagcgctgggggcggcagcccccaccgggaggatgcccagcctgagcacagcgccagcgccaggaagctgagcagaagaaggaccccagccagccgctctggagctgaccctgtgacctctgtgggcaagaggctgcggcccctggtgtccacccagcctgccaagaaggtggccactggagaggccctgctgcccagcagccccaccctgggcgctgagcccgcccggccccaggccgtgctggtggagagcggccctgtgtcctaccacgcagatgaggaggctgatgaggaggagccagatgaagaagatggagagccctgtgtgtctgccctgcagatgatgggcagcaatgactatggctgtgatggagatgaagatgatggctactag

SEQ ID NO: 145353 - DNA, 1422 bp, Artificial Sequence
  Description of Artificial Sequence: Synthetic coding sequence
atgacagccctgcggctgctgcagaggatgaagagggactggatgcacactggaagaagacccagcggcctgtgtggggccgccctgctggtggccgccaggatgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccatcctacacagctggccagaggaagctgaggatgaagcagctggagcaggtgctgagcaagaagctggaggaggtggagggggagatcagcagctaccaggatgccatcgagattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccaaggatgccagcggagatggagagctggacctgagcggcattgatgacctggagattgaccgctacatcctgaatgaaagtgaggcccgggtgaaggccgagctgtggatgagagaaaatgctgagtacctgcgggagcagcgggagaaggaggcccgcatcgccaaggagaaggagctgggcatctacaaggagcacaagcccaagaagagctgcaagaggcgggagcccatccaggccagcacagcccgggaggccatcgagaagatgctggagcagaagaagatcagcagcaagatcaactacagcgtgctgcggggcctgagcagcgctgggggcggcagcccccacagagaagatgcccagcctgagcacagcgccagcgccaggaagctgagcagaagaaggaccccagccagccgcagcggggctgaccctgtgacctctgtgggcaagaggctgcggcccctggtgtccacccagcctgccaagaaggtggccaccggggaggccctgctgcccagcagccccaccctgggcgctgagcccgcccggccccaggccgtgctggtggagagcggccctgtgtcctaccacgcagatgaggaggctgatgaggaggagccagatgaggaggatggagagccctgtgtgtctgccctgcagatgatgggcagcaatgactatggctgtgatggagatgaagatgatggctactag

SEQ ID NO: 145354 - DNA, 1755 bp, Artificial Sequence
  Description of Artificial Sequence: Synthetic coding sequence
atggctgtgagccgccacctgacccggggcaggaagatggcccacgtgattgctgcctgcctgtacctggtgtgcaggacagagggcaccccccacatgctgctggacctgagtgacctgctgcaggtgaatgtgtatgtgctgggcaagaccttcctgctgctggcccgggagctgtgcatcaatgccccagccatcgacccctgcctgtacatccccaggtttgcccacctgctggagtttggagagaagaaccacgaggtgtccatgacagccctgcggctgctgcagaggatgaagagggactggatgcacacaggccggcggcccagcggcctgtgtggggccgccctgctggtggccgccaggatgcatgacttccggaggacagtgaaggaggtgatctctgtggtgaaggtgtgtgagagcaccctgaggaagaggctgacagaatttgaggacacccccaccagccagctgaccattgatgagttcatgaagattgacctggaggaggagtgtgacccccccagctacacagctggccagaggaagctgaggatgaagcagctggagcaggtgctgagcaagaagctggaggaggtggagggggagatcagcagctaccaggatgccattgaaattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccaaggatgccagcggagatggagagctggacctgtctggaattgatgacctggagattgaccggcgggacctgtccatgccccgctgtgccaaggccaagagccagccccacttccctgtgctggcccagtacatcctgaatgaaagtgaggcccgggtgaaggccgagctgtggatgagagaaaatgctgagtacctgcgggagcagcgggagaaggaggccagaattgccaaggagaaggagctgggcatctacaaggagcacaagcccaagaagagctgcaagagaagagagcccatccaggccagcacagcccgggaggccatcgagaagatgctggagcagaagaagatcagcagcaagatcaactacagcgtgctgcggggcctgagcagcgctgggggcggcagcccccaccgggaggatgcccagcctgagcacagcgccagcgccaggaagctgagcagaagaaggaccccagccagccgctctggagctgaccctgtgacctctgtgggcaagaggctgcggcccctggtgtccacccagcctgccaagaaggtggccactggagaggccctgctgcccagcagccccaccctgggcgctgagcccgcccggccccaggccgtgctggtggagagcggccctgtgtcctaccacgcagatgaggaggctgatgaggaggagccagatgaagaagatggagagccctgtgtgtctgccctgcagatgatgggcagcaatgactatggctgtgatggagatgaagatgatggctactag

SEQ ID NO: 145355 - DNA, 1320 bp, Artificial Sequence
  Description of Artificial Sequence: Synthetic coding sequence
atgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccatcctacacagctggccagaggaagctgaggatgaagcagctggagcaggtgctgagcaagaagctggaggaggtggagggggagatcagcagctaccaggatgccatcgagattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccaaggatgccagcggagatggagagctggacctgagcggcattgatgacctggagattgaccgctacatcctgaatgaaagtgaggcccgggtgaaggccgagctgtggatgagagaaaatgctgagtacctgcgggagcagcgggagaaggaggcccgcatcgccaaggagaaggagctgggcatctacaaggagcacaagcccaagaagagctgcaagaggcgggagcccatccaggccagcacagcccgggaggccatcgagaagatgctggagcagaagaagatcagcagcaagatcaactacagcgtgctgcggggcctgagcagcgctgggggcggcagcccccacagagaagatgcccagcctgagcacagcgccagcgccaggaagctgagcagaagaaggaccccagccagccgcagcggggctgaccctgtgacctctgtgggcaagaggctgcggcccctggtgtccacccagcctgccaagaaggtggccaccggggaggccctgctgcccagcagccccaccctgggcgctgagcccgcccggccccaggccgtgctggtggagagcggccctgtgtcctaccacgcagatgaggaggctgatgaggaggagccagatgaggaggatggagagccctgtgtgtctgccctgcagatgatgggcagcaatgactatggctgtgatggagatgaagatgatggctactag

SEQ ID NO: 145356 - DNA, 2034 bp, Artificial Sequence
  Description of Artificial Sequence: Synthetic coding sequence
atgacaggccgggtgtgccggggctgcggcggcacagacatcgagctggatgctgcccggggagatgctgtgtgcacagcctgtggctctgtgctggaggacaacatcatcgtgtctgaggtgcagtttgtggagagcagcggcggcggcagcagcgctgtgggccagtttgtgtccctggatggagctgggaagacccccaccctgggcggcggcttccacgtgaacctgggcaaggagagccgggcccagaccctgcagaatggccgccgccacatccaccacctgggcaaccagctgcagctgaaccagcactgcctggacacagccttcaacttcttcaagatggctgtgagccgccacctgacccggggcaggaagatggcccacgtgattgctgcctgcctgtacctggtgtgcaggacagagggcaccccccacatgctgctggacctgagtgacctgctgcaggtgaatgtgtatgtgctgggcaagaccttcctgctgctggcccgggagctgtgcatcaatgccccagccatcgacccctgcctgtacatccccaggtttgcccacctgctggagtttggagagaagaaccacgaggtgtccatgacagccctgcggctgctgcagaggatgaagagggactggatgcacactggaagaagacccagcggcctgtgtggggccgccctgctggtggccgccaggatgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccatcctacacagctggccagaggaagctgaggatgaagcagctggagcaggtgctgagcaagaagctggaggaggtggagggggagatcagcagctaccaggatgccatcgagattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccaaggatgccagcggagatggagagctggacctgagcggcattgatgacctggagattgaccgctacatcctgaatgaaagtgaggcccgggtgaaggccgagctgtggatgagagaaaatgctgagtacctgcgggagcagcgggagaaggaggcccgcatcgccaaggagaaggagctgggcatctacaaggagcacaagcccaagaagagctgcaagaggcgggagcccatccaggccagcacagcccgggaggccatcgagaagatgctggagcagaagaagatcagcagcaagatcaactacagcgtgctgcggggcctgagcagcgctgggggcggcagcccccacagagaagatgcccagcctgagcacagcgccagcgccaggaagctgagcagaagaaggaccccagccagccgcagcggggctgaccctgtgacctctgtgggcaagaggctgcggcccctggtgtccacccagcctgccaagaaggtggccaccggggaggccctgctgcccagcagccccaccctgggcgctgagcccgcccggccccaggccgtgctggtggagagcggccctgtgtcctaccacgcagatgaggaggctgatgaggaggagccagatgaggaggatggagagccctgtgtgtctgccctgcagatgatgggcagcaatgactatggctgtgatggagatgaagatgatggctactag

SEQ ID NO: 145357 - DNA, 612 bp, Artificial Sequence
  Description of Artificial Sequence: Synthetic coding sequence
atgagagaaaatgctgagtacctgcgggagcagcgggagaaggaggcccgcatcgccaaggagaaggagctgggcatctacaaggagcacaagcccaagaagagctgcaagaggcgggagcccatccaggccagcacagcccgggaggccatcgagaagatgctggagcagaagaagatcagcagcaagatcaactacagcgtgctgcggggcctgagcagcgctgggggcggcagcccccacagagaagatgcccagcctgagcacagcgccagcgccaggaagctgagcagaagaaggaccccagccagccgcagcggggctgaccctgtgacctctgtgggcaagaggctgcggcccctggtgtccacccagcctgccaagaaggtggccaccggggaggccctgctgcccagcagccccaccctgggcgctgagcccgcccggccccaggccgtgctggtggagagcggccctgtgtcctaccacgcagatgaggaggctgatgaggaggagccagatgaggaggatggagagccctgtgtgtctgccctgcagatgatgggcagcaatgactatggctgtgatggagatgaagatgatggctactag

SEQ ID NO: 145358 - DNA, 714 bp, Artificial Sequence
  Description of Artificial Sequence: Synthetic coding sequence
atgacagccctgcggctgctgcagaggatgaagagggactggatgcacactggaagaagacccagcggcctgtgtggggccgccctgctggtggccgccaggatgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccatcctacacagctggccagaggaagctgaggatgaagcagctggagcaggtgctgagcaagaagctggaggaggtggagggggagatcagcagctaccaggatgccatcgagattgagctggagaacagccggcccaaggccaagggcggcctggccagcctggccaaggatggcagcacagaggacacagccagcagcctgtgtggggaggaggacacagaagatgaggagctggaggccgccgccagccacctgaacaaggacctgtaccgggagctgctgggcggggcccctggcagcagcgaggccgccggcagccctgagtggggcggccggcccccagccctgggcagcctgctggaccccctgcccacagctgccagcctgggcatcagtgacagcatccgggagtgcatcagcagccagagcagtgaccccagcgagttctag

SEQ ID NO: 145359 - DNA, 138 bp, Artificial Sequence
  Description of Artificial Sequence: Synthetic coding sequence
atgacagccctgcggctgctgcagaggatgaagagggactggatgcacactggaagaagacccagcggcctgtgtggggccgccctgctggtggccgccaggatgcatgacttcagaagaacagtgaaggaggtgtag

SEQ ID NO: 145360 - DNA, 45 bp, Artificial Sequence
  Description of Artificial Sequence: Synthetic coding sequence
atgacagccctgcggctgctgcagaggatgaagagggactggtag

SEQ ID NO: 145361 - DNA, 468 bp, Artificial Sequence
  Description of Artificial Sequence: Synthetic coding sequence
atgacagccctgcggctgctgcagaggatgaagagggactggatgcacactggaagaagacccagcggcctgtgtggggccgccctgctggtggccgccaggatgcatgacttcagaagaacagtgaaggaggtgatctctgtggtgaaggtgtgtgagagcaccctgaggaagaggctgacagaatttgaggacacccccaccagccagctgaccattgatgagttcatgaagattgacctggaggaggagtgtgaccccccatcctacacagctggccagaggaagctgaggatgaagcagctggagcaggtgctgagcaagaagctggaggaggtggagggggagatcagcagctaccaggatgccatcgagattgagctggagaacagccggcccaaggccaagggcggcctggccagcctggccaaggatggcagcacagaggacacagccagcagcctgtag

SEQ ID NO: 145362 - DNA, 8307 bp, Artificial Sequence
  Description of Artificial Sequence: Synthetic coding sequence
atggccctggtgctggagatcttcaccctgctggccagcatctgctgggtgtctgccaacatctttgagtaccaggtggatgcccagcccctgcggccctgtgagctgcagcgggagacagccttcctgaagcaggccgactatgtgccccagtgtgccgaggatggcagcttccagacagtgcagtgccagaatgatggccgcagctgctggtgtgtgggcgccaacggcagcgaggtgctgggcagccggcagcccggccggcctgtggcctgcctgtccttctgccagctgcagaagcagcagatcctgctgagcggctacatcaacagcacagacaccagctacctgccccagtgccaggacagcggggactatgcccctgtgcagtgtgatgtgcagcaggtgcagtgctggtgtgtggatgctgagggcatggaggtgtatggcacccggcagctgggccggcccaagcgctgccccaggagctgtgagatccggaacagaaggctgctgcatggagtgggggacaagagccccccccagtgcagcgctgagggggagttcatgcctgtgcagtgcaagtttgtgaacaccacagacatgatgatctttgacctggtgcacagctacaaccgcttcccagatgcctttgtgaccttcagcagcttccagaggcgcttccctgaggtgtctggctactgccactgtgccgacagccagggccgggagctggccgagaccggcctggagctgctgctggatgagatctatgacaccatctttgctggcctggacctgcccagcaccttcacagagaccaccctgtaccgcatcctgcagaggcgcttcctggccgtgcagagcgtcatcagcggccgcttccgctgccccaccaagtgtgaggtggagcgcttcaccgccaccagctttggccacccctacgtgcccagctgcagaagaaatggagactaccaggccgtgcagtgccagacagagggcccctgctggtgtgtggatgcccagggcaaggagatgcacggcacccggcagcagggcgagccccccagctgtgccgagggccagagctgtgccagcgagcggcagcaggccctgagccggctgtacttcggcaccagcggctacttcagccagcacgacctcttcagcagccctgagaagcgctgggccagcccccgggtggccaggtttgccaccagctgcccccccaccatcaaggagctgtttgtggacagcggcctgctgcggcccatggtggagggccagagccagcagttctctgtgtctgagaacctgctgaaggaggccatccgggccatcttccccagccggggcctggcccggctggccctgcagttcaccaccaaccccaagaggctgcagcagaacctgtttggaggcaagttcctggtgaatgtgggccagttcaacctgagcggggccctgggcacccggggcaccttcaacttcagccagttcttccagcagctgggcctggccagcttcctgaatggaggccggcaggaggacctggccaagcccctgtctgtgggcctggacagcaacagcagcacaggcaccccagaggccgccaagaaggatggcaccatgaacaagcccaccgtgggcagctttggatttgagatcaacctgcaggagaaccagaatgccctgaagttcctggccagcctgctggagctgcctgagttcctgctcttcctgcagcacgccatctctgtgcctgaagatgtggcccgggacctgggagatgtgatggagaccgtgctgagcagccagacctgtgagcagaccccagagcggctgtttgtgcccagctgcaccacagagggcagctatgaagatgtgcagtgcttctctggagagtgctggtgtgtgaacagctggggcaaggagctgcccggcagccgggtgcggggcggccagccccgctgccccacagactgtgagaagcagagggccaggatgcagagcctgatgggcagccagcctgctggcagcaccctgtttgtgcctgcctgcaccagcgagggccacttcctgcctgtgcagtgcttcaacagcgagtgctactgtgtggatgctgagggccaggccatccctggcaccaggtctgccatcggcaagcccaagaagtgccccaccccctgccagctgcagagcgagcaggccttcctgaggacagtgcaggccctgctgagcaacagctccatgctgcccaccctgagtgacacctacatcccccagtgcagcacagatggccagtggaggcaggtgcagtgcaatggacctcctgagcaggtgtttgagctgtaccagcgctgggaggcccagaacaagggccaggacctgaccccagccaagctgctggtgaagatcatgagctaccgggaggccgccagcggcaacttcagcctcttcatccagagcctgtatgaagctggccagcaggatgtgtttcctgtgctgagccagtaccccagcctgcaggatgtgcccctggccgccctggagggcaagaggccccagccccgggagaacatcctgctggagccctacctgttctggcagatcctgaatggccagctgagccagtacccaggcagctacagcgacttcagcacccccctggcccactttgacctgaggaactgctggtgtgtggatgaggccggccaggagctggagggcatgaggtctgagcccagcaagctgcccacctgccccggcagctgtgaggaggccaagctgcgggtgctgcagttcatccgggagacagaggagatcgtgtctgccagcaacagcagccgcttccccctgggggagagcttcctggtggccaagggcatccggctgagaaatgaagacctgggcctgcccccactcttccccccccgggaggcctttgctgagcagttcctgcggggcagtgactatgccatccggctggccgcccagagcaccctgtccttctaccagaggcggcgcttctccccagatgattctgctggggccagcgccctgctgcggagcggcccctacatgccccagtgtgatgccttcggctcctgggagcctgtgcagtgccacgccggcaccggccactgctggtgtgtggatgagaagggcggcttcatccctggcagcctgacagcccggagcctgcagatcccccagtgccccaccacctgtgagaagagcaggaccagcggcctgctgagctcctggaagcaggcccggagccaggagaaccccagccccaaggacctgtttgtgcctgcctgcctggagactggagaatatgcccggctgcaggccagcggggccggcacctggtgtgtggaccctgccagcggggaggagctgcggcccggcagcagcagcagcgcccagtgccccagcctgtgcaatgtgctgaagagcggcgtgctgagcagaagagtgtccccaggctacgtgcctgcctgcagagcagaagatggcggcttcagccctgtgcagtgtgaccaggcccagggcagctgctggtgtgtgatggacagcggggaggaggtgcccggcaccagggtgactggaggccagcctgcctgtgagagcccccgctgccccctgcccttcaatgccagcgaggtggtgggcggcaccatcctgtgtgagaccatcagcggccccaccggcagcgccatgcagcagtgccagctgctgtgccggcagggctcctggagcgtcttccccccaggccccctcatctgcagcctggagagcggccgctgggagagccagctgccccagccccgggcctgccagaggccccagctgtggcagaccatccagacccagggccacttccagctgcagctgcccccaggcaagatgtgcagcgctgactatgctgacctgctgcagaccttccaggtgttcatcctggatgagctgacagcccggggcttctgccagatccaggtgaagaccttcggcaccctggtgtccatccctgtgtgcaacaacagctctgtgcaggtgggctgcctgacccgggagcggctgggcgtgaatgtgacctggaagagccggctggaggacatccctgtggccagcctgcctgacctgcatgacatcgagcgggccctggtgggcaaggacctgctgggccgcttcacagacctgatccagagcggcagcttccagctgcacctggacagcaagaccttccctgctgagaccatccgcttcctgcagggcgaccacttcggcaccagccccaggacctggtttggctgcagcgagggcttctaccaggtgctgaccagcgaggccagccaggacggcctgggctgtgtgaagtgcccagagggcagctacagccaggatgaggagtgcatcccctgccctgtgggcttctaccaggagcaggccggcagcctggcctgtgtgccctgccctgtgggccgcaccaccatctctgctggggccttcagccagacccactgtgtgacagactgccagagaaatgaagctggcctgcagtgtgaccagaatggccagtaccgggccagccagaaggaccggggcagcggcaaggccttctgtgtggatggagagggccgccgcctgccctggtgggagacagaggcccccctggaggacagccagtgcctgatgatgcagaagtttgagaaggtgcctgagagcaaggtgatctttgatgccaatgcccctgtggccgtgcgcagcaaggtgcctgacagcgagttccctgtgatgcagtgcctgacagactgcacagaagatgaggcctgcagcttcttcaccgtgtccaccacagagcctgagatcagctgtgacttctacgcctggaccagtgacaacgtggcctgcatgaccagtgaccagaagagagatgccctgggcaacagcaaggccaccagctttggcagcctgcgctgccaggtgaaggtgcgcagccacggccaggacagccctgctgtgtacctgaagaagggccagggcagcaccaccaccctgcagaagagatttgagcccaccggcttccagaacatgctgagcggcctgtacaaccccatcgtgttttctgccagcggggccaacctgacagatgcccacctgttctgcctgctggcctgtgaccgggacctgtgctgtgatggctttgtgctgacccaggtgcagggcggggccatcatctgtggcctgctgagcagccccagcgtgctgctgtgcaatgtgaaggactggatggaccccagcgaggcctgggccaatgccacctgccctggggtgacctatgaccaggagagccaccaggtgatcctgcggctgggggaccaggagttcatcaagagcctgacccccctggagggcacccaggacaccttcaccaacttccagcaggtgtacctgtggaaggacagcgacatgggcagcaggcctgagagcatgggctgcaggaaggacacagtgcccaggcctgccagccccacagaagctggcctgaccacagagctgttcagccctgtggacctgaaccaggtgattgtgaatggaaaccagagcctgagcagccagaagcactggctgttcaagcacctgttcagcgcccagcaggccaacctgtggtgcctgagccgctgtgtgcaggagcacagcttctgccagctggccgagatcacagagagcgccagcctgtacttcacctgcaccctgtacccagaggcccaggtgtgtgatgacatcatggagagcaatgcccagggctgccgcctcatcctgccccagatgcccaaggccctcttcaggaagaaggtgatcctggaggacaaggtgaagaacttctacacccggctgcccttccagaagctgatgggcatcagcatccggaacaaggtgcccatgtctgagaagagcatcagcaatggcttctttgaatgtgagcggcgctgtgatgctgacccctgctgcaccggcttcggcttcctgaatgtgtcccagctgaagggcggggaggtgacctgcctgaccctgaacagcctgggcatccagatgtgcagcgaggagaatggaggagcctggaggatcctggactgtggcagcccagacatcgaggtgcacacctaccccttcggctggtaccagaagcccatcgcccagaacaatgcccccagcttctgccccctggtggtgctgcccagcctgacagagaaggtgtccctggacagctggcagagcctggccctgagctctgtggtggtggaccccagcatccgccactttgatgtggcccacgtgtccacagctgccaccagcaacttctctgctgtgcgggacctgtgcctgtctgaatgttcccagcacgaggcctgcctgatcaccaccctgcagacccagcctggagctgtgcgctgcatgttttatgctgacacccagagctgcacccacagcctgcagggccagaactgccgcctgctgctgcgggaggaggccacccacatctacaggaagccaggcatcagcctgctgtcctatgaggcctctgtgcccagcgtgcccatcagcacccacggccgcctgctgggccgcagccaggccatccaggtgggcacctcctggaagcaggtggaccagttcctgggcgtgccctatgctgccccacccctggccgagcggcgcttccaggcccctgagcccctgaactggacaggctcctgggatgccagcaagccccgggccagctgctggcagcccggcaccaggaccagcaccagccctggggtgtctgaggactgcctgtacctgaatgtgttcatcccccagaatgtggccccaaatgcctctgtgctggtgttcttccacaacaccatggaccgggaggagagcgagggctggccagccattgatggcagcttcctggccgctgtgggcaacctgattgtggtgacagccagctacagagtgggcgtgtttggcttcctgagcagcggcagcggggaggtgtctggcaactggggcctgctggaccaggtggccgccctgacctgggtgcagacccacatccggggctttggaggagacccccggcgggtgtccctggccgctgacagaggaggagcagatgtggccagcatccacctgctgacagcccgggccaccaacagccagctgttccggcgggctgtgctgatgggcggcagcgccctgagccctgctgctgtgatcagccatgagcgggcccagcagcaggccatcgccctggccaaggaggtgtcctgccccatgagcagcagccaggaggtggtgtcctgcctgcggcagaagccagccaacgtgctgaatgatgcccagaccaagctgctggccgtgtctggccccttccactactggggccctgtgattgatggccacttcctgcgggagcccccagcccgggccctgaagaggagcctgtgggtggaggtggacctgctgattggcagcagccaggatgatggcctcatcaacagagccaaggctgtgaagcagtttgaggagagccggggccgcaccagcagcaagacagccttctaccaggccctgcagaacagcctgggcggggaggacagtgatgcccgggtggaggccgccgccacctggtactacagcctggagcacagcacagatgattatgccagcttcagccgggccctggagaatgccacccgggactacttcatcatctgccccatcatcgacatggccagcgcctgggccaagagggcccggggaaatgtgttcatgtaccacgccccagaaaattatggccacggcagcctggagctgctggctgatgtgcagtttgccctgggcctgcccttctacccagcctatgagggccagttcagcctggaggagaagagcctgagcctgaagatcatgcagtacttcagccacttcatccgcagcggcaaccccaactacccctatgagttcagcaggaaggtgcccacctttgccaccccctggccagactttgtgcccagggctggaggagagaactacaaggagttcagcgagctgctgcccaaccggcagggcctgaagaaggctgactgcagcttctggagcaagtacatcagcagcctgaagaccagcgcagatggagccaagggcggccagagcgctgagagcgaggaggaggagctgacagctggcagcggcctgcgggaggacctgctgagcctgcaggagcccggcagcaagacctacagcaagtag

SEQ ID NO: 145363 - DNA, 1191 bp, Artificial Sequence
  Description of Artificial Sequence: Synthetic coding sequence
atgcctggccggggccgctgcccagactgtgtggtgacagaaggagtgctgaccaccaccttcagtgatgagggcaacctgcgggaggtgacctacagccgcagcactggagaaaatgagcaggtgagccgcagccagcagaggggcctgcggcgggtgcgggacctgtgccgggtgctgcagctgccccccacctttgaggacacagctgtggcctactaccagcaggcctaccgccacagcggcatccgggccgcccggctgcagaagaaggaggtgctggtgggctgctgcgtgctgatcacctgccggcagcacaactggcccctgaccatgggcgccatctgcaccctgctgtatgctgacctggatgtgttcagcagcacctacatgcagatcgtgaagctgctgggcctggatgtgcccagcctgtgcctggccgagctggtgaagacctactgcagcagcttcaagctgttccaggccagccccagcgtgcctgccaagtatgtggaggacaaggagaagatgctgagcaggaccatgcagctggtggagctggccaatgagacctggctggtgacaggccgccaccccctgcctgtgatcacagctgccaccttcctggcctggcagagcctgcagcctgctgaccggctgagctgcagcctggcccgcttctgcaagctggccaacgtggacctgccctacccagccagcagccggctgcaggagctgctggccgtgctgctgaggatggccgagcagctggcctggctgcgggtgctgcggctggacaagaggtctgtggtgaagcacatcggggacctgctgcagcaccggcagagcctggtgcgcagcgccttcagagatggaacagctgaggtggagacccgggagaaggagcccccaggctggggccagggccagggcgagggggaggtgggcaacaacagcctgggcctgccccagggcaagaggcctgccagccctgccctgctgctgcccccctgcatgctgaagagccccaagaggatctgccctgtgccccctgtgtccacagtgactggagatgagaacatcagtgacagcgagattgagcagtacctgcggaccccccaggaggtgcgggacttccagagggcccaggccgcccggcaggccgccacctctgtgcccaaccccccatag

SEQ ID NO: 145364 - DNA, 1698 bp, Artificial Sequence
  Description of Artificial Sequence: Synthetic coding sequence
atggccgagggcaaggccggcggggccgccggcctgtttgccaagcaggtgcagaagaagttcagccgggcccaggagaaggtgctgcagaagctgggcaaggctgtggagaccaaggatgaaagatttgagcagagcgccagcaacttctaccagcagcaggccgagggccacaagctgtacaaggacctgaagaacttcctgtctgctgtgaaggtgatgcatgagagcagcaagagggtgtctgagaccctgcaggagatctacagcagcgagtgggatggccacgaggagctgaaggccatcgtgtggaacaatgacctgctgtgggaggactatgaggagaagctggccgaccaggccgtgaggaccatggagatctacgtggcccagttcagcgagatcaaggagagaattgccaagaggggcaggaagctggtggactatgattctgcccggcaccacctggaggccgtgcagaatgccaagaagaaggatgaggccaagacagccaaggccgaggaggagttcaacaaggcccagacagtgtttgaggacctgaaccaggagctgctggaggagctgcccatcctgtacaacagcagaattggctgctacgtgaccatcttccagaacatcagcaacctgagagatgtgttctaccgggagatgagcaagctgaaccacaacctgtatgaggtgatgagcaagctggagaagcagcacagcaacaaggtgtttgtggtgaagggcctgagcagcagcagcagaagaagcctggtgatcagcccccctgtgaggacagccaccgtgagcagccccctgaccagccccaccagccccagcaccctgagcctgaagtctgagagcgagagcgtgtctgccacagaggacctggccccagatgctgcccagggcgaggacaacagcgagatcaaggagctgctggaggaggaggagattgagaaggagggcagcgaggccagcagcagtgaagaagatgagcccctgcctgcctgcaatggacctgcccaggcccagcccagccccaccacagagcgggccaagagccaggaggaggtgctgcccagcagcaccacccccagccctgggggcgccctgagccccagcggccagcccagcagcagcgccacagaggtggtgctgcggaccaggacagccagcgagggcagcgagcagcccaagaagagggccagcatccagaggaccagcgccccacccagcaggcctcctccaccccgggccacagccagcccccggcccagcagcggcaacatccccagcagccccacagccagcggcggcggcagccccaccagcccccgggccagcctgggcaccggcacagccagccccaggaccagcctggaggtgagccccaaccctgagcccccagagaagcctgtgaggaccccagaggccaaggaaaatgaaaacatccacaaccagaaccctgaggagctgtgcaccagccccaccctgatgaccagccaggtggccagcgagcccggggaggccaagaagatggaggacaaggagaaggacaacaagctgatcagcgccaacagcagcgagggccaggaccagctgcaggtgtccatggtgcctgagaacaacaacctgacagcccctgagccccaggaggaggtgtccaccagcgagaacccccagctgtag

SEQ ID NO: 145365 - DNA, 1602 bp, Artificial Sequence
  Description of Artificial Sequence: Synthetic coding sequence
atggccgagggcaaggccggcggggccgccggcctgtttgccaagcaggtgcagaagaagttcagccgggcccaggagaaggtgctgcagaagctgggcaaggctgtggagaccaaggatgaaagatttgagcagagcgccagcaacttctaccagcagcaggccgagggccacaagctgtacaaggacctgaagaacttcctgtctgctgtgaaggtgatgcatgagagcagcaagagggtgtctgagaccctgcaggagatctacagcagcgagtgggatggccacgaggagctgaaggccatcgtgtgggagagaattgccaagaggggcaggaagctggtggactatgattctgcccggcaccacctggaggccgtgcagaatgccaagaagaaggatgaggccaagacagccaaggccgaggaggagttcaacaaggcccagacagtgtttgaggacctgaaccaggagctgctggaggagctgcccatcctgtacaacagcagaattggctgctacgtgaccatcttccagaacatcagcaacctgagagatgtgttctaccgggagatgagcaagctgaaccacaacctgtatgaggtgatgagcaagctggagaagcagcacagcaacaaggtgtttgtggtgaagggcctgagcagcagcagcagaagaagcctggtgatcagcccccctgtgaggacagccaccgtgagcagccccctgaccagccccaccagccccagcaccctgagcctgaagtctgagagcgagagcgtgtctgccacagaggacctggccccagatgctgcccagggcgaggacaacagcgagatcaaggagctgctggaggaggaggagattgagaaggagggcagcgaggccagcagcagtgaagaagatgagcccctgcctgcctgcaatggacctgcccaggcccagcccagccccaccacagagcgggccaagagccaggaggaggtgctgcccagcagcaccacccccagccctgggggcgccctgagccccagcggccagcccagcagcagcgccacagaggtggtgctgcggaccaggacagccagcgagggcagcgagcagcccaagaagagggccagcatccagaggaccagcgccccacccagcaggcctcctccaccccgggccacagccagcccccggcccagcagcggcaacatccccagcagccccacagccagcggcggcggcagccccaccagcccccgggccagcctgggcaccggcacagccagccccaggaccagcctggaggtgagccccaaccctgagcccccagagaagcctgtgaggaccccagaggccaaggaaaatgaaaacatccacaaccagaaccctgaggagctgtgcaccagccccaccctgatgaccagccaggtggccagcgagcccggggaggccaagaagatggaggacaaggagaaggacaacaagctgatcagcgccaacagcagcgagggccaggaccagctgcaggtgtccatggtgcctgagaacaacaacctgacagcccctgagccccaggaggaggtgtccaccagcgagaacccccagctgtag

SEQ ID NO: 145366 - DNA, 1620 bp, Artificial Sequence
  Description of Artificial Sequence: Synthetic coding sequence
atggtgctgcagaagctgggcaaggctgtggagaccaaggatgaaagatttgagcagagcgccagcaacttctaccagcagcaggccgagggccacaagctgtacaaggacctgaagaacttcctgtctgctgtgaaggtgatgcatgagagcagcaagagggtgtctgagaccctgcaggagatctacagcagcgagtgggatggccacgaggagctgaaggccatcgtgtggaacaatgacctgctgtgggaggactatgaggagaagctggccgaccaggccgtgaggaccatggagatctacgtggcccagttcagcgagatcaaggagagaattgccaagaggggcaggaagctggtggactatgattctgcccggcaccacctggaggccgtgcagaatgccaagaagaaggatgaggccaagacagccaaggccgaggaggagttcaacaaggcccagacagtgtttgaggacctgaaccaggagctgctggaggagctgcccatcctgtacaacagcagaattggctgctacgtgaccatcttccagaacatcagcaacctgagagatgtgttctaccgggagatgagcaagctgaaccacaacctgtatgaggtgatgagcaagctggagaagcagcacagcaacaaggtgtttgtggtgaagggcctgagcagcagcagcagaagaagcctggtgatcagcccccctgtgaggacagccaccgtgagcagccccctgaccagccccaccagccccagcaccctgagcctgaagtctgagagcgagagcgtgtctgccacagaggacctggccccagatgctgcccagggcgaggacaacagcgagatcaaggagctgctggaggaggaggagattgagaaggagggcagcgaggccagcagcagtgaagaagatgagcccctgcctgcctgcaatggacctgcccaggcccagcccagccccaccacagagcgggccaagagccaggaggaggtgctgcccagcagcaccacccccagccctgggggcgccctgagccccagcggccagcccagcagcagcgccacagaggtggtgctgcggaccaggacagccagcgagggcagcgagcagcccaagaagagggccagcatccagaggaccagcgccccacccagcaggcctcctccaccccgggccacagccagcccccggcccagcagcggcaacatccccagcagccccacagccagcggcggcggcagccccaccagcccccgggccagcctgggcaccggcacagccagccccaggaccagcctggaggtgagccccaaccctgagcccccagagaagcctgtgaggaccccagaggccaaggaaaatgaaaacatccacaaccagaaccctgaggagctgtgcaccagccccaccctgatgaccagccaggtggccagcgagcccggggaggccaagaagatggaggacaaggagaaggacaacaagctgatcagcgccaacagcagcgagggccaggaccagctgcaggtgtccatggtgcctgagaacaacaacctgacagcccctgagccccaggaggaggtgtccaccagcgagaacccccagctgtag

SEQ ID NO: 145367 - DNA, 762 bp, Artificial Sequence
  Description of Artificial Sequence: Synthetic coding sequence
atgtcctggatccccttcaagattggccagcccaagaagcagatcgtgcccaagacagtggagcgggactttgagcgggagtatggcaagctgcagcagctggaggagcagacccggcggctgcagaaggacatgaagaagagcacagatgctgacctggccatgagcaagtctgctgtgaagatcagcctggacctgctgagcaaccccctgtgtgagcaggaccaggacctgctgaacatggtgacagccctggacacagccatgaagaggatggatgccttcaaccaggagaaggtgaaccagatccagaagacagtcatcgagcccctgaagaagtttggcagcgtcttccccagcctgaacatggctgtgaagagaagagagcaggccctgcaggactaccgccgcctgcaggccaaggtggagaagtatgaggagaaggagaagacaggccctgtgctggccaagctgcaccaggcccgggaggagctgcggcctgtgcgggaggactttgaggccaagaaccggcagctgctggaggagatgccccgcttctacggcagccggctggactacttccagcccagctttgagagcctcatccgggcccaggtggtgtactacagcgagatgcacaagatctttggagacctgagccaccagctggaccagcccggccacagtgatgagcagcgggagcgggagaatgaggccaagctgtctgagctgcgggccctgagcatcgtggctgatgactag

SEQ ID NO: 145368 - DNA, 600 bp, Artificial Sequence
  Description of Artificial Sequence: Synthetic coding sequence
atgagcaagtctgctgtgaagatcagcctggacctgctgagcaaccccctgtgtgagcaggaccaggacctgctgaacatggtgacagccctggacacagccatgaagaggatggatgccttcaaccaggagaaggtgaaccagatccagaagacagtcatcgagcccctgaagaagtttggcagcgtcttccccagcctgaacatggctgtgaagagaagagagcaggccctgcaggactaccgccgcctgcaggccaaggtggagaagtatgaggagaaggagaagacaggccctgtgctggccaagctgcaccaggcccgggaggagctgcggcctgtgcgggaggactttgaggccaagaaccggcagctgctggaggagatgccccgcttctacggcagccggctggactacttccagcccagctttgagagcctcatccgggcccaggtggtgtactacagcgagatgcacaagatctttggagacctgagccaccagctggaccagcccggccacagtgatgagcagcgggagcgggagaatgaggccaagctgtctgagctgcgggccctgagcatcgtggctgatgactag

SEQ ID NO: 145369 - DNA, 2343 bp, Artificial Sequence
  Description of Artificial Sequence: Synthetic coding sequence
atgacccacaccaggaggaagagcctgcccatgctgagcagcggcctgactggaagaagagagcccctgcagatggaggacagcaacatggagcagggcgtggagggcgtggagcccggcatgcctgagagccctggccacctgactggaagaaggaagaactaccccctgaggaagaggcccctggtgcctgagaagcccaaggcctgcaaggtgctgctgacccggctggagaatgtggccggccccaggtctgcagatgaagcagatgagctgcccccagacctgcccaagccacccagccctgcccccagcagtgaagatcctggcctggcccagcccaggaagaggcggctggccagcctgaatgctgaggccctgaacaacctgctgctggagcgggaggacaccagcagcctggccggcacccggcgcagccgggccggggacccccacaggagccgggaccgggaccgggccactggaggctggagcagcagcaagaagaggccccggctgggggacctgggcggcggcagccgggacctgagccctgagcccgccccagatgagggccccaggagagatggagaccctgcccccaagaggctggccagcctgaatgctgctgccttcctgaagctgagccaggagcgggagctgcccctgcggctgccccgggcccacgccgaggtggatggccgcagcacagagcccccagcccccaaggccccccggcccaagtggcccaaggtgaatggcaagaactaccccaaggcctggcagggcgccagcagcggggaggccgccggccccccaggctggcagggctgcccagatgagccctggcccagcgccaccccctgtggccccagcgtgcagcccagccaccagcccctgagcaaggccctggagagccccctgggcctgcggccccacctgcccctgctgatgggcggccaggccgccctgaagccagagcccggccggcctggagaggagagccctgcccccaagcaggagctgcaccagcccagcttccccaccccccagctgagccccctgcccatgcctggcaacccagctgactacaacggcctgtgtgtgggccctgagctgacagccctgggcagcttctacctgtactgcggccaggagggcctgcagtgtggcggctacagcccctgccccatgctgcctgagggcaagctgagccctgtggccgcccctcatgaggagggcctgctgctggcccccagctctgtgcccagcggcacccccttccagcaccccccctggggcagcagccgctactgcagcagcgaggacaccggggtgaatggctacagcatctgtggggtgctgcccctgtctgtgacccacgccggcaccacctgtggcggctgcccctacaagatgccctttgctgctgagggctgccgcagcctgggccagctggagttccccctgcctgaggccggccacccagccagccctgcccaccccctgctgggctgccctgtgcccagcgtgcccccagctgctgagcctgtgccccacctgcagacccccaccagcgagccccagacagtggcccgggcctgcccccagagcgccaagcccccatctggcagcaagagcggcctgaggacaggcagcagctgccgccacacagcccggagcaaggccgcccggcggcccagccaccccaagcagccccgggtgcagaggccccggcccaggagaagaagaagaagaaggaccaacggctgggtgcctgtgggcgccgcctgtgagaaggctgtgtatgtgctggatgagcctgagcccgccatcaggaagagctaccaggccgtggagcggcacggggagaccatccgggtgcgggacacagtgctgctgaagagcggccccaggaagaccagcaccccctacgtggccaagatcagcgccctgtgggagaaccctgagagcggggagctgatgatgagcctgctgtggtactacagacctgagcacctgcagggcggccgcagccccagcatgcatgagcccctgcagaatgaggtgtttgccagccgccaccaggaccagaacagcgtggcctgcatcgaggagaagtgctacgtgctgacctttgctgagtactgccgcttctgtgccatggccaagagaagaggagagggcctgcccagcaggaagacagccctggtgcccccatctgctgactacagcaccccaccccacaggacagtgcctgaggacacagatcctgagctggtgttcctgtgccgccacgtgtatgacttccgccacggccgcatcctgaagaacccccagtag

SEQ ID NO: 145370 - DNA, 2340 bp, Artificial Sequence
  Description of Artificial Sequence: Synthetic coding sequence
atgacccacaccaggaggaagagcctgcccatgctgagcagcggcctgactggaagaagagagcccctgcagatggaggacagcaacatggagcagggcgtggagggcgtggagcccggcatgcctgagagccctggccacctgactggaagaaggaagaactaccccctgaggaagaggcccctggtgcctgagaagcccaaggcctgcaaggtgctgctgacccggctggagaatgtggccggccccaggtctgcagatgaagcagatgagctgcccccagacctgcccaagccacccagccctgcccccagcagtgaagatcctggcctggcccagcccaggaagaggcggctggccagcctgaatgctgaggccctgaacaacctgctgctggagcgggaggacaccagcagcctggccggcacccggcgcagccgggccggggacccccacaggagccgggaccgggaccgggccactggaggctggagcagcagcaagaagaggccccggctgggggacctgggcggcggcagccgggacctgagccctgagcccgccccagatgagggccccaggagagatggagaccctgcccccaagaggctggccagcctgaatgctgctgccttcctgaagctgagccaggagcgggagctgcccctgcggctgccccgggcccacgccgaggtggatggccgcagcacagagcccccagcccccaaggccccccggcccaagtggcccaaggtgaatggcaagaactaccccaaggcctggcagggcgccagcagcggggaggccgccggccccccaggctggcagggctgcccagatgagccctggcccagcgccaccccctgtggccccagcgtgcagcccagccaccagcccctgagcaaggccctggagagccccctgggcctgcggccccacctgcccctgctgatgggcggccaggccgccctgaagccagagcccggccggcctggagaggagagccctgcccccaagcaggagctgcaccagcccagcttccccaccccccagctgagccccctgcccatgcctggcaacccagctgactacaacggcctgtgtgtgggccctgagctgacagccctgggcagcttctacctgtactgcggccaggagggcctgcagtgtggcggctacagcccctgccccatgctgcctgagggcaagctgagccctgtggccgcccctcatgaggagggcctgctgctggcccccagctctgtgcccagcggcacccccttccagcaccccccctggggcagcagccgctactgcagcagcgaggacaccggggtgaatggctacagcatctgtggggtgctgcccctgtctgtgacccacgccggcaccacctgtggcggctgcccctacaagatgccctttgctgctggctgccgcagcctgggccagctggagttccccctgcctgaggccggccacccagccagccctgcccaccccctgctgggctgccctgtgcccagcgtgcccccagctgctgagcctgtgccccacctgcagacccccaccagcgagccccagacagtggcccgggcctgcccccagagcgccaagccacccagcggcagcaagagcggcctgaggacaggcagcagctgccgccacacagcccggagcaaggccgcccggcggcccagccaccccaagcagccccgggtgcagaggccccggcccaggagaagaagaagaagaaggaccaacggctgggtgcctgtgggcgccgcctgtgagaaggctgtgtatgtgctggatgagcctgagcccgccatcaggaagagctaccaggccgtggagagacatggagagaccatccgggtgcgggacacagtgctgctgaagagcggccccaggaagaccagcaccccctacgtggccaagatcagcgccctgtgggagaaccctgagagcggggagctgatgatgagcctgctgtggtactacagacctgagcacctgcagggcggccgcagccccagcatgcatgagcccctgcagaatgaggtgtttgccagccgccaccaggaccagaacagcgtggcctgcatcgaggagaagtgctacgtgctgacctttgctgagtactgccgcttctgtgccatggccaagagaagaggagagggcctgcccagcaggaagacagccctggtgccccccagcgctgactacagcaccccaccccacaggacagtgcctgaggacacagatcctgagctggtgttcctgtgcagacatgtgtatgacttcagacatggccgcatcctgaagaacccccagtag

SEQ ID NO: 145371 - DNA, 4575 bp, Artificial Sequence
  Description of Artificial Sequence: Synthetic coding sequence
atgcccctgctgcacaggaagccctttgtgcggcagaagcccccagctgacctgcggccagatgaggaggtgttctactgcaaggtgaccaatgagatcttccgccactatgatgacttctttgagaggaccatcctgtgcaacagcctggtgtggagctgtgctgtgacaggccggcccggcctgacctaccaggaggccctggagagcgagaagaaggcccggcagaacctgcagagcttccctgagcccctcatcatccctgtgctgtacctgaccagcctgacccacaggagccggctgcacgagatctgtgatgacatctttgcctacgtgaaggaccgctactttgtggaggagaccgtggaggtgatccggaacaacggggcccggctgcagtgccgcatcctggaggtgctgccccccagccaccagaatggatttgccaacggccacgtgaacagcgtggatggagagaccatcatcatcagtgacagtgatgattctgagacccagagctgcagcttccagaatggcaagaagaaggatgccatcgaccccctgctcttcaagtacaaggtgcagcccaccaagaaggagctgcacgagagcgccatcgtgaaggccacccagatcagcaggaggaagcacctgttcagccgggacaagctgaagctgttcctgaagcagcactgtgagccccaggatggagtcatcaagatcaaggccagcagcctgagcacctacaagattgctgagcaggacttctcctacttcttcccagatgacccccccaccttcatcttctccccagccaacagaagaagaggccggccccccaagaggatccacatcagccaggaggacaacgtggccaacaagcagaccctggccagctaccgcagcaaggccaccaaggagcgggacaagctgctgaagcaggaggagatgaagagcctggcctttgagaaggccaagctgaagcgggagaaggcagatgccctggaggccaagaagaaggagaaggaggacaaggagaagaagcgggaggagctgaagaagatcgtggaggaggagcggctgaagaagaaggaggagaaggagcggctgaaggtggagcgggagaaggagcgggagaagctgcgggaggagaagaggaaatatgtggagtacctgaagcagtggagcaagccccgggaggacatggagtgtgatgacctgaaggagctgcctgagcccacccctgtgaagacccggctgcccccagagatctttggagatgccctgatggtgctggagttcctgaatgccttcggggagctgtttgacctgcaggatgagttcccagatggagtgaccctggaggtgctggaggaggccctggtgggcaatgacagcgagggccccctgtgtgagctgctcttcttcttcctgacagccatcttccaggccatcgccgaggaggaggaggaggtggccaaggagcagctgacagatgctgacaccaagggctgcagcctgaagagcctggacctggacagctgcaccctgtctgagatcctgcggctgcacatcctggccagcggggctgatgtgaccagcgccaatgccaagtaccgctaccagaagagaggaggctttgatgccacagatgatgcctgcatggagctgcggctgagcaaccccagcctggtgaagaagctgagcagcacctctgtgtatgacctgaccccaggagagaagatgaagatcctgcacgccctgtgtgggaagctgctgaccctggtgtccacccgggacttcattgaagattatgtggacatcctgcggcaggccaagcaggagttccgggagctgaaggccgagcagcacaggaaggagcgggaggaggccgccgcccgcatcaggaagaggaaggaggagaagctgaaggagcaggagcagaagatgaaggagaagcaggagaagctgaaggaggatgagcagaggaacagcacagctgacatcagcattggagaggaggagagagaagattttgacaccagcattgagagcaaggacacagagcagaaggagctggaccaggacatggtgacagaagatgaagatgatcctggcagccacaagaggggccggcggggcaagaggggccagaatggcttcaaggagttcacccggcaggagcagatcaactgtgtgacccgggagcccctgacagcagatgaggaggaggccctgaagcaggagcaccagaggaaggagaaggagctgctggagaagatccagagcgccatcgcctgcaccaacatcttccccctgggccgggacaggatgtaccgccgctactggatcttccccagcatccctggcctcttcatcgaggaggactacagcggcctgacagaggacatgctgctgccccggcccagcagcttccagaacaacgtgcagagccaggacccccaggtgtccaccaagacaggagagcccctgatgtctgagagcaccagcaacatcgaccagggcccccgggaccacagcgtgcagctgcccaagcctgtgcacaagcccaaccgctggtgcttctacagcagctgtgagcagctggaccagctgattgaggccctgaacagccggggccaccgggagagcgccctgaaggagaccctgctgcaggagaagagccgcatctgtgcccagctggcccgcttcagcgaggagaagttccacttcagtgacaagccccagcctgacagcaagcccacctacagccggggccgcagcagcaatgcctatgaccccagccagatgtgtgccgagaagcagctggagctgcggctgcgggacttcctgctggacattgaagatcgcatctaccagggcaccctgggcgccatcaaggtgacagacagacacatctggaggtctgccctggagagcggccgctatgagctgctgtctgaggagaacaaggaaaatggcatcatcaagacagtgaatgaagatgtggaggagatggagattgatgagcagaccaaggtgattgtgaaggaccggctgctgggcatcaagacagagacccccagcacagtgtccaccaatgccagcaccccccagagcgtgtcctctgtggtgcactacctggccatggccctcttccagatcgagcagggcattgaaagacgcttcctgaaggcccccctggatgccagtgacagcggccgcagctacaagacagtgctggaccgctggagggagagcctgctgagcagcgccagcctgagccaggtgttcctgcacctgagcaccctggacagaagtgtcatctggagcaagagcatcctgaatgcccgctgcaagatctgcaggaagaagggagatgctgagaacatggtgctgtgtgatggctgtgaccggggccaccacacctactgtgtgcggcccaagctgaagacagtgcctgagggggactggttctgcccagagtgccggcccaagcagaggagccggcggctgagcagccggcagaggcccagcctggagagtgatgaagatgtggaggacagcatgggaggagaagatgatgaggtggatggagatgaggaggagggccagagcgaggaggaggagtatgaggtggagcaggatgaagatgacagccaggaggaggaggaggtgtccctgcccaagaggggccggccccaggtgcggctgcctgtgaagacccggggcaagctgagcagcagcttcagcagccggggccagcagcaggagcccggccgctaccccagccgcagccagcagagcacccccaagaccaccgtgagcagcaagacaggccgcagcctgaggaagatcaacagcgccccacccacagagaccaagagcctgagaattgccagccgcagcaccaggcacagccacggccccctgcaggctgatgtgtttgtggagctgctgagccccaggaggaagaggcggggcaggaagagcgccaacaacaccccagagaacagccccaacttccccaacttccgggtcatcgccaccaagagcagcgagcagagccgctctgtgaacatcgccagcaagctgagcctgcaggagagcgagagcaagaggcgctgcaggaagaggcagagccctgagcccagccctgtgaccctgggcagaagaagcagcggccggcagggcggcgtgcatgagctgagcgcctttgagcagctggtggtggagctggtgagacatgatgacagctggcccttcctgaagctggtgtccaagatccaggtgcctgactactatgacatcatcaagaagcccatcgccctgaacatcatccgggagaaggtgaacaagtgtgagtacaagctggccagcgagttcattgatgacatcgagctgatgttcagcaactgctttgagtacaaccccaggaacaccagcgaggccaaggccggcacccggctgcaggccttcttccacatccaggcccagaagctgggcctgcacgtgacccccagcaatgtggaccaggtgtccaccccacctgctgccaagaagagccgcatctag

SEQ ID NO: 145372 - DNA, 4671 bp, Artificial Sequence
  Description of Artificial Sequence: Synthetic coding sequence
atgcccctgctgcacaggaagccctttgtgcggcagaagcccccagctgacctgcggccagatgaggaggtgttctactgcaaggtgaccaatgagatcttccgccactatgatgacttctttgagaggaccatcctgtgcaacagcctggtgtggagctgtgctgtgacaggccggcccggcctgacctaccaggaggccctggagagcgagaagaaggcccggcagaacctgcagagcttccctgagcccctcatcatccctgtgctgtacctgaccagcctgacccacaggagccggctgcacgagatctgtgatgacatctttgcctacgtgaaggaccgctactttgtggaggagaccgtggaggtgatccggaacaacggggcccggctgcagtgccgcatcctggaggtgctgccccccagccaccagaatggatttgccaacggccacgtgaacagcgtggatggagagaccatcatcatcagtgacagtgatgattctgagacccagagctgcagcttccagaatggcaagaagaaggatgccatcgaccccctgctcttcaagtacaaggtgcagcccaccaagaaggagctgcacgagagcgccatcgtgaaggccacccagatcagcaggaggaagcacctgttcagccgggacaagctgaagctgttcctgaagcagcactgtgagccccaggatggagtcatcaagatcaaggccagcagcctgagcacctacaagattgctgagcaggacttctcctacttcttcccagatgacccccccaccttcatcttctccccagccaacagaagaagaggccggccccccaagaggatccacatcagccaggaggacaacgtggccaacaagcagaccctggccagctaccgcagcaaggccaccaaggagcgggacaagctgctgaagcaggaggagatgaagagcctggcctttgagaaggccaagctgaagcgggagaaggcagatgccctggaggccaagaagaaggagaaggaggacaaggagaagaagcgggaggagctgaagaagatcgtggaggaggagcggctgaagaagaaggaggagaaggagcggctgaaggtggagcgggagaaggagcgggagaagctgcgggaggagaagaggaaatatgtggagtacctgaagcagtggagcaagccccgggaggacatggagtgtgatgacctgaaggagctgcctgagcccacccctgtgaagacccggctgcccccagagatctttggagatgccctgatggtgctggagttcctgaatgccttcggggagctgtttgacctgcaggatgagttcccagatggagtgaccctggaggtgctggaggaggccctggtgggcaatgacagcgagggccccctgtgtgagctgctcttcttcttcctgacagccatcttccaggccatcgccgaggaggaggaggaggtggccaaggagcagctgacagatgctgacaccaaggacctgacagaggccctggatgaagatgctgaccccaccaagagcgccctgtctgctgtggccagcctggccgccgcctggccccagctgcaccagggctgcagcctgaagagcctggacctggacagctgcaccctgtctgagatcctgcggctgcacatcctggccagcggggctgatgtgaccagcgccaatgccaagtaccgctaccagaagagaggaggctttgatgccacagatgatgcctgcatggagctgcggctgagcaaccccagcctggtgaagaagctgagcagcacctctgtgtatgacctgaccccaggagagaagatgaagatcctgcacgccctgtgtgggaagctgctgaccctggtgtccacccgggacttcattgaagattatgtggacatcctgcggcaggccaagcaggagttccgggagctgaaggccgagcagcacaggaaggagcgggaggaggccgccgcccgcatcaggaagaggaaggaggagaagctgaaggagcaggagcagaagatgaaggagaagcaggagaagctgaaggaggatgagcagaggaacagcacagctgacatcagcattggagaggaggagagagaagattttgacaccagcattgagagcaaggacacagagcagaaggagctggaccaggacatggtgacagaagatgaagatgatcctggcagccacaagaggggccggcggggcaagaggggccagaatggcttcaaggagttcacccggcaggagcagatcaactgtgtgacccgggagcccctgacagcagatgaggaggaggccctgaagcaggagcaccagaggaaggagaaggagctgctggagaagatccagagcgccatcgcctgcaccaacatcttccccctgggccgggacaggatgtaccgccgctactggatcttccccagcatccctggcctcttcatcgaggaggactacagcggcctgacagaggacatgctgctgccccggcccagcagcttccagaacaacgtgcagagccaggacccccaggtgtccaccaagacaggagagcccctgatgtctgagagcaccagcaacatcgaccagggcccccgggaccacagcgtgcagctgcccaagcctgtgcacaagcccaaccgctggtgcttctacagcagctgtgagcagctggaccagctgattgaggccctgaacagccggggccaccgggagagcgccctgaaggagaccctgctgcaggagaagagccgcatctgtgcccagctggcccgcttcagcgaggagaagttccacttcagtgacaagccccagcctgacagcaagcccacctacagccggggccgcagcagcaatgcctatgaccccagccagatgtgtgccgagaagcagctggagctgcggctgcgggacttcctgctggacattgaagatcgcatctaccagggcaccctgggcgccatcaaggtgacagacagacacatctggaggtctgccctggagagcggccgctatgagctgctgtctgaggagaacaaggaaaatggcatcatcaagacagtgaatgaagatgtggaggagatggagattgatgagcagaccaaggtgattgtgaaggaccggctgctgggcatcaagacagagacccccagcacagtgtccaccaatgccagcaccccccagagcgtgtcctctgtggtgcactacctggccatggccctcttccagatcgagcagggcattgaaagacgcttcctgaaggcccccctggatgccagtgacagcggccgcagctacaagacagtgctggaccgctggagggagagcctgctgagcagcgccagcctgagccaggtgttcctgcacctgagcaccctggacagaagtgtcatctggagcaagagcatcctgaatgcccgctgcaagatctgcaggaagaagggagatgctgagaacatggtgctgtgtgatggctgtgaccggggccaccacacctactgtgtgcggcccaagctgaagacagtgcctgagggggactggttctgcccagagtgccggcccaagcagaggagccggcggctgagcagccggcagaggcccagcctggagagtgatgaagatgtggaggacagcatgggaggagaagatgatgaggtggatggagatgaggaggagggccagagcgaggaggaggagtatgaggtggagcaggatgaagatgacagccaggaggaggaggaggtgtccctgcccaagaggggccggccccaggtgcggctgcctgtgaagacccggggcaagctgagcagcagcttcagcagccggggccagcagcaggagcccggccgctaccccagccgcagccagcagagcacccccaagaccaccgtgagcagcaagacaggccgcagcctgaggaagatcaacagcgccccacccacagagaccaagagcctgagaattgccagccgcagcaccaggcacagccacggccccctgcaggctgatgtgtttgtggagctgctgagccccaggaggaagaggcggggcaggaagagcgccaacaacaccccagagaacagccccaacttccccaacttccgggtcatcgccaccaagagcagcgagcagagccgctctgtgaacatcgccagcaagctgagcctgcaggagagcgagagcaagaggcgctgcaggaagaggcagagccctgagcccagccctgtgaccctgggcagaagaagcagcggccggcagggcggcgtgcatgagctgagcgcctttgagcagctggtggtggagctggtgagacatgatgacagctggcccttcctgaagctggtgtccaagatccaggtgcctgactactatgacatcatcaagaagcccatcgccctgaacatcatccgggagaaggtgaacaagtgtgagtacaagctggccagcgagttcattgatgacatcgagctgatgttcagcaactgctttgagtacaaccccaggaacaccagcgaggccaaggccggcacccggctgcaggccttcttccacatccaggcccagaagctgggcctgcacgtgacccccagcaatgtggaccaggtgtccaccccacctgctgccaagaagagccgcatctag

SEQ ID NO: 145373 - DNA, 4671 bp, Artificial Sequence; identical to SEQ ID NO: 145372
  Description of Artificial Sequence: Synthetic coding sequence

SEQ ID NO: 145374 - DNA, 3702 bp, Artificial Sequence
  Description of Artificial Sequence: Synthetic coding sequence
atgaagagcctggcctttgagaaggccaagctgaagcgggagaaggcagatgccctggaggccaagaagaaggagaaggaggacaaggagaagaagcgggaggagctgaagaagatcgtggaggaggagcggctgaagaagaaggaggagaaggagcggctgaaggtggagcgggagaaggagcgggagaagctgcgggaggagaagaggaaatatgtggagtacctgaagcagtggagcaagccccgggaggacatggagtgtgatgacctgaaggagctgcctgagcccacccctgtgaagacccggctgcccccagagatctttggagatgccctgatggtgctggagttcctgaatgccttcggggagctgtttgacctgcaggatgagttcccagatggagtgaccctggaggtgctggaggaggccctggtgggcaatgacagcgagggccccctgtgtgagctgctcttcttcttcctgacagccatcttccaggccatcgccgaggaggaggaggaggtggccaaggagcagctgacagatgctgacaccaagggctgcagcctgaagagcctggacctggacagctgcaccctgtctgagatcctgcggctgcacatcctggccagcggggctgatgtgaccagcgccaatgccaagtaccgctaccagaagagaggaggctttgatgccacagatgatgcctgcatggagctgcggctgagcaaccccagcctggtgaagaagctgagcagcacctctgtgtatgacctgaccccaggagagaagatgaagatcctgcacgccctgtgtgggaagctgctgaccctggtgtccacccgggacttcattgaagattatgtggacatcctgcggcaggccaagcaggagttccgggagctgaaggccgagcagcacaggaaggagcgggaggaggccgccgcccgcatcaggaagaggaaggaggagaagctgaaggagcaggagcagaagatgaaggagaagcaggagaagctgaaggaggatgagcagaggaacagcacagctgacatcagcattggagaggaggagagagaagattttgacaccagcattgagagcaaggacacagagcagaaggagctggaccaggacatggtgacagaagatgaagatgatcctggcagccacaagaggggccggcggggcaagaggggccagaatggcttcaaggagttcacccggcaggagcagatcaactgtgtgacccgggagcccctgacagcagatgaggaggaggccctgaagcaggagcaccagaggaaggagaaggagctgctggagaagatccagagcgccatcgcctgcaccaacatcttccccctgggccgggacaggatgtaccgccgctactggatcttccccagcatccctggcctcttcatcgaggaggactacagcggcctgacagaggacatgctgctgccccggcccagcagcttccagaacaacgtgcagagccaggacccccaggtgtccaccaagacaggagagcccctgatgtctgagagcaccagcaacatcgaccagggcccccgggaccacagcgtgcagctgcccaagcctgtgcacaagcccaaccgctggtgcttctacagcagctgtgagcagctggaccagctgattgaggccctgaacagccggggccaccgggagagcgccctgaaggagaccctgctgcaggagaagagccgcatctgtgcccagctggcccgcttcagcgaggagaagttccacttcagtgacaagccccagcctgacagcaagcccacctacagccggggccgcagcagcaatgcctatgaccccagccagatgtgtgccgagaagcagctggagctgcggctgcgggacttcctgctggacattgaagatcgcatctaccagggcaccctgggcgccatcaaggtgacagacagacacatctggaggtctgccctggagagcggccgctatgagctgctgtctgaggagaacaaggaaaatggcatcatcaagacagtgaatgaagatgtggaggagatggagattgatgagcagaccaaggtgattgtgaaggaccggctgctgggcatcaagacagagacccccagcacagtgtccaccaatgccagcaccccccagagcgtgtcctctgtggtgcactacctggccatggccctcttccagatcgagcagggcattgaaagacgcttcctgaaggcccccctggatgccagtgacagcggccgcagctacaagacagtgctggaccgctggagggagagcctgctgagcagcgccagcctgagccaggtgttcctgcacctgagcaccctggacagaagtgtcatctggagcaagagcatcctgaatgcccgctgcaagatctgcaggaagaagggagatgctgagaacatggtgctgtgtgatggctgtgaccggggccaccacacctactgtgtgcggcccaagctgaagacagtgcctgagggggactggttctgcccagagtgccggcccaagcagaggagccggcggctgagcagccggcagaggcccagcctggagagtgatgaagatgtggaggacagcatgggaggagaagatgatgaggtggatggagatgaggaggagggccagagcgaggaggaggagtatgaggtggagcaggatgaagatgacagccaggaggaggaggaggtgtccctgcccaagaggggccggccccaggtgcggctgcctgtgaagacccggggcaagctgagcagcagcttcagcagccggggccagcagcaggagcccggccgctaccccagccgcagccagcagagcacccccaagaccaccgtgagcagcaagacaggccgcagcctgaggaagatcaacagcgccccacccacagagaccaagagcctgagaattgccagccgcagcaccaggcacagccacggccccctgcaggctgatgtgtttgtggagctgctgagccccaggaggaagaggcggggcaggaagagcgccaacaacaccccagagaacagccccaacttccccaacttccgggtcatcgccaccaagagcagcgagcagagccgctctgtgaacatcgccagcaagctgagcctgcaggagagcgagagcaagaggcgctgcaggaagaggcagagccctgagcccagccctgtgaccctgggcagaagaagcagcggccggcagggcggcgtgcatgagctgagcgcctttgagcagctggtggtggagctggtgagacatgatgacagctggcccttcctgaagctggtgtccaagatccaggtgcctgactactatgacatcatcaagaagcccatcgccctgaacatcatccgggagaaggtgaacaagtgtgagtacaagctggccagcgagttcattgatgacatcgagctgatgttcagcaactgctttgagtacaaccccaggaacaccagcgaggccaaggccggcacccggctgcaggccttcttcatcttccggctgaagagcctggacagcaccagccaccctgtgatgtggaccaagctggcccaccaccggctgaggaagagccatgaaagtgactttgtgctgctgaaggacatctttgaggagaagcagatcgtgcatgaaaatggcaccctgaaccacgctgtgtag

SEQ ID NO: 145375 - DNA, 4452 bp, Artificial Sequence
  Description of Artificial Sequence: Synthetic coding sequence
atggcccccctgctgggcaggaagcccttccccctggtgaagcccctgcctggagaggagcccctcttcaccatcccccacacccaggaggccttccgcacccgggaggagtatgaggcccggctggagcgctacagcgagcgcatctggacctgcaagagcacaggcagcagccagctgacccacaaggaggcctgggaggaggagcaggaggtggccgagctgctgaaggaggagttccctgcctggtatgagaagctggtgctggagatggtgcaccacaacacagccagcctggagaagctggtggacacagcctggctggagatcatgaccaagtatgctgtgggggaggagtgtgactttgaggtgggcaaggagaagatgctgaaggtgaagatcgtgaagatccaccccctggagaaggtggatgaggaggccacagagaagaagagtgatggagcctgtgacagccccagcagtgacaaggagaacagcagccagatcgcccaggaccaccagaagaaggagaccgtggtgaaggaggatgagggccggcgggagagcatcaatgaccgggcccggcgcagccccaggaagctgcccaccagcctgaagaagggggagaggaagtgggccccacccaagttcctgccccacaagtatgatgtgaagctgcagaatgaagacaagatcatcagcaatgtgcctgctgacagcctcatcagaacagagaggcctcccaacaaggagatcgtgcgctacttcatccgccacaatgccctgcgggccggcaccggggagaatgccccctgggtggtggaggatgagctggtgaagaagtacagcctgcccagcaagttcagtgacttcctgctggacccctacaagtacatgaccctgaaccccagcaccaagaggaagaacacaggcagcccagacaggaagcccagcaagaagagcaagacagacaacagcagcctgagcagccccctgaaccccaagctgtggtgccacgtgcacctgaagaagagcctgagcggcagccccctgaaggtgaagaacagcaagaacagcaagagccctgaggagcacctggaggagatgatgaagatgatgagccccaacaagctgcacaccaacttccacatccccaagaagggccccccagccaagaagccaggcaagcacagcgacaagcccctgaaggccaagggccgcagcaagggcatcctgaatggccagaagagcacaggcaacagcaagagccccaagaagggcctgaagacccccaagaccaagatgaagcagatgaccctgctggacatggccaagggcacccagaagatgacccgggcccccagaaattctgggggcacccccaggaccagcagcaagccccacaagcacctgcccccagctgccctgcacctgattgcctactacaaggagaacaaggaccgggaggacaagaggtctgccctgagctgtgtgatcagcaagacagcccggctgctgagcagtgaagatcgggcccggctgcctgaggagctgcggagcctggtgcagaagagatatgagctgctggagcacaagaagcgctgggcctccatgtctgaggagcagaggaaggagtacctgaagaagaagcgggaggagctgaagaagaagctgaaggagaaggccaaggagcggcgggagaaggagatgctggagcggctggagaagcagaagagatatgaggaccaggagctgaccgggaagaacctgcctgccttccggctggtggacaccccagagggcctgcccaacaccctgtttggagatgtggccatggtggtggagttcctgagctgctacagcggcctgctgctgcctgatgcccagtaccccatcacagctgtgtccctgatggaggccctgtctgctgacaagggcggcttcctgtacctgaacagagtgctggtgatcctgctgcagaccctgctgcaggatgaaattgctgaagattatggagagctgggcatgaagctgtctgagatccccctgaccctgcacagcgtgtctgagctggtgcggctgtgcctgcggcggagtgatgtgcaggaggagagcgagggcagtgacacagatgacaacaaggacagcgctgcctttgaggacaatgaggtgcaggatgagttcctggagaagctggagaccagcgagttctttgagctgaccagcgaggagaagctgcagatcctgacagccctgtgccaccgcatcctgatgacctacagcgtgcaggaccacatggagacccggcagcagatgtctgctgagctgtggaaggagcggctggccgtgctgaaggaggagaatgacaagaagagagctgagaagcagaagaggaaggagatggaggccaagaacaaggaaaatggcaaggtggagaatggcctgggcaagacagacaggaagaaggagatcgtgaagtttgagccccaggtggacacagaagctgaggacatgatctctgctgtgaagagccggcggctgctggccatccaggccaagaaggagcgggagatccaggagcgggagatgaaggtgaagctggagcggcaggccgaggaggagcgcatcaggaagcacaaggctgctgctgagaaggccttccaggagggcatcgccaaggccaagctggtgatgaggaggacccccatcggcacagacaggaaccacaaccgctactggctgttcagtgatgaggtgcccggcctcttcatcgagaagggctgggtgcatgacagcattgactaccgcttcaaccaccactgcaaggaccacacagtgtctggagatgaggactactgccccaggagcaagaaggccaacctgggcaagaatgcctccatgaacacccagcacggcacagccacagaggtggccgtggagaccaccacccccaagcagggccagaacctgtggttcctgtgtgacagccagaaggagctggatgagctgctgaactgcctgcacccccagggcatccgggagagccagctgaaggagcggctggagaagcgctaccaggacatcatccacagcatccacctggccaggaagcccaacctgggcctgaagagctgtgatggcaaccaggagctgctgaacttcctgcggagtgacctgattgaggtggccacccggctgcagaagggcggcctgggctacgtggaggagaccagcgagtttgaggcccgggtcatcagcctggagaagctgaaggactttggagaatgtgtgattgccctgcaggccagcgtcatcaagaagttcctgcagggcttcatggcccccaagcagaagaggaggaagctgcagagtgaagattctgccaagacagaggaggtggatgaggagaagaagatggtggaggaggccaaggtggccagcgccctggagaagtggaagacagccatccgggaggcccagaccttcagcaggatgcacgtgctgctgggcatgctggatgcctgcatcaagtgggacatgtctgcagaaaatgcccgctgcaaggtgtgcaggaagaagggagaagatgacaagctgatcctgtgtgatgagtgcaacaaggccttccacctgttctgcctgcggcctgccctgtatgaggtgcctgatggagagtggcagtgcccagcctgccagcctgccacagcccggaggaacagccggggcaggaactacacagaggagagcgccagcgaggacagtgaagatgatgaaagtgatgaggaggaggaggaggaggaggaggaggaggaggaggaggactatgaggtggccggcctgcggctgcggcccaggaagaccatccggggcaagcacagcgtcatccccccagctgcccggtctggaagaagacctgggaagaagccccacagcaccaggaggagccagcccaaggcccctcctgtggatgatgctgaggtggatgagctggtgctgcagaccaagaggagcagccggcggcagagcctggagctgcagaagtgtgaggagatcctgcacaagatcgtgaagtaccgcttctcctggcccttccgggagcctgtgaccagagatgaagctgaggactactatgatgtgatcacccaccccatggacttccagacagtgcagaacaagtgcagctgtggcagctacagatctgtgcaggagttcctgacagacatgaagcaggtgttcaccaatgctgaggtgtacaactgccggggcagccacgtgctgagctgcatggtgaagacagagcagtgcctggtggccctgctgcacaagcacctgcccggccacccctacgtgcggaggaagaggaagaagttcccagaccggctggctgaagatgaaggagacagcgagcctgaggccgtgggccagagccggggccggcggcagaagaagtag

SEQ ID NO: 145376 - DNA, 4452 bp, Artificial Sequence; identical to SEQ ID NO: 145375
  Description of Artificial Sequence: Synthetic coding sequence

SEQ ID NO: 145377 - DNA, 5622 bp, Artificial Sequence
  Description of Artificial Sequence: Synthetic coding sequence
atggaggccaatgaccacttcaacttcaccggcctgcccccagccccagctgccagcggcctgaagcccagccccagcagtggagagggcctgtacaccaacggcagccccatgaacttcccccagcagggcaagagcctgaatggagatgtgaatgtgaatggcctgagcacagtgagccacaccaccaccagcggcatcctgaacagcgccccccacagcagcagcaccagccacctgcaccaccccagcgtggcctatgactgcctgtggaactacagccagtaccccagcgccaaccctggcagcaacctgaaggacccccccctgctgagccagttcagcggcggccagtaccccctgaatggcatcctgggcggcagccggcagcccagcagccccagccacaacaccaacctgcgggccggcagccaggagttctgggccaacggcacccagagccccatgggcctgaactttgacagccaggagctgtatgacagcttcccagaccagaactttgaggaggtgggcagcggcatccacccagatgaggccgctgagaaggagatgacctctgtggtggctgaaaatggcaccggcctggtgggcagcctggagctggaggaggagcagcctgagctgaagatgtgtggctacaatggatctgtgcccagcgtggagagcctgcaccaggaggtgtctgtgctggtgcctgaccccaccgtgtcctgcctggatgaccccagccacctgcctgaccagctggaggacacccccatcctgtctgaggacagcctggagcccttcaacagcctggcccctgagcctgtgtctgggggcctgtatggaattgatgacacagagctgatgggcgctgaggacaagctgcccctggaggacagccctgtgatcagcgccctggactgccccagcctgaacaatgccacagccttcagcctgctggctgatgacagccagaccagcaccagcatctttgccagccccaccagcccccctgtgctgggggagagcgtgctgcaggacaacagctttgacctgaacaacggcagtgatgctgagcaggaggagatggagacccagagcagtgacttcccccccagcctgacccagcctgccccagaccagagcagcaccatccagctgcacccagccaccagccctgctgtgagccccaccaccagccctgctgtgtccctggtggtgtccccagctgccagccctgagatcagccctgaggtgtgcccagctgccagcacagtggtgtccccagctgtgttttctgtggtgtccccagccagcagcgctgtgctgcctgctgtgtccctggaggtgcccctgacagcctctgtgaccagccccaaggccagccctgtgaccagccctgctgctgccttccccacagccagccctgccaacaaggatgtgtcctccttcctggagaccacagcagatgtggaggagatcactggagagggcctgacagccagcggcagcggagatgtgatgagaagacgcatcgccaccccagaggaggtgcggctgcccctgcagcacggctggaggcgggaggtgcgcatcaagaagggcagccaccgctggcagggcgagacctggtactacggcccctgtgggaagaggatgaagcagtttcctgaggtgatcaagtacctgagcagaaatgtggtgcacagcgtgcggcgggagcacttctccttcagccccaggatgcctgtgggggacttctttgaggagcgggacaccccagagggcctgcagtgggtgcagctgtctgctgaggagatccccagccgcatccaggccatcaccgggaagaggggccggcccaggaacacagagaaggccaagaccaaggaggtgcccaaggtgaagaggggccggggccggccccccaaggtgaagatcacagagctgctgaacaagacagacaaccggcccctgaagaagctggaggcccaggagaccctgaatgaggaggacaaggccaagatcgccaagagcaagaagaagatgaggcagaaggtgcagagaggagagtgccagaccaccatccagggccaggccaggaacaagaggaagcaggagaccaagagcctgaagcagaaggaggccaagaagaagagcaaggccgagaaggagaagggcaagaccaagcaggagaagctgaaggagaaggtgaagcgggagaagaaggagaaggtgaagatgaaggagaaggaggaggtgaccaaggccaagccagcctgcaaggctgacaagaccctggccacccagaggcggctggaggagcggcagaggcagcagatgatcctggaggagatgaagaagcccacagaggacatgtgcctgacagaccaccagcccctgcctgacttcagccgggtgcccggcctgaccctgcccagcggggccttcagtgactgcctgaccatcgtggagttcctgcacagctttgggaaggtgctgggctttgatcctgccaaggatgtgcccagcctgggcgtgctgcaggagggcctgctgtgccagggcgacagcctgggggaggtgcaggacctgctggtgcggctgctgaaggccgccctgcatgaccccggcttccccagctactgccagagcctgaagatcctgggggagaaggtgtctgagatccccctgacccgggacaacgtgtctgagatcctgcgctgcttcctgatggcctacggcgtggagcccgccctgtgtgaccggctgcggacccagcccttccaggcccagcccccccagcagaaggctgctgtgctggccttcctggtgcatgagctgaatggcagcaccctcatcatcaatgaaattgacaagaccctggagagcatgagcagctacaggaagaacaagtggatcgtggagggccgcctgcggcggctgaagacagtgctggccaagaggacaggccgctctgaggtggagatggagggccctgaggagtgcctgggcagaagaagaagcagccgcatcatggaggagaccagcggcatggaggaggaggaggaggaggagagcattgctgctgtgcccggccggcggggcagaagagatggagaggtggatgccacagccagcagcatccctgagctggagcggcagatcgagaagctgagcaagaggcagctgttcttcaggaagaagctgctgcacagcagccagatgctgcgggctgtgtccctgggccaggaccgctacagaagacgctactgggtgctgccctacctggccggcatctttgtggagggcacagagggcaacctggtgcctgaggaggtgatcaagaaggagacagacagcctgaaggtggccgcccacgccagcctgaacccagccctcttctccatgaagatggagctggccggcagcaacaccacagccagcagccctgcccgggcccggggccggcccaggaagaccaagccaggctccatgcagcccaggcacctgaagagccctgtgcggggccaggacagcgagcagccccaggcccagctgcagcctgaggcccagctgcacgccccagcccagccccagccccagctgcagctgcagctgcagagccacaagggcttcctggagcaggagggcagccccctgagcctgggccagagccagcacgacctgagccagagcgccttcctgtcctggctgagccagacccagagccacagcagcctgctgagcagctctgtgctgaccccagacagcagccctgggaagctggaccctgcccccagccagcccccagaggagcctgagccagatgaagctgagagcagcccagacccccaggccctgtggttcaacatcagcgcccagatgccctgcaatgctgcccccaccccacctcctgctgtgtctgaggaccagcccacccccagcccccagcagctggccagcagcaagcccatgaaccggcccagcgctgccaacccctgcagccctgtgcagttcagcagcacccccctggccggcctggcccccaagaggcgggccggggaccctggagagatgccccagagccccaccggcctgggccagcccaagaggcggggccggccccccagcaagttcttcaagcagatggagcagcgctacctgacccagctgacagcccagcctgtgcccccagagatgtgcagcggctggtggtggatccgggaccctgagatgctggatgccatgctgaaggccctgcacccccggggcatccgggagaaggccctgcacaagcacctgaacaagcaccgggacttcctgcaggaggtgtgcctgcggcccagcgctgaccccatctttgagccccggcagctgcctgccttccaggagggcatcatgtcctggagccccaaggagaagacctatgaaacagacctggccgtgctgcagtgggtggaggagctggagcagagggtcatcatgtctgacctgcagatccggggctggacctgccccagcccagacagcacccgggaggacctggcctactgtgagcacctgagtgacagccaggaggacatcacctggaggggccggggccgggagggcctggccccccagaggaagaccaccaaccccctggacctggccgtgatgaggctggccgccctggagcagaatgtggagcggcgctacctgcgggagcccctgtggcccacccatgaggtggtgctggagaaggccctgctgagcaccccaaatggagcccctgagggcaccaccacagagatctcctatgagatcaccccccgcatccgggtgtggaggcagaccctggagcgctgccgctctgctgcccaggtgtgcctgtgcctgggccagctggagaggagcatcgcctgggagaagtctgtgaacaaggtgacctgcctggtgtgcaggaagggggacaatgatgagttcctgctgctgtgtgatggctgtgaccggggctgccacatctactgccaccggcccaagatggaggccgtgcctgagggggactggttctgcaccgtgtgcctggcccagcaggtggagggggagttcacccagaagccaggcttccccaagaggggccagaagaggaagagcggctacagcctgaacttctctgaaggagatggaagaagaagaagagtgctgctgcggggccgggagagccctgctgctggcccccgctacagcgaggagggcctgagccccagcaagagaagaaggctgtccatgaggaaccaccacagcgacctgaccttctgtgagatcatcctgatggagatggagagccatgatgctgcctggcccttcctggagcctgtgaacccccggctggtgtctggctaccgccgcatcatcaagaaccccatggacttcagcaccatgagggagcggctgctgcggggcggctacaccagcagcgaggagtttgctgctgatgccctgctggtgtttgacaactgccagaccttcaatgaagatgattctgaggtgggcaaggccggccacatcatgaggcgcttctttgagagccgctgggaggagttctaccagggcaagcaggccaacctgtag

SEQ ID NO: 145378 - DNA, 2514 bp, Artificial Sequence
  Description of Artificial Sequence: Synthetic coding sequence
gtgcccggccggcggggcagaagagatggagaggtggatgccacagccagcagcatccctgagctggagcggcagatcgagaagctgagcaagaggcagctgttcttcaggaagaagctgctgcacagcagccagatgctgcgggctgtgtccctgggccaggaccgctacagaagacgctactgggtgctgccctacctggccggcatctttgtggagggcacagagggcaacctggtgcctgaggaggtgatcaagaaggagacagacagcctgaaggtggccgcccacgccagcctgaacccagccctcttctccatgaagatggagctggccggcagcaacaccacagccagcagccctgcccgggcccggggccggcccaggaagaccaagccaggctccatgcagcccaggcacctgaagagccctgtgcggggccaggacagcgagcagccccaggcccagctgcagcctgaggcccagctgcacgccccagcccagccccagccccagctgcagctgcagctgcagagccacaagggcttcctggagcaggagggcagccccctgagcctgggccagagccagcacgacctgagccagagcgccttcctgtcctggctgagccagacccagagccacagcagcctgctgagcagctctgtgctgaccccagacagcagccctgggaagctggaccctgcccccagccagcccccagaggagcctgagccagatgaagctgagagcagcccagacccccaggccctgtggttcaacatcagcgcccagatgccctgcaatgctgcccccaccccacctcctgctgtgtctgaggaccagcccacccccagcccccagcagctggccagcagcaagcccatgaaccggcccagcgctgccaacccctgcagccctgtgcagttcagcagcacccccctggccggcctggcccccaagaggcgggccggggaccctggagagatgccccagagccccaccggcctgggccagcccaagaggcggggccggccccccagcaagttcttcaagcagatggagcagcgctacctgacccagctgacagcccagcctgtgcccccaggctggtggtggatccgggaccctgagatgctggatgccatgctgaaggccctgcacccccggggcatccgggagaaggccctgcacaagcacctgaacaagcaccgggacttcctgcaggaggtgtgcctgcggcccagcgctgaccccatctttgagccccggcagctgcctgccttccaggagggcatcatgtcctggagccccaaggagaagacctatgaaacagacctggccgtgctgcagtgggtggaggagctggagcagagggtcatcatgtctgacctgcagatccggggctggacctgccccagcccagacagcacccgggaggacctggcctactgtgagcacctgagtgacagccaggaggacatcacctggaggggccggggccgggagggcctggccccccagaggaagaccaccaaccccctggacctggccgtgatgaggctggccgccctggagcagaatgtggagcggcgctacctgcgggagcccctgtggcccacccatgaggtggtgctggagaaggccctgctgagcaccccaaatggagcccctgagggcaccaccacagagatctcctatgagatcaccccccgcatccgggtgtggaggcagaccctggagcgctgccgctctgctgcccaggtgtgcctgtgcctgggccagctggagaggagcatcgcctgggagaagtctgtgaacaaggtgacctgcctggtgtgcaggaagggggacaatgatgagttcctgctgctgtgtgatggctgtgaccggggctgccacatctactgccaccggcccaagatggaggccgtgcctgagggggactggttctgcaccgtgtgcctggcccagcaggtggagggggagttcacccagaagccaggcttccccaagaggggccagaagaggaagagcggctacagcctgaacttctctgaaggagatggaagaagaagaagagtgctgctgcggggccgggagagccctgctgctggcccccgctacagcgaggagggcctgagccccagcaagagaagaaggctgtccatgaggaaccaccacagcgacctgaccttctgtgagatcatcctgatggagatggagagccatgatgctgcctggcccttcctggagcctgtgaacccccggctggtgtctggctaccgccgcatcatcaagaaccccatggacttcagcaccatgagggagcggctgctgcggggcggctacaccagcagcgaggagtttgctgctgatgccctgctggtgtttgacaactgccagaccttcaatgaagatgattctgaggtgggcaaggccggccacatcatgaggcgcttctttgagagccgctgggaggagttctaccagggcaagcaggccaacctgtag

SEQ ID NO: 145379 - DNA, 5718 bp, Artificial Sequence
  Description of Artificial Sequence: Synthetic coding sequence
atggagatggaggccaatgaccacttcaacttcaccggcctgcccccagccccagctgccagcggcctgaagcccagccccagcagtggagagggcctgtacaccaacggcagccccatgaacttcccccagcagggcaagagcctgaatggagatgtgaatgtgaatggcctgagcacagtgagccacaccaccaccagcggcatcctgaacagcgccccccacagcagcagcaccagccacctgcaccaccccagcgtggcctatgactgcctgtggaactacagccagtaccccagcgccaaccctggcagcaacctgaaggacccccccctgctgagccagttcagcggcggccagtaccccctgaatggcatcctgggcggcagccggcagcccagcagccccagccacaacaccaacctgcgggccggcagccaggagttctgggccaacggcacccagagccccatgggcctgaactttgacagccaggagctgtatgacagcttcccagaccagaactttgaggtgatgcccaatggacctccttccttcttcaccagcccccagaccagccccatgctgggcagcagcatccagacctttgcccccagccaggaggtgggcagcggcatccacccagatgaggccgctgagaaggagatgacctctgtggtggctgaaaatggcaccggcctggtgggcagcctggagctggaggaggagcagcctgagctgaagatgtgtggctacaatggatctgtgcccagcgtggagagcctgcaccaggaggtgtctgtgctggtgcctgaccccaccgtgtcctgcctggatgaccccagccacctgcctgaccagctggaggacacccccatcctgtctgaggacagcctggagcccttcaacagcctggcccctgagcctgtgtctgggggcctgtatggaattgatgacacagagctgatgggcgctgaggacaagctgcccctggaggacagccctgtgatcagcgccctggactgccccagcctgaacaatgccacagccttcagcctgctggctgatgacagccagaccagcaccagcatctttgccagccccaccagcccccctgtgctgggggagagcgtgctgcaggacaacagctttgacctgaacaacggcagtgatgctgagcaggaggagatggagacccagagcagtgacttcccccccagcctgacccagcctgccccagaccagagcagcaccatccagctgcacccagccaccagccctgctgtgagccccaccaccagccctgctgtgtccctggtggtgtccccagctgccagccctgagatcagccctgaggtgtgcccagctgccagcacagtggtgtccccagctgtgttttctgtggtgtccccagccagcagcgctgtgctgcctgctgtgtccctggaggtgcccctgacagcctctgtgaccagccccaaggccagccctgtgaccagccctgctgctgccttccccacagccagccctgccaacaaggatgtgtcctccttcctggagaccacagcagatgtggaggagatcactggagagggcctgacagccagcggcagcggagatgtgatgagaagacgcatcgccaccccagaggaggtgcggctgcccctgcagcacggctggaggcgggaggtgcgcatcaagaagggcagccaccgctggcagggcgagacctggtactacggcccctgtgggaagaggatgaagcagtttcctgaggtgatcaagtacctgagcagaaatgtggtgcacagcgtgcggcgggagcacttctccttcagccccaggatgcctgtgggggacttctttgaggagcgggacaccccagagggcctgcagtgggtgcagctgtctgctgaggagatccccagccgcatccaggccatcaccgggaagaggggccggcccaggaacacagagaaggccaagaccaaggaggtgcccaaggtgaagaggggccggggccggccccccaaggtgaagatcacagagctgctgaacaagacagacaaccggcccctgaagaagctggaggcccaggagaccctgaatgaggaggacaaggccaagatcgccaagagcaagaagaagatgaggcagaaggtgcagagaggagagtgccagaccaccatccagggccaggccaggaacaagaggaagcaggagaccaagagcctgaagcagaaggaggccaagaagaagagcaaggccgagaaggagaagggcaagaccaagcaggagaagctgaaggagaaggtgaagcgggagaagaaggagaaggtgaagatgaaggagaaggaggaggtgaccaaggccaagccagcctgcaaggctgacaagaccctggccacccagaggcggctggaggagcggcagaggcagcagatgatcctggaggagatgaagaagcccacagaggacatgtgcctgacagaccaccagcccctgcctgacttcagccgggtgcccggcctgaccctgcccagcggggccttcagtgactgcctgaccatcgtggagttcctgcacagctttgggaaggtgctgggctttgatcctgccaaggatgtgcccagcctgggcgtgctgcaggagggcctgctgtgccagggcgacagcctgggggaggtgcaggacctgctggtgcggctgctgaaggccgccctgcatgaccccggcttccccagctactgccagagcctgaagatcctgggggagaaggtgtctgagatccccctgacccgggacaacgtgtctgagatcctgcgctgcttcctgatggcctacggcgtggagcccgccctgtgtgaccggctgcggacccagcccttccaggcccagcccccccagcagaaggctgctgtgctggccttcctggtgcatgagctgaatggcagcaccctcatcatcaatgaaattgacaagaccctggagagcatgagcagctacaggaagaacaagtggatcgtggagggccgcctgcggcggctgaagacagtgctggccaagaggacaggccgctctgaggtggagatggagggccctgaggagtgcctgggcagaagaagaagcagccgcatcatggaggagaccagcggcatggaggaggaggaggaggaggagagcattgctgctgtgcccggccggcggggcagaagagatggagaggtggatgccacagccagcagcatccctgagctggagcggcagatcgagaagctgagcaagaggcagctgttcttcaggaagaagctgctgcacagcagccagatgctgcgggctgtgtccctgggccaggaccgctacagaagacgctactgggtgctgccctacctggccggcatctttgtggagggcacagagggcaacctggtgcctgaggaggtgatcaagaaggagacagacagcctgaaggtggccgcccacgccagcctgaacccagccctcttctccatgaagatggagctggccggcagcaacaccacagccagcagccctgcccgggcccggggccggcccaggaagaccaagccaggctccatgcagcccaggcacctgaagagccctgtgcggggccaggacagcgagcagccccaggcccagctgcagcctgaggcccagctgcacgccccagcccagccccagccccagctgcagctgcagctgcagagccacaagggcttcctggagcaggagggcagccccctgagcctgggccagagccagcacgacctgagccagagcgccttcctgtcctggctgagccagacccagagccacagcagcctgctgagcagctctgtgctgaccccagacagcagccctgggaagctggaccctgcccccagccagcccccagaggagcctgagccagatgaagctgagagcagcccagacccccaggccctgtggttcaacatcagcgcccagatgccctgcaatgctgcccccaccccacctcctgctgtgtctgaggaccagcccacccccagcccccagcagctggccagcagcaagcccatgaaccggcccagcgctgccaacccctgcagccctgtgcagttcagcagcacccccctggccggcctggcccccaagaggcgggccggggaccctggagagatgccccagagccccaccggcctgggccagcccaagaggcggggccggccccccagcaagttcttcaagcagatggagcagcgctacctgacccagctgacagcccagcctgtgcccccagagatgtgcagcggctggtggtggatccgggaccctgagatgctggatgccatgctgaaggccctgcacccccggggcatccgggagaaggccctgcacaagcacctgaacaagcaccgggacttcctgcaggaggtgtgcctgcggcccagcgctgaccccatctttgagccccggcagctgcctgccttccaggagggcatcatgtcctggagccccaaggagaagacctatgaaacagacctggccgtgctgcagtgggtggaggagctggagcagagggtcatcatgtctgacctgcagatccggggctggacctgccccagcccagacagcacccgggaggacctggcctactgtgagcacctgagtgacagccaggaggacatcacctggaggggccggggccgggagggcctggccccccagaggaagaccaccaaccccctggacctggccgtgatgaggctggccgccctggagcagaatgtggagcggcgctacctgcgggagcccctgtggcccacccatgaggtggtgctggagaaggccctgctgagcaccccaaatggagcccctgagggcaccaccacagagatctcctatgagatcaccccccgcatccgggtgtggaggcagaccctggagcgctgccgctctgctgcccaggtgtgcctgtgcctgggccagctggagaggagcatcgcctgggagaagtctgtgaacaaggtgacctgcctggtgtgcaggaagggggacaatgatgagttcctgctgctgtgtgatggctgtgaccggggctgccacatctactgccaccggcccaagatggaggccgtgcctgagggggactggttctgcaccgtgtgcctggcccagcaggtggagggggagttcacccagaagccaggcttccccaagaggggccagaagaggaagagcggctacagcctgaacttctctgaaggagatggaagaagaagaagagtgctgctgcggggccgggagagccctgctgctggcccccgctacagcgaggagggcctgagccccagcaagagaagaaggctgtccatgaggaaccaccacagcgacctgaccttctgtgagatcatcctgatggagatggagagccatgatgctgcctggcccttcctggagcctgtgaacccccggctggtgtctggctaccgccgcatcatcaagaaccccatggacttcagcaccatgagggagcggctgctgcggggcggctacaccagcagcgaggagtttgctgctgatgccctgctggtgtttgacaactgccagaccttcaatgaagatgattctgaggtgggcaaggccggccacatcatgaggcgcttctttgagagccgctgggaggagttctaccagggcaagcaggccaacctgtag

SEQ ID NO: 145380 - DNA, 6207 bp, Artificial Sequence
  Description of Artificial Sequence: Synthetic coding sequence
atggagagcggggagcggctgcccagcagcgctgccagcagcaccacccccaccagcagcagcacccccagcgtggcctctgtggtgtccaaaggaggcctgagcactggagtggccagcctgagcagcaccatcaacccctgtggccacctgttcagaacagctggggaccagcccttcaacctgagcacagtgtcctctgccttccccatggtgagccaccctgtgtttggcctgcacagcgccagcagcggccacagcgagtttggaggcctgggcaccctgggcacccccacagccctggccgcccacccccagctggccagcttccctgagtggtggaggaccacagatgcccacaccaggactggagccaccttcttcccccccctgctgggcatcccccccctgtttgcccccccagcccagaaccacgacagcagcagcttccacagcaggaccagcggcaagagcaacagaaatggacctgagaagggcgtgaatggcagcatcaatggcagcaacaccagcagcgtcatcggcatcaacacctctgtgctgagcaccacagccagcagctccatgggccagaccaagagcaccagcagcggcggcggcaacaggaagtgcaaccaggagcagagcaagaaccagcccctggatgcccgggtggacaagatcaaggacaagaagcccaggaagaaggccatggagagcagcagcaacagcgacagcgacagcggcaccagcagtgacaccagcagcgagggcatcagcagcagtgacagtgatgacctggaggaggatgaggaggaggaggaccagagcattgaggagagtgaagatgatgacagcgacagcgagagcgaggcccagcacaagagcaacaaccaggtgctgctgcacggcatcagtgaccccaaggcagatggccagaaggccacagagaaggcccaggagaagaggatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtcatccagagcacaggcctggtgtccaatgtgaagcccctgagcctggtgaaccaggccaagaaggagacctacatgaagctgattgtgcccagcccagatgtgctgaaggccggcaacaagaacaccagcgaggagagcagcctgctgaccagcgagctgcggagcaagcgggagcagtacaagcaggccttccccagccagctgaagaagcaggagagcagcaagagcctgaagaaggtgattgctgccctgagcaaccccaaggccaccagcagcagccctgcccaccccaagcagaccctggagaacaaccaccccaaccccttcctgaccaatgccctgctgggcaaccaccagcccaatggagtcatccagagcgtcatccaggaggcccccctggccctgaccaccaagaccaagatgcagagcaagatcaatgaaaatattgctgctgccagcagcacccccttcagcagccctgtgaacctgagcaccagcggccgccgcaccccaggcaaccagacccctgtgatgcccagcgccagccccatcctgcacagccagggcaaggagaaggctgtgagcaacaacgtgaaccctgtgaagacccagcaccacagccacccagccaagagcctggtggagcagttccggggcacagacagcgacatccccagcagcaaggacagcgaggacagcaatgaagatgaggaggaggatgatgaggaggaggatgaagaagatgatgaagatgatgaaagtgatgacagccagagcggcaccagcaagagaagaagagtgacagatgagcgggagctgcgcatccccctggagtatggctggcagcgggagacccgcatccggaactttggaggccgcctgcagggcgaggtggcctactatgccccctgtgggaagaagctgcggcagtacccagaggtgatcaagtacctgagcagaaatggcatcatggacatcagccgggacaacttctccttcagcgccaagatccgggtgggggacttctatgaggccagagatggcccccagggcatgcagtggtgcctgctgaaggaggaggatgtgatcccccgcatccgggccatggagggccggcggggccggccccccaacccagaccggcagagggcccgggaggagagcaggatgagaagaaggaagggccggcccccaaatgtgggcaatgctgagttcctggacaatgctgatgccaagctgctgaggaagctgcaggcccaggagatcgcccggcaggccgcccagatcaagctgctgaggaagctgcagaagcaggagcaggcccgggtggccaaggaggccaagaagcagcaggccatcatggctgctgaggagaagaggaagcagaaggagcagatcaagatcatgaagcagcaggagaagatcaagaggatccagcagatccgcatggagaaggagctgcgggcccagcagatcctggaggccaagaagaagaagaaggaggaggccgccaatgccaagctgctggaggccgagaagaggatcaaggagaaggagatgaggcggcagcaggccgtgctgctgaagcaccaggagcgggagcggcggcggcagcacatgatgctgatgaaggccatggaggccaggaagaaggccgaggagaaggagcggctgaagcaggagaagagagatgagaagaggctgaacaaggagaggaagctggagcagaggcggctggagctggagatggccaaggagctgaagaagcccaatgaagacatgtgcctggccgaccagaagcccctgcctgagctgccccgcatccctggcctggtgctgagcggcagcaccttcagtgactgcctgatggtggtgcagttcctgaggaactttgggaaggtgctgggctttgatgtgaacattgatgtgcccaacctgtctgtgctgcaggagggcctgctgaacatcggggacagcatgggagaggtgcaggacctgctggtgcggctgctgtctgctgctgtgtgtgaccccggcctcatcaccggctacaaggccaagacagccctgggggagcacctgctgaatgtgggcgtgaacagagacaacgtgtctgagatcctgcagatcttcatggaggcccactgcggccagacagagctgacagagagcctgaagaccaaggccttccaggcccacaccccagcccagaaggcctctgtgctggccttcctgatcaatgagctggcctgcagcaagtctgtggtgtctgaaattgacaagaacatcgactacatgagcaacctgcggcgggacaagtgggtggtggagggcaagctgaggaagctgcgcatcatccacgccaagaagacaggcaagagggacaccagcggcggcatcgacctgggggaggagcagcaccccctgggcacccccaccccaggcaggaagagaagaagaaaaggaggagacagcgactatgatgatgatgatgatgatgacagtgatgaccagggagatgaagatgatgaagatgaggaggacaaggaggacaagaagggcaagaagacagacatctgtgaagatgaagatgaaggagaccaggccgcctctgtggaggagctggagaagcagatcgagaagctgagcaagcagcagagccagtacagaaggaagctgtttgatgccagccacagcctgcggtctgtgatgtttggccaggaccgctacagaagacgctactggatcctgccccagtgtggcggcatctttgtggagggcatggagagcggggagggcctggaggagatcgccaaggagcgggagaagctgaagaaggccgagagcgtgcagatcaaggaggagatgtttgagaccagcggggacagcctgaactgcagcaacacagaccactgtgagcagaaggaggacctgaaggagaaggacaacaccaacctcttcctgcagaagccaggcagcttcagcaagctgagcaagctgctggaggtggccaagatgcctcctgagagcgaggtgatgacccccaagcccaatgctggggccaacggctgcaccctgagctaccagaacagcggcaagcacagcctgggctctgtgcagagcacagccacccagagcaatgtggagaaggctgacagcaacaacctcttcaacacaggcagcagcggccctgggaagttctacagccccctgcccaatgaccagctgctgaagaccctgacagagaagaaccggcagtggttcagcctgctgcccaggaccccctgtgatgacaccagcctgacccacgccgacatgagcacagccagcctggtgaccccccagagccagccccccagcaagagccccagccccaccccagcccccctgggcagcagcgcccagaaccctgtgggcctgaacccctttgccctgagccccctgcaggtgaagggcggcgtgtccatgatgggcctgcagttctgtggctggcccaccggggtggtgaccagcaacatccccttcaccagctctgtgcccagcctgggcagcggcctgggcctgtctgagggcaatggaaacagcttcctgaccagcaatgtggccagcagcaagtctgagagccctgtgccccagaatgagaaggccaccagcgcccagcctgctgctgtggaggtggccaagcctgtggacttccccagccccaagcccatccctgaggagatgcagtttggctggtggaggatcatcgaccctgaggacctgaaggccctgctgaaggtgctgcacctgcggggcatccgggagaaggccctgcagaagcagatccagaagcacctggactacatcacccaggcctgcctgaagaacaaggatgtggccatcatcgagctgaatgaaaatgaggagaaccaggtgacccgggacatcgtggagaactggagcgtggaggagcaggccatggagatggacctgtctgtgctgcagcaggtggaggacctggagcggcgggtggccagcgccagcctgcaggtgaagggctggatgtgcccagagcccgccagcgagcgggaggacctggtgtactttgagcacaagagcttcaccaagctgtgcaaggagcatgatggagagttcaccggggaggatgagagcagcgcccacgccctggagaggaagagtgacaaccccctggacattgctgtgacccggctggccgacctggagaggaacatcgagcggcgcatcgaggaggacatcgcccctggcctgcgggtgtggaggcgggccctgtctgaggcccggtctgctgcccaggtggccctgtgcatccagcagctgcagaagagcatcgcctgggagaagagcatcatgaaggtgtactgccagatctgcaggaaaggagacaatgaggagctgctgctgctgtgtgatggctgtgacaagggctgccacacctactgccaccggcccaagatcaccaccatcccagatggagactggttctgcccagcctgcatcgccaaggccagcggccagaccctgaagatcaagaagctgcacgtgaagggcaagaagaccaatgaaagcaagaagggcaagaaggtgaccctgactggagacacagaagatgaagattctgccagcaccagcagcagcctgaagaggggcaacaaggacctgaagaagaggaagatggaggagaacaccagcatcaacctgagcaagcaggagagcttcacctctgtgaagaagcccaagagagatgacagcaaggacctggccctgtgcagcatgatcctgacagagatggagacccatgaagatgcctggcccttcctgctgcctgtgaacctgaagctggtgcccggctacaagaaggtgatcaagaagcccatggacttcagcaccatccgggagaagctgagcagcggccagtaccccaacctggagacctttgccctggatgtgcggctggtgtttgacaactgtgagaccttcaatgaagatgacagcgacatcggccgggccggccacaacatgaggaagtactttgagaagaagtggacagacaccttcaaggtgtcctag

SEQ ID NO: 145381 - DNA, 6405 bp, Artificial Sequence
  Description of Artificial Sequence: Synthetic coding sequence
atggagagcggggagcggctgcccagcagcgctgccagcagcaccacccccaccagcagcagcacccccagcgtggcctctgtggtgtccaaaggaggcctgagcactggagtggccagcctgagcagcaccatcaacccctgtggccacctgttcagaacagctggggaccagcccttcaacctgagcacagtgtcctctgccttccccatggtgagccaccctgtgtttggcctgcacagcgccagcagcggccacagcgagtttggaggcctgggcaccctgggcacccccacagccctggccgcccacccccagctggccagcttccctggagctgagtggtggaggaccacagatgcccacaccaggactggagccaccttcttcccccccctgctgggcatcccccccctgtttgcccccccagcccagaaccacgacagcagcagcttccacagcaggaccagcggcaagagcaacagaaatggacctgagaagggcgtgaatggcagcatcaatggcagcaacaccagcagcgtcatcggcatcaacacctctgtgctgagcaccacagccagcagctccatgggccagaccaagagcaccagcagcggcggcggcaacaggaagtgcaaccaggagcagagcaagaaccagcccctggatgcccgggtggacaagatcaaggacaagaagcccaggaagaaggccatggagagcagcagcaacagcgacagcgacagcggcaccagcagtgacaccagcagcgagggcatcagcagcagtgacagtgatgacctggaggaggatgaggaggaggaggaccagagcattgaggagagtgaagatgatgacagcgacagcgagagcgaggcccagcacaagagcaacaaccaggtgctgctgcacggcatcagtgaccccaaggcagatggccagaaggccacagagaaggcccaggagaagaggatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtcatccagagcacaggcctggtgtccaatgtgaagcccctgagcctggtgaaccaggccaagaaggagacctacatgaagctgattgtgcccagcccagatgtgctgaaggccggcaacaagaacaccagcgaggagagcagcctgctgaccagcgagctgcggagcaagcgggagcagtacaagcaggccttccccagccagctgaagaagcaggagagcagcaagagcctgaagaaggtgattgctgccctgagcaaccccaaggccaccagcagcagccctgcccaccccaagcagaccctggagaacaaccaccccaaccccttcctgaccaatgccctgctgggcaaccaccagcccaatggagtcatccagagcgtcatccaggaggcccccctggccctgaccaccaagaccaagatgcagagcaagatcaatgaaaatattgctgctgccagcagcacccccttcagcagccctgtgaacctgagcaccagcggccgccgcaccccaggcaaccagacccctgtgatgcccagcgccagccccatcctgcacagccagggcaaggagaaggctgtgagcaacaacgtgaaccctgtgaagacccagcaccacagccacccagccaagagcctggtggagcagttccggggcacagacagcgacatccccagcagcaaggacagcgaggacagcaatgaagatgaggaggaggatgatgaggaggaggatgaagaagatgatgaagatgatgaaagtgatgacagccagagcgagagtgacagcaacagcgagagtgacacagagggcagcgaggaggaggatgatgatgacaaggaccaggatgaaagtgacagcgacacagaaggagagaagacctccatgaagctgaacaagaccaccagctctgtgaagagccccagcatgagcctgaccggccacagcaccccaagaaacctgcacatcgccaaggcccctggcagcgccccagctgccctgtgcagcgagagccagagccctgccttcctgggcaccagcagcagcaccctgaccagcagcccccacagcggcaccagcaagagaagaagagtgacagatgagcgggagctgcgcatccccctggagtatggctggcagcgggagacccgcatccggaactttggaggccgcctgcagggcgaggtggcctactatgccccctgtgggaagaagctgcggcagtacccagaggtgatcaagggcatgcagtggtgcctgctgaaggaggaggatgtgatcccccgcatccgggccatggagggccggcggggccggccccccaacccagaccggcagagggcccgggaggagagcaggatgagaagaaggaagggccggcccccaaatgtgggcaatgctgagttcctggacaatgctgatgccaagctgctgaggaagctgcaggcccaggagatcgcccggcaggccgcccagatcaagctgctgaggaagctgcagaagcaggagcaggcccgggtggccaaggaggccaagaagcagcaggccatcatggctgctgaggagaagaggaagcagaaggagcagatcaagatcatgaagcagcaggagaagatcaagaggatccagcagatccgcatggagaaggagctgcgggcccagcagatcctggaggccaagaagaagaagaaggaggaggccgccaatgccaagctgctggaggccgagaagaggatcaaggagaaggagatgaggcggcagcaggccgtgctgctgaagcaccaggagcgggagcggcggcggcagcacatgatgctgatgaaggccatggaggccaggaagaaggccgaggagaaggagcggctgaagcaggagaagagagatgagaagaggctgaacaaggagaggaagctggagcagaggcggctggagctggagatggccaaggagctgaagaagcccaatgaagacatgtgcctggccgaccagaagcccctgcctgagctgccccgcatccctggcctggtgctgagcggcagcaccttcagtgactgcctgatggtggtgcagttcctgaggaactttgggaaggtgctgggctttgatgtgaacattgatgtgcccaacctgtctgtgctgcaggagggcctgctgaacatcggggacagcatgggagaggtgcaggacctgctggtgcggctgctgtctgctgctgtgtgtgaccccggcctcatcaccggctacaaggccaagacagccctgggggagcacctgctgaatgtgggcgtgaacagagacaacgtgtctgagatcctgcagatcttcatggaggcccactgcggccagacagagctgacagagagcctgaagaccaaggccttccaggcccacaccccagcccagaaggcctctgtgctggccttcctgatcaatgagctggcctgcagcaagtctgtggtgtctgaaattgacaagaacatcgactacatgagcaacctgcggcgggacaagtgggtggtggagggcaagctgaggaagctgcgcatcatccacgccaagaagacaggcaagagggacaccagcggcggcatcgacctgggggaggagcagcaccccctgggcacccccaccccaggcaggaagagaagaagaaaaggaggagacagcgactatgatgatgatgatgatgatgacagtgatgaccagggagatgaagatgatgaagatgaggaggacaaggaggacaagaagggcaagaagacagacatctgtgaagatgaagatgaaggagaccaggccgcctctgtggaggagctggagaagcagatcgagaagctgagcaagcagcagagccagtacagaaggaagctgtttgatgccagccacagcctgcggtctgtgatgtttggccaggaccgctacagaagacgctactggatcctgccccagtgtggcggcatctttgtggagggcatggagagcggggagggcctggaggagatcgccaaggagcgggagaagctgaagaaggccgagagcgtgcagatcaaggaggagatgtttgagaccagcggggacagcctgaactgcagcaacacagaccactgtgagcagaaggaggacctgaaggagaaggacaacaccaacctcttcctgcagaagccaggcagcttcagcaagctgagcaagctgctggaggtggccaagatgcctcctgagagcgaggtgatgacccccaagcccaatgctggggccaacggctgcaccctgagctaccagaacagcggcaagcacagcctgggctctgtgcagagcacagccacccagagcaatgtggagaaggctgacagcaacaacctcttcaacacaggcagcagcggccctgggaagttctacagccccctgcccaatgaccagctgctgaagaccctgacagagaagaaccggcagtggttcagcctgctgcccaggaccccctgtgatgacaccagcctgacccacgccgacatgagcacagccagcctggtgaccccccagagccagccccccagcaagagccccagccccaccccagcccccctgggcagcagcgcccagaaccctgtgggcctgaacccctttgccctgagccccctgcaggtgaagggcggcgtgtccatgatgggcctgcagttctgtggctggcccaccggggtggtgaccagcaacatccccttcaccagctctgtgcccagcctgggcagcggcctgggcctgtctgagggcaatggaaacagcttcctgaccagcaatgtggccagcagcaagtctgagagccctgtgccccagaatgagaaggccaccagcgcccagcctgctgctgtggaggtggccaagcctgtggacttccccagccccaagcccatccctgaggagatgcagtttggctggtggaggatcatcgaccctgaggacctgaaggccctgctgaaggtgctgcacctgcggggcatccgggagaaggccctgcagaagcagatccagaagcacctggactacatcacccaggcctgcctgaagaacaaggatgtggccatcatcgagctgaatgaaaatgaggagaaccaggtgacccgggacatcgtggagaactggagcgtggaggagcaggccatggagatggacctgtctgtgctgcagcaggtggaggacctggagcggcgggtggccagcgccagcctgcaggtgaagggctggatgtgcccagagcccgccagcgagcgggaggacctggtgtactttgagcacaagagcttcaccaagctgtgcaaggagcatgatggagagttcaccggggaggatgagagcagcgcccacgccctggagaggaagagtgacaaccccctggacattgctgtgacccggctggccgacctggagaggaacatcgagcggcgcatcgaggaggacatcgcccctggcctgcgggtgtggaggcgggccctgtctgaggcccggtctgctgcccaggtggccctgtgcatccagcagctgcagaagagcatcgcctgggagaagagcatcatgaaggtgtactgccagatctgcaggaaaggagacaatgaggagctgctgctgctgtgtgatggctgtgacaagggctgccacacctactgccaccggcccaagatcaccaccatcccagatggagactggttctgcccagcctgcatcgccaaggccagcggccagaccctgaagatcaagaagctgcacgtgaagggcaagaagaccaatgaaagcaagaagggcaagaaggtgaccctgactggagacacagaagatgaagattctgccagcaccagcagcagcctgaagaggggcaacaaggacctgaagaagaggaagatggaggagaacaccagcatcaacctgagcaagcaggagagcttcacctctgtgaagaagcccaagagagatgacagcaaggacctggccctgtgcagcatgatcctgacagagatggagacccatgaagatgcctggcccttcctgctgcctgtgaacctgaagctggtgcccggctacaagaaggtgatcaagaagcccatggacttcagcaccatccgggagaagctgagcagcggccagtaccccaacctggagacctttgccctggatgtgcggctggtgtttgacaactgtgagaccttcaatgaagatgacagcgacatcggccgggccggccacaacatgaggaagtactttgagaagaagtggacagacaccttcaaggtgtcctag

SEQ ID NO: 145382 - DNA, 6399 bp, Artificial Sequence
  Description of Artificial Sequence: Synthetic coding sequence
atggagagcggggagcggctgcccagcagcgctgccagcagcaccacccccaccagcagcagcacccccagcgtggcctctgtggtgtccaaaggaggcctgagcactggagtggccagcctgagcagcaccatcaacccctgtggccacctgttcagaacagctggggaccagcccttcaacctgagcacagtgtcctctgccttccccatggtgagccaccctgtgtttggcctgcacagcgccagcagcggccacagcgagtttggaggcctgggcaccctgggcacccccacagccctggccgcccacccccagctggccagcttccctgagtggtggaggaccacagatgcccacaccaggactggagccaccttcttcccccccctgctgggcatcccccccctgtttgcccccccagcccagaaccacgacagcagcagcttccacagcaggaccagcggcaagagcaacagaaatggacctgagaagggcgtgaatggcagcatcaatggcagcaacaccagcagcgtcatcggcatcaacacctctgtgctgagcaccacagccagcagctccatgggccagaccaagagcaccagcagcggcggcggcaacaggaagtgcaaccaggagcagagcaagaaccagcccctggatgcccgggtggacaagatcaaggacaagaagcccaggaagaaggccatggagagcagcagcaacagcgacagcgacagcggcaccagcagtgacaccagcagcgagggcatcagcagcagtgacagtgatgacctggaggaggatgaggaggaggaggaccagagcattgaggagagtgaagatgatgacagcgacagcgagagcgaggcccagcacaagagcaacaaccaggtgctgctgcacggcatcagtgaccccaaggcagatggccagaaggccacagagaaggcccaggagaagaggatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtcatccagagcacaggcctggtgtccaatgtgaagcccctgagcctggtgaaccaggccaagaaggagacctacatgaagctgattgtgcccagcccagatgtgctgaaggccggcaacaagaacaccagcgaggagagcagcctgctgaccagcgagctgcggagcaagcgggagcagtacaagcaggccttccccagccagctgaagaagcaggagagcagcaagagcctgaagaaggtgattgctgccctgagcaaccccaaggccaccagcagcagccctgcccaccccaagcagaccctggagaacaaccaccccaaccccttcctgaccaatgccctgctgggcaaccaccagcccaatggagtcatccagagcgtcatccaggaggcccccctggccctgaccaccaagaccaagatgcagagcaagatcaatgaaaatattgctgctgccagcagcacccccttcagcagccctgtgaacctgagcaccagcggccgccgcaccccaggcaaccagacccctgtgatgcccagcgccagccccatcctgcacagccagggcaaggagaaggctgtgagcaacaacgtgaaccctgtgaagacccagcaccacagccacccagccaagagcctggtggagcagttccggggcacagacagcgacatccccagcagcaaggacagcgaggacagcaatgaagatgaggaggaggatgatgaggaggaggatgaagaagatgatgaagatgatgaaagtgatgacagccagagcgagagtgacagcaacagcgagagtgacacagagggcagcgaggaggaggatgatgatgacaaggaccaggatgaaagtgacagcgacacagaaggagagaagacctccatgaagctgaacaagaccaccagctctgtgaagagccccagcatgagcctgaccggccacagcaccccaagaaacctgcacatcgccaaggcccctggcagcgccccagctgccctgtgcagcgagagccagagccctgccttcctgggcaccagcagcagcaccctgaccagcagcccccacagcggcaccagcaagagaagaagagtgacagatgagcgggagctgcgcatccccctggagtatggctggcagcgggagacccgcatccggaactttggaggccgcctgcagggcgaggtggcctactatgccccctgtgggaagaagctgcggcagtacccagaggtgatcaagggcatgcagtggtgcctgctgaaggaggaggatgtgatcccccgcatccgggccatggagggccggcggggccggccccccaacccagaccggcagagggcccgggaggagagcaggatgagaagaaggaagggccggcccccaaatgtgggcaatgctgagttcctggacaatgctgatgccaagctgctgaggaagctgcaggcccaggagatcgcccggcaggccgcccagatcaagctgctgaggaagctgcagaagcaggagcaggcccgggtggccaaggaggccaagaagcagcaggccatcatggctgctgaggagaagaggaagcagaaggagcagatcaagatcatgaagcagcaggagaagatcaagaggatccagcagatccgcatggagaaggagctgcgggcccagcagatcctggaggccaagaagaagaagaaggaggaggccgccaatgccaagctgctggaggccgagaagaggatcaaggagaaggagatgaggcggcagcaggccgtgctgctgaagcaccaggagcgggagcggcggcggcagcacatgatgctgatgaaggccatggaggccaggaagaaggccgaggagaaggagcggctgaagcaggagaagagagatgagaagaggctgaacaaggagaggaagctggagcagaggcggctggagctggagatggccaaggagctgaagaagcccaatgaagacatgtgcctggccgaccagaagcccctgcctgagctgccccgcatccctggcctggtgctgagcggcagcaccttcagtgactgcctgatggtggtgcagttcctgaggaactttgggaaggtgctgggctttgatgtgaacattgatgtgcccaacctgtctgtgctgcaggagggcctgctgaacatcggggacagcatgggagaggtgcaggacctgctggtgcggctgctgtctgctgctgtgtgtgaccccggcctcatcaccggctacaaggccaagacagccctgggggagcacctgctgaatgtgggcgtgaacagagacaacgtgtctgagatcctgcagatcttcatggaggcccactgcggccagacagagctgacagagagcctgaagaccaaggccttccaggcccacaccccagcccagaaggcctctgtgctggccttcctgatcaatgagctggcctgcagcaagtctgtggtgtctgaaattgacaagaacatcgactacatgagcaacctgcggcgggacaagtgggtggtggagggcaagctgaggaagctgcgcatcatccacgccaagaagacaggcaagagggacaccagcggcggcatcgacctgggggaggagcagcaccccctgggcacccccaccccaggcaggaagagaagaagaaaaggaggagacagcgactatgatgatgatgatgatgatgacagtgatgaccagggagatgaagatgatgaagatgaggaggacaaggaggacaagaagggcaagaagacagacatctgtgaagatgaagatgaaggagaccaggccgcctctgtggaggagctggagaagcagatcgagaagctgagcaagcagcagagccagtacagaaggaagctgtttgatgccagccacagcctgcggtctgtgatgtttggccaggaccgctacagaagacgctactggatcctgccccagtgtggcggcatctttgtggagggcatggagagcggggagggcctggaggagatcgccaaggagcgggagaagctgaagaaggccgagagcgtgcagatcaaggaggagatgtttgagaccagcggggacagcctgaactgcagcaacacagaccactgtgagcagaaggaggacctgaaggagaaggacaacaccaacctcttcctgcagaagccaggcagcttcagcaagctgagcaagctgctggaggtggccaagatgcctcctgagagcgaggtgatgacccccaagcccaatgctggggccaacggctgcaccctgagctaccagaacagcggcaagcacagcctgggctctgtgcagagcacagccacccagagcaatgtggagaaggctgacagcaacaacctcttcaacacaggcagcagcggccctgggaagttctacagccccctgcccaatgaccagctgctgaagaccctgacagagaagaaccggcagtggttcagcctgctgcccaggaccccctgtgatgacaccagcctgacccacgccgacatgagcacagccagcctggtgaccccccagagccagccccccagcaagagccccagccccaccccagcccccctgggcagcagcgcccagaaccctgtgggcctgaacccctttgccctgagccccctgcaggtgaagggcggcgtgtccatgatgggcctgcagttctgtggctggcccaccggggtggtgaccagcaacatccccttcaccagctctgtgcccagcctgggcagcggcctgggcctgtctgagggcaatggaaacagcttcctgaccagcaatgtggccagcagcaagtctgagagccctgtgccccagaatgagaaggccaccagcgcccagcctgctgctgtggaggtggccaagcctgtggacttccccagccccaagcccatccctgaggagatgcagtttggctggtggaggatcatcgaccctgaggacctgaaggccctgctgaaggtgctgcacctgcggggcatccgggagaaggccctgcagaagcagatccagaagcacctggactacatcacccaggcctgcctgaagaacaaggatgtggccatcatcgagctgaatgaaaatgaggagaaccaggtgacccgggacatcgtggagaactggagcgtggaggagcaggccatggagatggacctgtctgtgctgcagcaggtggaggacctggagcggcgggtggccagcgccagcctgcaggtgaagggctggatgtgcccagagcccgccagcgagcgggaggacctggtgtactttgagcacaagagcttcaccaagctgtgcaaggagcatgatggagagttcaccggggaggatgagagcagcgcccacgccctggagaggaagagtgacaaccccctggacattgctgtgacccggctggccgacctggagaggaacatcgagcggcgcatcgaggaggacatcgcccctggcctgcgggtgtggaggcgggccctgtctgaggcccggtctgctgcccaggtggccctgtgcatccagcagctgcagaagagcatcgcctgggagaagagcatcatgaaggtgtactgccagatctgcaggaaaggagacaatgaggagctgctgctgctgtgtgatggctgtgacaagggctgccacacctactgccaccggcccaagatcaccaccatcccagatggagactggttctgcccagcctgcatcgccaaggccagcggccagaccctgaagatcaagaagctgcacgtgaagggcaagaagaccaatgaaagcaagaagggcaagaaggtgaccctgactggagacacagaagatgaagattctgccagcaccagcagcagcctgaagaggggcaacaaggacctgaagaagaggaagatggaggagaacaccagcatcaacctgagcaagcaggagagcttcacctctgtgaagaagcccaagagagatgacagcaaggacctggccctgtgcagcatgatcctgacagagatggagacccatgaagatgcctggcccttcctgctgcctgtgaacctgaagctggtgcccggctacaagaaggtgatcaagaagcccatggacttcagcaccatccgggagaagctgagcagcggccagtaccccaacctggagacctttgccctggatgtgcggctggtgtttgacaactgtgagaccttcaatgaagatgacagcgacatcggccgggccggccacaacatgaggaagtactttgagaagaagtggacagacaccttcaaggtgtcctag

SEQ ID NO: 145383 - DNA, 6507 bp, Artificial Sequence
  Description of Artificial Sequence: Synthetic coding sequence
atggagagcggggagcggctgcccagcagcgctgccagcagcaccacccccaccagcagcagcacccccagcgtggcctctgtggtgtccaaaggaggcctgagcactggagtggccagcctgagcagcaccatcaacccctgtggccacctgttcagaacagctggggaccagcccttcaacctgagcacagtgtcctctgccttccccatggtgagccaccctgtgtttggcctgcacagcgccagcagcggccacagcgagtttggaggcctgggcaccctgggcacccccacagccctggccgcccacccccagctggccagcttccctggagctgagtggtggaggaccacagatgcccacaccaggactggagccaccttcttcccccccctgctgggcatcccccccctgtttgcccccccagcccagaaccacgacagcagcagcttccacagcaggaccagcggcaagagcaacagaaatggacctgagaagggcgtgaatggcagcatcaatggcagcaacaccagcagcgtcatcggcatcaacacctctgtgctgagcaccacagccagcagctccatgggccagaccaagagcaccagcagcggcggcggcaacaggaagtgcaaccaggagcagagcaagaaccagcccctggatgcccgggtggacaagatcaaggacaagaagcccaggaagaaggccatggagagcagcagcaacagcgacagcgacagcggcaccagcagtgacaccagcagcgagggcatcagcagcagtgacagtgatgacctggaggaggatgaggaggaggaggaccagagcattgaggagagtgaagatgatgacagcgacagcgagagcgaggcccagcacaagagcaacaaccaggtgctgctgcacggcatcagtgaccccaaggcagatggccagaaggccacagagaaggcccaggagaagaggatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtcatccagagcacaggcctggtgtccaatgtgaagcccctgagcctggtgaaccaggccaagaaggagacctacatgaagctgattgtgcccagcccagatgtgctgaaggccggcaacaagaacaccagcgaggagagcagcctgctgaccagcgagctgcggagcaagcgggagcagtacaagcaggccttccccagccagctgaagaagcaggagagcagcaagagcctgaagaaggtgattgctgccctgagcaaccccaaggccaccagcagcagccctgcccaccccaagcagaccctggagaacaaccaccccaaccccttcctgaccaatgccctgctgggcaaccaccagcccaatggagtcatccagagcgtcatccaggaggcccccctggccctgaccaccaagaccaagatgcagagcaagatcaatgaaaatattgctgctgccagcagcacccccttcagcagccctgtgaacctgagcaccagcggccgccgcaccccaggcaaccagacccctgtgatgcccagcgccagccccatcctgcacagccagggcaaggagaaggctgtgagcaacaacgtgaaccctgtgaagacccagcaccacagccacccagccaagagcctggtggagcagttccggggcacagacagcgacatccccagcagcaaggacagcgaggacagcaatgaagatgaggaggaggatgatgaggaggaggatgaagaagatgatgaagatgatgaaagtgatgacagccagagcgagagtgacagcaacagcgagagtgacacagagggcagcgaggaggaggatgatgatgacaaggaccaggatgaaagtgacagcgacacagaaggagagaagacctccatgaagctgaacaagaccaccagctctgtgaagagccccagcatgagcctgaccggccacagcaccccaagaaacctgcacatcgccaaggcccctggcagcgccccagctgccctgtgcagcgagagccagagccctgccttcctgggcaccagcagcagcaccctgaccagcagcccccacagcggcaccagcaagagaagaagagtgacagatgagcgggagctgcgcatccccctggagtatggctggcagcgggagacccgcatccggaactttggaggccgcctgcagggcgaggtggcctactatgccccctgtgggaagaagctgcggcagtacccagaggtgatcaagtacctgagcagaaatggcatcatggacatcagccgggacaacttctccttcagcgccaagatccgggtgggggacttctatgaggccagagatggcccccagggcatgcagtggtgcctgctgaaggaggaggatgtgatcccccgcatccgggccatggagggccggcggggccggccccccaacccagaccggcagagggcccgggaggagagcaggatgagaagaaggaagggccggcccccaaatgtgggcaatgctgagttcctggacaatgctgatgccaagctgctgaggaagctgcaggcccaggagatcgcccggcaggccgcccagatcaagctgctgaggaagctgcagaagcaggagcaggcccgggtggccaaggaggccaagaagcagcaggccatcatggctgctgaggagaagaggaagcagaaggagcagatcaagatcatgaagcagcaggagaagatcaagaggatccagcagatccgcatggagaaggagctgcgggcccagcagatcctggaggccaagaagaagaagaaggaggaggccgccaatgccaagctgctggaggccgagaagaggatcaaggagaaggagatgaggcggcagcaggccgtgctgctgaagcaccaggagcgggagcggcggcggcagcacatgatgctgatgaaggccatggaggccaggaagaaggccgaggagaaggagcggctgaagcaggagaagagagatgagaagaggctgaacaaggagaggaagctggagcagaggcggctggagctggagatggccaaggagctgaagaagcccaatgaagacatgtgcctggccgaccagaagcccctgcctgagctgccccgcatccctggcctggtgctgagcggcagcaccttcagtgactgcctgatggtggtgcagttcctgaggaactttgggaaggtgctgggctttgatgtgaacattgatgtgcccaacctgtctgtgctgcaggagggcctgctgaacatcggggacagcatgggagaggtgcaggacctgctggtgcggctgctgtctgctgctgtgtgtgaccccggcctcatcaccggctacaaggccaagacagccctgggggagcacctgctgaatgtgggcgtgaacagagacaacgtgtctgagatcctgcagatcttcatggaggcccactgcggccagacagagctgacagagagcctgaagaccaaggccttccaggcccacaccccagcccagaaggcctctgtgctggccttcctgatcaatgagctggcctgcagcaagtctgtggtgtctgaaattgacaagaacatcgactacatgagcaacctgcggcgggacaagtgggtggtggagggcaagctgaggaagctgcgcatcatccacgccaagaagacaggcaagagggacaccagcggcggcatcgacctgggggaggagcagcaccccctgggcacccccaccccaggcaggaagagaagaagaaaaggaggagacagcgactatgatgatgatgatgatgatgacagtgatgaccagggagatgaagatgatgaagatgaggaggacaaggaggacaagaagggcaagaagacagacatctgtgaagatgaagatgaaggagaccaggccgcctctgtggaggagctggagaagcagatcgagaagctgagcaagcagcagagccagtacagaaggaagctgtttgatgccagccacagcctgcggtctgtgatgtttggccaggaccgctacagaagacgctactggatcctgccccagtgtggcggcatctttgtggagggcatggagagcggggagggcctggaggagatcgccaaggagcgggagaagctgaagaaggccgagagcgtgcagatcaaggaggagatgtttgagaccagcggggacagcctgaactgcagcaacacagaccactgtgagcagaaggaggacctgaaggagaaggacaacaccaacctcttcctgcagaagccaggcagcttcagcaagctgagcaagctgctggaggtggccaagatgcctcctgagagcgaggtgatgacccccaagcccaatgctggggccaacggctgcaccctgagctaccagaacagcggcaagcacagcctgggctctgtgcagagcacagccacccagagcaatgtggagaaggctgacagcaacaacctcttcaacacaggcagcagcggccctgggaagttctacagccccctgcccaatgaccagctgctgaagaccctgacagagaagaaccggcagtggttcagcctgctgcccaggaccccctgtgatgacaccagcctgacccacgccgacatgagcacagccagcctggtgaccccccagagccagccccccagcaagagccccagccccaccccagcccccctgggcagcagcgcccagaaccctgtgggcctgaacccctttgccctgagccccctgcaggtgaagggcggcgtgtccatgatgggcctgcagttctgtggctggcccaccggggtggtgaccagcaacatccccttcaccagctctgtgcccagcctgggcagcggcctgggcctgtctgagggcaatggaaacagcttcctgaccagcaatgtggccagcagcaagtctgagagccctgtgccccagaatgagaaggccaccagcgcccagcctgctgctgtggaggtggccaagcctgtggacttccccagccccaagcccatccctgaggagatgcagtttggctggtggaggatcatcgaccctgaggacctgaaggccctgctgaaggtgctgcacctgcggggcatccgggagaaggccctgcagaagcagatccagaagcacctggactacatcacccaggcctgcctgaagaacaaggatgtggccatcatcgagctgaatgaaaatgaggagaaccaggtgacccgggacatcgtggagaactggagcgtggaggagcaggccatggagatggacctgtctgtgctgcagcaggtggaggacctggagcggcgggtggccagcgccagcctgcaggtgaagggctggatgtgcccagagcccgccagcgagcgggaggacctggtgtactttgagcacaagagcttcaccaagctgtgcaaggagcatgatggagagttcaccggggaggatgagagcagcgcccacgccctggagaggaagagtgacaaccccctggacattgctgtgacccggctggccgacctggagaggaacatcgagcggcgcatcgaggaggacatcgcccctggcctgcgggtgtggaggcgggccctgtctgaggcccggtctgctgcccaggtggccctgtgcatccagcagctgcagaagagcatcgcctgggagaagagcatcatgaaggtgtactgccagatctgcaggaaaggagacaatgaggagctgctgctgctgtgtgatggctgtgacaagggctgccacacctactgccaccggcccaagatcaccaccatcccagatggagactggttctgcccagcctgcatcgccaaggccagcggccagaccctgaagatcaagaagctgcacgtgaagggcaagaagaccaatgaaagcaagaagggcaagaaggtgaccctgactggagacacagaagatgaagattctgccagcaccagcagcagcctgaagaggggcaacaaggacctgaagaagaggaagatggaggagaacaccagcatcaacctgagcaagcaggagagcttcacctctgtgaagaagcccaagagagatgacagcaaggacctggccctgtgcagcatgatcctgacagagatggagacccatgaagatgcctggcccttcctgctgcctgtgaacctgaagctggtgcccggctacaagaaggtgatcaagaagcccatggacttcagcaccatccgggagaagctgagcagcggccagtaccccaacctggagacctttgccctggatgtgcggctggtgtttgacaactgtgagaccttcaatgaagatgacagcgacatcggccgggccggccacaacatgaggaagtactttgagaagaagtggacagacaccttcaaggtgtcctag

SEQ ID NO: 145384 - DNA, 432 bp, Artificial Sequence
  Description of Artificial Sequence: Synthetic coding sequence
atggagagcggggagcggctgcccagcagcgctgccagcagcaccacccccaccagcagcagcacccccagcgtggcctctgtggtgtccaaaggaggcctgagcactggagtggccagcctgagcagcaccatcaacccctgtggccacctgttcagaacagctggggaccagcccttcaacctgagcacagtgtcctctgccttccccatggtgagccaccctgtgtttggcctgcacagcgccagcagcggccacagcgagtttggaggcctgggcaccctgggcacccccacagccctggccgcccacccccagctggccagcttccctggagctgagtggtggaggaccacagatgcccacaccaggactggagccaccttcttcccccccctgctgggcatcccccccctgtttgccccaccctag

SEQ ID NO: 145385 - DNA, 1563 bp, Artificial Sequence
  Description of Artificial Sequence: Synthetic coding sequence
atggagagcggggagcggctgcccagcagcgctgccagcagcaccacccccaccagcagcagcacccccagcgtggcctctgtggtgtccaaaggaggcctgagcactggagtggccagcctgagcagcaccatcaacccctgtggggctgagtggtggaggaccacagatgcccacaccaggactggagccaccttcttcccccccctgctgggcatcccccccctgtttgcccccccagcccagaaccacgacagcagcagcttccacagcaggaccagcggcaagagcaacagaaatggacctgagaagggcgtgaatggcagcatcaatggcagcaacaccagctctgtgattggcatcaacacctctgtgctgagcaccacagccagcagctccatgggccagaccaagagcaccagcagcggcggcggcaacaggaagtgcaaccaggagcagagcaagaaccagcccctggatgcccgggtggacaagatcaaggacaagaagcccaggaagaaggccatggagagcagcagcaacagcgacagcgacagcggcaccagcagtgacaccagcagcgagggcatcagcagcagtgacagtgatgacctggaggaggatgaggaggaggaggaccagagcattgaggagagtgaagatgatgacagcgacagcgagagcgaggcccagcacaagagcaacaaccaggtgctgctgcacggcatcagtgaccccaaggcagatggccagaaggccacagagaaggcccaggagaagaggatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtcatccagagcacaggcctggtgtccaatgtgaagcccctgagcctggtgaaccaggccaagaaggagacctacatgaagctgattgtgcccagcccagatgtgctgaaggccggcaacaagaacaccagcgaggagagcagcctgctgaccagcgagctgcggagcaagcgggagcagtacaagcaggccttccccagccagctgaagaagcaggagagcagcaagagcctgaagaaggtgattgctgccctgagcaaccccaaggccaccagcagcagccctgcccaccccaagcagaccctggagaacaaccaccccaaccccttcctgaccaatgccctgctgggcaaccaccagcccaacggggtcatccagagcgtcatccaggaggcccccctggccctgaccaccaagaccaagatgcagagcaagatcaatgaaaatattgctgctgccagcagcacccccttcagcagccctgtgaacctgagcaccagcggccgccgcaccccaggcaaccagacccctgtgatgcccagcgccagccccatcctgcacagccagggcaaggagaaggctgtgagcaacaacgtgaaccccaggaagatgatgaagaagaagatgaggtag

SEQ ID NO: 145386 - DNA, 3645 bp, Artificial Sequence
  Description of Artificial Sequence: Synthetic coding sequence
atgggcgtggactttgatgtgaagaccttctgccacaacctgcgggccaccaagccaccctatgagtgccctgtggagacctgcaggaaggtgtacaagagctacagcggcatcgagtaccacctgtaccactatgaccatgacaaccccccaccaccccagcagacccccctgaggaagcacaagaagaagggccggcagagcaggcctgccaacaagcagagccccagccccagcgaggtgtcccagagccctggccgggaggtgatgtcctatgcccaggcccagaggatggtggaggtggacctgcacggccgggtgcaccgcatcagcatctttgacaacctggatgtggtgtctgaagatgaggaggcccctgaggaggccccagaaaatggcagcaacaaggaaaatacagagaccccagctgccacccccaagagcggcaagcacaagaacaaggagaagaggaaggacagcaaccaccaccaccaccacaacgtgtctgccagcaccacccccaagctgcctgaggtggtgtaccgggagctggagcaggacaccccagatgccccaccccggcccaccagctactaccgctacatcgagaagtctgctgaggagctggatgaggaggtggagtatgacatggatgaggaggactacatctggctggacatcatgaatgaaagaaggaagacagagggcgtgagccccatcccccaggagatctttgagtacctgatggaccggctggagaaggagagctactttgagagccacaacaagggggaccccaatgccctggtggatgaagatgctgtgtgctgcatctgcaatgatggagagtgccagaacagcaatgtcatcctcttctgtgacatgtgcaacctggccgtgcaccaggagtgctatggagtgccctacatccctgagggccagtggctgtgccgccgctgcctgcagagccccagcagagctgtggactgtgccctgtgccccaacaagggcggggccttcaagcagacagatgatggccgctgggcccacgtggtgtgtgccctgtggatccctgaggtgtgctttgccaacacagtgttcctggagcccatcgacagcattgagcacatccccccagcccgctggaagctgacctgctacatctgcaagcagaggggcagcggggcctgcatccagtgccacaaggccaactgctacacagccttccacgtgacctgtgcccagcaggccggcctgtacatgaagatggagcctgtgcgggagactggagccaacggcaccagcttctctgtgaggaagacagcctactgtgacatccacaccccacctggcagcgcccggcggctgcctgccctgagccacagcgagggggaggaggatgaagatgaggaggaggatgagggcaagggctggagcagcgagaaggtgaagaaggccaaggccaagagccgcatcaagatgaagaaggccaggaagatcctggccgagaagagagctgctgcccctgtggtgtctgtgccctgcatccccccccaccggctgagcaagatcaccaaccggctgaccatccagaggaagagccagttcatgcagaggctgcacagctactggaccctgaagaggcagagcagaaatggagtgcccctgctgcggcggctgcagacccacctgcagagccagaggaactgtgaccaggtgggccgggacagcgaggacaagaactgggccctgaaggagcagctgaagtcctggcagaggctgcggcatgacctggagcgggcccggctgctggtggagctgatcaggaagcgggagaagctgaagcgggagaccatcaaggtgcagcagatcgccatggagatgcagctgacccccttcctgatcctgctgaggaagaccctggagcagctgcaggagaaggacaccggcaacatcttcagcgagcctgtgcccctgtctgaggtgcctgactacctggaccacatcaagaagcccatggacttcttcaccatgaagcagaacctggaggcctaccgctacctgaactttgatgactttgaggaggacttcaacctgattgtgagcaactgcctgaagtacaatgccaaggacaccatcttctacagagctgctgtgcggctgcgggagcagggcggcgctgtgctgcggcaggcccggcggcaggccgagaagatgggcatcgactttgaaacaggcatgcacatcccccacagcctggccggagatgaggccacccaccacacagaagatgctgctgaggaggagcggctggtgctgctggagaaccagaagcacctgcctgtggaggagcagctgaagctgctgctggagcggctggatgaggtgaatgccagcaagcagagcgtgggccgcagcagaagagccaagatgatcaagaaggagatgacagccctgcggaggaagctggcccaccagcgggagaccggcagagatggccctgagagacatggccccagcagccggggcagcctgaccccccaccctgctgcctgtgacaaggatggccagacagacagcgctgctgaggagagcagcagccaggagaccagcaagggcctgggccccaacatgagcagcaccccagcccacgaggtgggccgccgcacctctgtgctcttcagcaagaagaaccccaagacagctggcccccccaagaggcctggccggccccccaagaaccgggagagccagatgacccccagccatggaggcagccctgtgggccccccccagctgcccatcatgagcagcctgcggcagaggaagaggggccgcagcccccggcccagcagcagcagtgacagcgacagcgacaagagcacagaagatcctcccatggacctgcctgccaacggcttcagcggcggcaaccagcctgtgaagaagagcttcctggtgtacagaaatgactgcagcctgcccaggagcagcagtgacagcgagagcagcagcagcagcagcagcagcgctgccagtgacaggaccagcaccacccccagcaagcagggccggggcaagcccagcttcagccggggcaccttccctgaggacagcagcgaggacaccagcggcacagaaaatgaggcctacagcgtgggcaccggccggggcgtgggccacagcatggtgaggaagagcctgggccgcggggccggctggctgtctgaagatgaggacagccccctggatgccctggacctggtgtgggccaagtgccggggctaccccagctacccagccctgatcatcgaccccaagatgccccgggagggcatgttccaccacggcgtgcccatccctgtgccccccctggaggtgctgaagctgggggagcagatgacccaggaggcccgggagcacctgtacctggtgctcttctttgacaacaagaggacctggcagtggctgcccaggaccaagctggtgcccctgggcgtgaaccaggacctggacaaggagaagatgctggagggcaggaagagcaacatcaggaagtctgtgcagatcgcctaccaccgggccctgcagcacaggagcaaggtgcagggcgagcagagcagcgagaccagtgacagcgactag

SEQ ID NO: 145387 - DNA, 3663 bp, Artificial Sequence
  Description of Artificial Sequence: Synthetic coding sequence
atgggcgtggactttgatgtgaagaccttctgccacaacctgcgggccaccaagccaccctatgagtgccctgtggagacctgcaggaaggtgtacaagagctacagcggcatcgagtaccacctgtaccactatgaccatgacaaccccccaccaccccagcagacccccctgaggaagcacaagaagaagggccggcagagcaggcctgccaacaagcagagccccagccccagcgaggtgtcccagagccctggccgggaggtgatgtcctatgcccaggcccagaggatggtggaggtggacctgcacggccgggtgcaccgcatcagcatctttgacaacctggatgtggtgtctgaagatgaggaggcccctgaggaggccccagaaaatggcagcaacaaggaaaatacagagaccccagctgccacccccaagagcggcaagcacaagaacaaggagaagaggaaggacagcaaccaccaccaccaccacaacgtgtctgccagcaccacccccaagctgcctgaggtggtgtaccgggagctggagcaggacaccccagatgccccaccccggcccaccagctactaccgctacatcgagaagtctgctgaggagctggatgaggaggtggagtatgacatggatgaggaggactacatctggctggacatcatgaatgaaagaaggaagacagagggcgtgagccccatcccccaggagatctttgagtacctgatggaccggctggagaaggagagctactttgagagccacaacaagggggaccccaatgccctggtggatgaagatgctgtgtgctgcatctgcaatgatggagagtgccagaacagcaatgtcatcctcttctgtgacatgtgcaacctggccgtgcaccaggagtgctatggagtgccctacatccctgagggccagtggctgtgccgccgctgcctgcagagccccagcagagctgtggactgtgccctgtgccccaacaagggcggggccttcaagcagacagatgatggccgctgggcccacgtggtgtgtgccctgtggatccctgaggtgtgctttgccaacacagtgttcctggagcccatcgacagcattgagcacatccccccagcccgctggaagctgacctgctacatctgcaagcagaggggcagcggggcctgcatccagtgccacaaggccaactgctacacagccttccacgtgacctgtgcccagcaggccggcctgtacatgaagatggagcctgtgcgggagactggagccaacggcaccagcttctctgtgaggaagacagcctactgtgacatccacaccccacctggcagcgcccggcggctgcctgccctgagccacagcgagggggaggaggatgaagatgaggaggaggatgagggcaagggctggagcagcgagaaggtgaagaaggccaaggccaagagccgcatcaagatgaagaaggccaggaagatcctggccgagaagagagctgctgcccctgtggtgtctgtgccctgcatccccccccaccggctgagcaagatcaccaaccggctgaccatccagaggaagagccagttcatgcagaggctgcacagctactggaccctgaagaggcagagcagaaatggagtgcccctgctgcggcggctgcagacccacctgcagagccagaggaactgtgaccaggtgggccgggacagcgaggacaagaactgggccctgaaggagcagctgaagtcctggcagaggctgcggcatgacctggagcgggcccggctgctggtggagctgatcaggaagcgggagaagctgaagcgggagaccatcaaggtgcagcagatcgccatggagatgcagctgacccccttcctgatcctgctgaggaagaccctggagcagctgcaggagaaggacaccggcaacatcttcagcgagcctgtgcccctgtctgaggtgacagagctggatgaggtgcctgactacctggaccacatcaagaagcccatggacttcttcaccatgaagcagaacctggaggcctaccgctacctgaactttgatgactttgaggaggacttcaacctgattgtgagcaactgcctgaagtacaatgccaaggacaccatcttctacagagctgctgtgcggctgcgggagcagggcggcgctgtgctgcggcaggcccggcggcaggccgagaagatgggcatcgactttgaaacaggcatgcacatcccccacagcctggccggagatgaggccacccaccacacagaagatgctgctgaggaggagcggctggtgctgctggagaaccagaagcacctgcctgtggaggagcagctgaagctgctgctggagcggctggatgaggtgaatgccagcaagcagagcgtgggccgcagcagaagagccaagatgatcaagaaggagatgacagccctgcggaggaagctggcccaccagcgggagaccggcagagatggccctgagagacatggccccagcagccggggcagcctgaccccccaccctgctgcctgtgacaaggatggccagacagacagcgctgctgaggagagcagcagccaggagaccagcaagggcctgggccccaacatgagcagcaccccagcccacgaggtgggccgccgcacctctgtgctcttcagcaagaagaaccccaagacagctggcccccccaagaggcctggccggccccccaagaaccgggagagccagatgacccccagccatggaggcagccctgtgggccccccccagctgcccatcatgagcagcctgcggcagaggaagaggggccgcagcccccggcccagcagcagcagtgacagcgacagcgacaagagcacagaagatcctcccatggacctgcctgccaacggcttcagcggcggcaaccagcctgtgaagaagagcttcctggtgtacagaaatgactgcagcctgcccaggagcagcagtgacagcgagagcagcagcagcagcagcagcagcgctgccagtgacaggaccagcaccacccccagcaagcagggccggggcaagcccagcttcagccggggcaccttccctgaggacagcagcgaggacaccagcggcacagaaaatgaggcctacagcgtgggcaccggccggggcgtgggccacagcatggtgaggaagagcctgggccgcggggccggctggctgtctgaagatgaggacagccccctggatgccctggacctggtgtgggccaagtgccggggctaccccagctacccagccctgatcatcgaccccaagatgccccgggagggcatgttccaccacggcgtgcccatccctgtgccccccctggaggtgctgaagctgggggagcagatgacccaggaggcccgggagcacctgtacctggtgctcttctttgacaacaagaggacctggcagtggctgcccaggaccaagctggtgcccctgggcgtgaaccaggacctggacaaggagaagatgctggagggcaggaagagcaacatcaggaagtctgtgcagatcgcctaccaccgggccctgcagcacaggagcaaggtgcagggcgagcagagcagcgagaccagtgacagcgactag

SEQ ID NO: 145388 - DNA, 303 bp, Artificial Sequence
  Description of Artificial Sequence: Synthetic coding sequence
atgggcgtggactttgatgtgaagaccttctgccacaacctgcgggccaccaagccaccctatgagtgccctgtggagacctgcaggaaggtgtacaagagctacagcggcatcgagtaccacctgtaccactatgaccatgacaaccccccaccaccccagcagacccccctgaggaagcacaagaagaagggccggcagagcaggcctgccaacaagcagagccccagccccagcgaggtgtcccagagccctggccgggaggtgatgtcctatgcccaggcccagaggatggtggagtag

SEQ ID NO: 145389 - DNA, 318 bp, Artificial Sequence
  Description of Artificial Sequence: Synthetic coding sequence
atgggcgtggactttgatgtgaagaccttctgccacaacctgcgggccaccaagccaccctatgagtgccctgtggagacctgcaggaaggtgtacaagagctacagcggcatcgagtaccacctgtaccactatgaccatgacaaccccccaccaccccagcagacccccctgaggaagcacaagaagaagggccggcagagcaggcctgccaacaagcagagccccagccccagcgaggtgtcccagagccctggccgggaggtgatgtcctatgcccaggcccagaggatggtggaggtggacctgcacggctag

SEQ ID NO: 145390 - DNA, 3645 bp, Artificial Sequence; identical to SEQ ID NO: 145386
  Description of Artificial Sequence: Synthetic coding sequence

SEQ ID NO: 145391 - DNA, 5409 bp, Artificial Sequence
  Description of Artificial Sequence: Synthetic coding sequence
atggctgctgcccccacccagatcgaggccgagctgtactacctgattgcccgcttcctgcagagcggcccctgcaacaagagcgcccaggtgctggtgcaggagctggaggagcaccagctgatcccccggcggctggactgggagggcaaggagcaccggcgcagctttgaggacctggtggccgccaatgcccacatccccccagactacctgctgaagatctgtgaaagaattggccccctgctggacaaggagatcccccagagcgtgcctggggtgcagaccctgctgggcgtgggccggcagagcctgctgagagatgccaaggactgcaagagcaccctgtggaatggcagcgcctttgctgccctgcaccggggccggcccccagagctgcctgtgaactacgtgaagccacccaacgtggtgaacatcaccagcgcccggcagctgaccggctgcagccgcttcggccacatcttccccagcagcgcctaccagcacatcaagatgcacaagaggatcctgggccacctgagctctgtgtactgtgtggcctttgacagaagtggaagacgcatcttcaccggcagtgatgactgcctggtgaagatctgggccacagatgatggccgcctgctggccaccctgcggggccacagcgctgagatcagtgacatggctgtgaactatgagaacaccctgattgctgctggcagctgtgacaaggtggtgcgggtgtggtgcctgcggacctgtgcccctgtggccgtgctgcagggccacagcgccagcatcaccagcatccagttctgccccagcaccaagggcaccaaccgctacctgaccagcactggagcagatggcaccatctgcttctggcagtggcacgtgaagaccatgaagttccgggacaggcctgtgaagttcacagagaggagcaggcctggggtgcagatcagctgcagcagcttcagcagcggcggcatgttcatcaccaccggcagcacagaccacgtgatccgcatctactacctgggcagcgaggtgcctgagaagattgctgagctggagagccacacagacaaggtggtggccgtgcagttctgcaacaatggagacagcctgcgctttgtgtctggcagcagagatggaacagcccgcatctggcagtaccagcagcaggagtggaagagcatcgtgctggacatggccaccaagatgacaggcaacaacctgcccagcggggaggacaagatcaccaagctgaaggtgaccatggtggcctgggacagatatgacaccaccgtcatcacagctgtgaacaacttcctgctgaaggtgtggaacagcatcaccggccagctgctgcacaccctgagcggccatgatgatgaggtgtttgtgctggaggcccacccctttgaccagaggatcatcctgtctgctggccatgatggcaacatcttcatctgggacctggaccggggcaccaagatccggaactacttcaacatgattgagggccagggccatggagctgtgtttgactgcaagttctccccagatggcaaccactttgcctgcacagacagccacggccacctgctgctgtttggcttcggctgcagcaagtactatgagaagatcccagaccagatgttcttccacacagactaccggcccctcatcagagatgccaacaactacgtgctggatgagcagacccagcaggccccccacctgatgcccccacccttcctggtggatgtggatggcaacccccaccccaccaagttccagaggctggtgcccggccgggagaactgcaaggatgagcagctgatcccccagctgggctacgtggccaatggagatggagaggtggtggagcaggtgattggccagcagaccaatgaccaggatgagagcatcctggatggcatcatccgggagctgcagcgggagcaggacctgcggctcatcaatgaaggagatgtgccccacctgcctgtgaacagagcctacagcgtgaatggagccctgcggagccccaacatggacatcagcagcagccccaacatccggctgcggcggcacagcagccagattgaaggagtgcggcagatgcacaacaatgcccccaggagccagatggccacagagcgggacctgatggcctggagcagaagagtggtggtgaatgagctgaacaacggggtgtcccgggtgcaggaggagtgcaggacagccaagggggacatcgagatcagcctgtacacagtggagaagaagaagaagcccagctacaccacccagagaaatgactatgagcccagctgtggccgcagcctgcggaggacccagaggaagaggcagcacacctaccagaccaggagcaacatcgagcacaacagccaggccagctgccagaacagcggcgtgcaggaggacagcgacagcagcagcgaggaggatgaaacagtgggcaccagtgatgcctctgtggaggaccctgtggtggagtggcagagcgagagcagcagcagtgacagcagcagcgagtacagcgactggacagcagatgctggcatcaacctgcagccccccaagaggcagacccggcagaccaccaggaagatctgcagcagcagtgatgaggagaacctgaagagcctggaggagcggcagaagaagcccaagcagaccaggaagaagaagggcggcctggtgtccattgctggggagcccaatgaggagtggtttgccccccagtggatcctggacaccatcccccggcgcagcccctttgtgccccagatgggagatgagctgatctacttccggcagggccacgaggcctacgtgcgggctgtgaggaagagcaagatctacagcgtgaacctgcagaagcagccctggaacaagatggacctgcgggagcaggagtttgtgaagatcgtgggcatcaagtatgaggtgggcccccccaccctgtgctgcctgaagctggccttcctggaccccatcagcggcaagatgaccggggagagcttcagcatcaagtaccatgacatgccagatgtgattgacttcctggtgctgcaccagttctacaatgaggccaaggagaggaactggcagatcggggaccgcttccgcagcatcattgatgatgcctggtggtttggcaccgtggagagccagcagcccttccagcctgagtacccagacagcagcttccagtgctacagcgtgcactgggacaacaatgaaagagagaagatgagcccctgggacatggagcccatccctgagggcacagccttcccagatgaggtgggcgccggcgtgcctgtgtcccaggaggagctgacagccctgctgtacaagccccaggagggggagtggggcgcccacagcagagatgaggagtgtgagagggtcatccagggcatcaaccacctgctgagcctggactttgccagcccctttgctgtgcctgtggacctgagcgcctaccccctgtactgcaccgtggtggcctaccccacagacctgaacaccatcagaagaaggctggagaaccgcttctaccgccgcatcagcgccctgatgtgggaggtgcgctacatcgagcacaatgcccggaccttcaatgaaccagacagccccatcgtgaaggccgccaagatcgtgacagatgtgctgctgcgcttcatcggggaccagagctgcacagacatcctggacacctacaacaagatcaaggccgaggagaggaacagcacagatgctgaggaggacacagaaattgtggacctggacagtgatggccctggcaccagcagcggcaggaaggtgaagtgccggggccggcggcagagcctgaagtgcaacccagatgcctggaagaagcagtgcaaggagctgctgagcctcatctatgagcgggaggacagcgagcccttccggcagcctgctgacctgctgagctacccaggccaccaggagcaggagggggagagcagcgagagcgtggtgcctgagcggcagcaggacagcagcctgtctgaggactaccaggacgtcatcgacacccctgtggacttcagcacagtgaaggagaccctggaggccggcaactacggcagccccctggagttctacaaggatgtgcggcagatcttcaacaacagcaaggcctacaccagcaacaagaagagccgcatctacagcatgatgctgcggctgagcgccctgtttgagagccacatcaagaacatcatcagcgagtacaagagcgccatccagagccagaagagaagaagaccccgctacaggaagaggctgcggagcagcagcagcagcctgagcagcagcggggcccccagccccaagggcaagcagaagcagatgaagctgcagcccaagaatgaccagaacacctctgtgagccacgcccggaccagcagccccttcagcagccctgtgtctgatgctgctgagggcctgagcctgtacctgctggatgatgagccagatggccccttcagcagcagcagctttggaggctacagccgcagcggcaacagccatgaccccgggaaggccaagagcttcaggaacagagtgctgcctgtgaagcaggaccacagcctggatggccccctgaccaatggagatggccgggagcccaggacaggcatcaagaggaagctgctgagcgcctctgaagaagatgagaacatgggcggggaggacaaggagaagaaggagaccaaggagaagagccacctgagcaccagcgagagcggggagctgggcagcagcctgagcagcgagagcacctgtggcagtgacagcgacagcgagagcaccagcaggacagaccaggactatgtggatggagaccatgactacagcaagttcatccagacccggcccaagaggaagctgaggaagcagcacggcaatggcaagaggaactggaagacccggggcaccggcggccggggccgctggggccgctggggccgctggagcagaggaggccggggccggggcggccggggccggggcagccggggccggggcggcggcggcacccggggccggggccggggccggggcggccgcggggccagcagaggagccacccgggccaagagggccagaattgctgatgatgaatttgacaccatgttcagcggccgcttcagccggctgccccgcatcaagaccaggaaccagggccgcaggacagtgctgtacaatgatgacagcgacaatgacaactttgtgtccacagaggaccccctgaacctgggcaccagccgcagcggccgggtgaggaagatgacagagaaggcccgggtgagccacctgatgggctggaactactag

SEQ ID NO: 145392 - DNA, 2406 bp, Artificial Sequence
  Description of Artificial Sequence: Synthetic coding sequence
atgctgcagaatgtgaccccccacaacaagctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145393 - DNA, 2406 bp, Artificial Sequence; identical to SEQ ID NO: 145392
  Description of Artificial Sequence: Synthetic coding sequence

SEQ ID NO: 145394 - DNA, 2406 bp, Artificial Sequence; identical to SEQ ID NO: 145392
  Description of Artificial Sequence: Synthetic coding sequence

SEQ ID NO: 145395 - DNA, 2511 bp, Artificial Sequence
  Description of Artificial Sequence: Synthetic coding sequence
atgctgcagaatgtgaccccccacaacaagctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcaggccggcgtgcagtggagggacctgggcctgctgcagccccccctgctgggcttcaagcgcttcagctgcctgagcctgcccagcagccaggactaccgcctgcccaagaaggccaccaagacagcccccccagccctgcccaccggctatgacagcgaggaggaggaggagagccggcccatgtcctatgatgagaagaggcagctgagcctggacatcaacaagctgcctggagagaagctgggccgggtggtgcacatcatccaggcccgggagcccagcctgcgggacagcaaccctgaggagattgaaattgactttgagaccctgaagcccagcaccctgcgggagctggagagatatgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145396 - DNA, 2511 bp, Artificial Sequence; identical to SEQ ID NO: 145395
  Description of Artificial Sequence: Synthetic coding sequence

SEQ ID NO: 145397 - DNA, 2511 bp, Artificial Sequence; identical to SEQ ID NO: 145395
  Description of Artificial Sequence: Synthetic coding sequence

SEQ ID NO: 145398 - DNA, 2406 bp, Artificial Sequence; identical to SEQ ID NO: 145392
  Description of Artificial Sequence: Synthetic coding sequence

SEQ ID NO: 145399 - DNA, 2406 bp, Artificial Sequence; identical to SEQ ID NO: 145392
  Description of Artificial Sequence: Synthetic coding sequence

SEQ ID NO: 145400 - DNA, 891 bp, Artificial Sequence
  Description of Artificial Sequence: Synthetic coding sequence
tgaagacccctgggcgtgcagcagcccggggcccggctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctgtag

SEQ ID NO: 145401 - DNA, 2406 bp, Artificial Sequence
  Description of Artificial Sequence: Synthetic coding sequence
atgctgcagaatgtgaccccccacaacaagctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtcttcaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145402 - DNA, 1842 bp, Artificial Sequence
  Description of Artificial Sequence: Synthetic coding sequence
atgctgcagaatgtgaccccccacaacaagctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcacctag

SEQ ID NO: 145403 - DNA, 1842 bp, Artificial Sequence; identical to SEQ ID NO: 145402
  Description of Artificial Sequence: Synthetic coding sequence

SEQ ID NO: 145404 - DNA, 987 bp, Artificial Sequence
  Description of Artificial Sequence: Synthetic coding sequence
tgagccaagagcagcagcgagagcagcagcgaggagagcagcagcgagagcagcagcgaggaggaggaggaggaggatgaagatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggccccccggcccccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgacagcgaggaggaggaggagagccggcccatgtcctatgatgagaagaggcagctgagcctggacatcaacaagctgcctggagagaagctgggccgggtggtgcacatcatccaggcccgggagcccagcctgcgggacagcaaccctgaggagattgaaattgactttgagaccctgaagcccagcaccctgcgggagctggagagatatgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145405 - DNA, 1947 bp, Artificial Sequence
  Description of Artificial Sequence: Synthetic coding sequence
atgctgcagaatgtgaccccccacaacaagctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcaggccggcgtgcagtggagggacctgggcctgctgcagccccccctgctgggcttcaagcgcttcagctgcctgagcctgcccagcagccaggactactag

SEQ ID NO: 145406 - DNA, 2424 bp, Artificial Sequence
  Description of Artificial Sequence: Synthetic coding sequence
tgaaatggaggcggcggcagcgccacagcccggggcggggagtaccgcctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtcttcaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145407 - DNA, 891 bp, Artificial Sequence
  Description of Artificial Sequence: Synthetic coding sequence
tgaagacccctgggcgtgcagcagcccggggcccggctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtcttcaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctgtag

SEQ ID NO: 145408 - DNA, 2265 bp, Artificial Sequence
  Description of Artificial Sequence: Synthetic coding sequence
atggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgaggcgggagagcggccggcccatcaagccacccaggaaggacctgcctgacagccagcagcagcaccagagcagcaagaagggcaagctgtctgagcagctgaagcactgcaatggcatcctgaaggagctgctgagcaagaagcatgctgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaagaagatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggccccccggcccccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgacagcgaggaggaggaggagagccggcccatgtcctatgatgagaagaggcagctgagcctggacatcaacaagctgcctggagagaagctgggccgggtggtgcacatcatccaggcccgggagcccagcctgcgggacagcaaccctgaggagattgaaattgactttgagaccctgaagcccagcaccctgcgggagctggagagatatgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145409 - DNA, 2406 bp, Artificial Sequence; identical to SEQ ID NO: 145392
  Description of Artificial Sequence: Synthetic coding sequence

SEQ ID NO: 145410 - DNA, 2424 bp, Artificial Sequence
  Description of Artificial Sequence: Synthetic coding sequence
tgaaatggaggcggcggcagcgccacagcccggggcggggagtaccgcctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145411 - DNA, 1092 bp, Artificial Sequence
  Description of Artificial Sequence: Synthetic coding sequence
tgagccaagagcagcagcgagagcagcagcgaggagagcagcagcgagagcagcagcgaggaggaggaggaggaggatgaagatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggccccccggcccccccagcccaagaagagcaagaaggccagcggcagcggcggcggcagcgctgccctgggccccagcggcttcggccccagcggcggcagcggcaccaagctgcaggccggcgtgcagtggagggacctgggcctgctgcagccccccctgctgggcttcaagcgcttcagctgcctgagcctgcccagcagccaggactaccgcctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145412 - DNA, 2511 bp, Artificial Sequence; identical to SEQ ID NO: 145395
  Description of Artificial Sequence: Synthetic coding sequence

SEQ ID NO: 145413 - DNA, 2046 bp, Artificial Sequence
  Description of Artificial Sequence: Synthetic coding sequence
atggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145414 - DNA, 2424 bp, Artificial Sequence; identical to SEQ ID NO: 145410
  Description of Artificial Sequence: Synthetic coding sequence

SEQ ID NO: 145415 - DNA, 987 bp, Artificial Sequence; identical to SEQ ID NO: 145404
  Description of Artificial Sequence: Synthetic coding sequence

SEQ ID NO: 145416 - DNA, 2511 bp, Artificial Sequence; identical to SEQ ID NO: 145395
  Description of Artificial Sequence: Synthetic coding sequence

SEQ ID NO: 145417 - DNA, 2424 bp, Artificial Sequence; identical to SEQ ID NO: 145410
  Description of Artificial Sequence: Synthetic coding sequence

SEQ ID NO: 145418 - DNA, 2265 bp, Artificial Sequence; identical to SEQ ID NO: 145408
  Description of Artificial Sequence: Synthetic coding sequence

SEQ ID NO: 145419 - DNA, 2406 bp, Artificial Sequence; identical to SEQ ID NO: 145401
  Description of Artificial Sequence: Synthetic coding sequence

SEQ ID NO: 145420 - DNA, 891 bp, Artificial Sequence; identical to SEQ ID NO: 145400
  Description of Artificial Sequence: Synthetic coding sequence

SEQ ID NO: 145421 - DNA, 2511 bp, Artificial Sequence
  Description of Artificial Sequence: Synthetic coding sequence
atgctgcagaatgtgaccccccacaacaagctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtcttcaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcaggccggcgtgcagtggagggacctgggcctgctgcagccccccctgctgggcttcaagcgcttcagctgcctgagcctgcccagcagccagaactaccgcctgcccaagaaggccaccaagacagcccccccagccctgcccaccggctatgacagcgaggaggaggaggagagccggcccatgtcctatgatgagaagaggcagctgagcctggacatcaacaagctgcctggagagaagctgggccgggtggtgcacatcatccaggcccgggagcccagcctgcgggacagcaaccctgaggagattgaaattgactttgagaccctgaagcccagcaccctgcgggagctggagagatatgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145422 - DNA, 987 bp, Artificial Sequence; identical to SEQ ID NO: 145404
  Description of Artificial Sequence: Synthetic coding sequence

SEQ ID NO: 145423 - DNA, 891 bp, Artificial Sequence; identical to SEQ ID NO: 145400
  Description of Artificial Sequence: Synthetic coding sequence

SEQ ID NO: 145424 - DNA, 891 bp, Artificial Sequence; identical to SEQ ID NO: 145400
  Description of Artificial Sequence: Synthetic coding sequence

SEQ ID NO: 145425 - DNA, 1860 bp, Artificial Sequence
  Description of Artificial Sequence: Synthetic coding sequence
tgaaatggaggcggcggcagcgccacagcccggggcggggagtaccgcctgcccggggagggcaatgccggcctgctgggcctgggccctgaggccgccgcccctgggaagaggatcaggaagcccagcctgctgtatgagggctttgagagccccaccatggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtgctgaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcacctag

SEQ ID NO: 145426 - DNA, 987 bp, Artificial Sequence; identical to SEQ ID NO: 145404
  Description of Artificial Sequence: Synthetic coding sequence

SEQ ID NO: 145427 - DNA, 2046 bp, Artificial Sequence
  Description of Artificial Sequence: Synthetic coding sequence
atggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtcttcaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgagaagagagagcggccggcccatcaagccacccaggaaggacctgcctgacagccagcagcagcaccagagcagcaagaagggcaagctgtctgagcagctgaagcactgcaatggcatcctgaaggagctgctgagcaagaagcacgccgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaggaggatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggcccccaggcctccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgattctgaggaggaggaggagagccggcccatgtcctatgatgagaagaggcagctgagcctggacatcaacaagctgcccggggagaagctgggccgggtggtgcacatcatccaggcccgggagcccagcctgcgggacagcaaccctgaggagattgaaattgactttgagaccctgaagcccagcaccctgcgggagctggagcgctacgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145428 - DNA, 2265 bp, Artificial Sequence
  Description of Artificial Sequence: Synthetic coding sequence
atggcctctgtgcctgccctgcagctgaccccagccaaccccccacctcctgaggtgagcaaccccaagaagccaggccgggtgaccaaccagctgcagtacctgcacaaggtggtgatgaaggccctgtggaagcaccagtttgcctggcccttccggcagcctgtggatgctgtgaagctgggcctgcctgactaccacaagatcatcaagcagcccatggacatgggcaccatcaagaggcggctggagaacaactactactgggccgccagcgagtgcatgcaggacttcaacaccatgttcaccaactgctacatctacaacaagcccacagatgacatcgtgctgatggcccagaccctggagaagatcttcctgcagaaggtggcctccatgccccaggaggagcaggagctggtggtgaccatccccaagaacagccacaagaagggggccaagctggccgccctgcagggctctgtgaccagcgcccaccaggtgcctgctgtgtcctctgtgagccacacagccctgtacaccccacctcctgagatccccaccaccgtcttcaacatcccccaccccagcgtcatcagcagccccctgctgaagagcctgcacagcgctggcccccccctgctggccgtgacagctgcccccccagcccagcccctggccaagaagaagggcgtgaagaggaaggctgacaccaccacccccacccccacagccatcctggcccctggcagccctgccagccccccaggcagcctggagcccaaggccgcccggctgccccccatgaggcgggagagcggccggcccatcaagccacccaggaaggacctgcctgacagccagcagcagcaccagagcagcaagaagggcaagctgtctgagcagctgaagcactgcaatggcatcctgaaggagctgctgagcaagaagcatgctgcctatgcctggcccttctacaagcctgtggatgccagcgccctgggcctgcatgactaccatgacatcatcaagcaccccatggacctgagcacagtgaagaggaagatggagaacagagactacagagatgcccaggagtttgctgctgatgtgcggctgatgttcagcaactgctacaagtacaaccccccagaccatgatgtggtggccatggccaggaagctgcaggatgtgtttgagttccgctatgccaagatgccagatgagcccctggagcccggccccctgcctgtgtccacagccatgcctcctggcctggccaagagcagcagcgagagcagcagcgaggagagcagcagcgagagcagcagcgaggaggaggaggaggaggatgaagaagatgaggaggaggaggagagcgagagcagtgacagcgaggaggagcgggcccaccggctggccgagctgcaggagcagctgcgggctgtgcatgagcagctggccgccctgagccagggccccatcagcaagcccaagaggaagcgggagaagaaggagaagaagaagaagaggaaggccgagaagcaccggggccgggccggggctgatgaagatgacaagggcccccgggccccccggcccccccagcccaagaagagcaagaaggccagcggcagcggcggcggcagcgctgccctgggccccagcggcttcggccccagcggcggcagcggcaccaagctgcccaagaaggccaccaagacagcccccccagccctgcccaccggctatgacagcgaggaggaggaggagagccggcccatgtcctatgatgagaagaggcagctgagcctggacatcaacaagctgcctggagagaagctgggccgggtggtgcacatcatccaggcccgggagcccagcctgcgggacagcaaccctgaggagattgaaattgactttgagaccctgaagcccagcaccctgcgggagctggagagatatgtgctgagctgcctgaggaagaagcccaggaagccctacaccatcaagaagcctgtgggcaagaccaaggaggagctggccctggagaagaagcgggagctggagaagaggctgcaggatgtgtctggccagctgaacagcaccaagaagccacccaagaaggccaatgagaagacagagagcagcagcgcccagcaggtggccgtgtcccggctgagcgccagcagcagcagcagtgacagcagcagcagcagcagcagcagcagcagcagtgacaccagtgacagcgacagcggctag

SEQ ID NO: 145429 - DNA, 2511 bp, Artificial Sequence; identical to SEQ ID NO: 145395
  Description of Artificial Sequence: Synthetic coding sequence

SEQ ID NO: 145430 - DNA, 2046 bp, Artificial Sequence; identical to SEQ ID NO: 145413
  Description of Artificial Sequence: Synthetic coding sequence

SEQ ID NO: 145431 - DNA, 2511 bp, Artificial Sequence; identical to SEQ ID NO: 145395
  Description of Artificial Sequence: Synthetic coding sequence

SEQ ID NO: 145432 - DNA, 2265 bp, Artificial Sequence; identical to SEQ ID NO: 145408
  Description of Artificial Sequence: Synthetic coding sequence

SEQ ID NO: 145433 - DNA, 2046 bp, Artificial Sequence; identical to SEQ ID NO: 145413
  Description of Artificial Sequence: Synthetic coding sequence

SEQ ID NO: 145434 - DNA, 2511 bp, Artificial Sequence; identical to SEQ ID NO: 145395
  Description of Artificial Sequence: Synthetic coding sequence

SEQ ID NO: 145435 - DNA, 2511 bp, Artificial Sequence; identical to SEQ ID NO: 145421
  Description of Artificial Sequence: Synthetic coding sequence

SEQ ID NO: 145436 - DNA, 2265 bp, Artificial Sequence; identical to SEQ ID NO: 145408
  Description of Artificial Sequence: Synthetic coding sequence

SEQ ID NO: 145437 - DNA, 2406 bp, Artificial Sequence; identical to SEQ ID NO: 145392
  Description of Artificial Sequence: Synthetic coding sequence

SEQ ID NO: 145438 - DNA, 2046 bp, Artificial Sequence; identical to SEQ ID NO: 145413
  Description of Artificial Sequence: Synthetic coding sequence

SEQ ID NO: 145439 - DNA, 4089 bp, Artificial Sequence
  Description of Artificial Sequence: Synthetic coding sequence
atgtctgctgagagcggccctggcacccggctgaggaacctgcctgtgatgggagatggcctggagaccagccagatgagcaccacccaggcccaggcccagccccagcctgccaatgctgccagcaccaaccccccacctcctgagaccagcaaccccaacaagcccaagaggcagaccaaccagctgcagtacctgctgcgggtggtgctgaagaccctgtggaagcaccagtttgcctggcccttccagcagcctgtggatgctgtgaagctgaacctgcctgactactacaagatcatcaagacccccatggacatgggcaccatcaagaagaggctggagaacaactactactggaatgcccaggagtgcatccaggacttcaacaccatgttcaccaactgctacatctacaacaagccaggagatgacatcgtgctgatggccgaggccctggagaagctgttcctgcagaagatcaatgagctgcccacagaggagacagagatcatgattgtgcaggccaagggccggggccggggcaggaaggagaccggcacagccaagccaggagtgtccacagtgcccaacaccacccaggccagcaccccaccccagacccagaccccccagcccaaccccccacctgtgcaggccaccccccaccccttccctgctgtgaccccagacctgattgtgcagacccctgtgatgacagtggtgcccccccagcccctgcagaccccacctcctgtgcccccccagccccagcccccaccagccccagccccccagcctgtgcagagccacccccccatcatcgccgccaccccccagcctgtgaagaccaagaagggcgtgaagaggaaggctgacaccaccacccccaccaccatcgaccccatccacgagccccccagcctgcccccagagcccaagaccaccaagctgggccagaggcgggagagcagcaggcctgtgaagccacccaagaaggatgtgcctgacagccagcagcacccagcccctgagaagagcagcaaggtgtctgagcagctgaagtgctgcagcggcatcctgaaggagatgtttgccaagaagcacgccgcctatgcctggcccttctacaagcctgtggatgtggaggccctgggcctgcatgactactgtgacatcatcaagcaccccatggacatgagcaccatcaagagcaagctggaggcccgggagtacagagatgcccaggagtttggagcagatgtgcggctgatgttcagcaactgctacaagtacaaccccccagaccacgaggtggtggccatggccaggaagctgcaggatgtgtttgagatgagatttgccaagatgccagatgagcctgaggagcctgtggtggccgtgagcagccctgctgtgcccccacccaccaaggtggtggccccacccagcagcagtgacagcagcagtgacagcagcagtgacagcgacagcagcacagatgattctgaggaggagcgggcccagaggctggccgagctgcaggagcagctgaaggctgtgcatgagcagctggccgccctgagccagccccagcagaacaagcccaagaagaaggagaaggacaagaaggagaagaagaaggagaagcacaagaggaaggaggaggtggaggagaacaagaagagcaaggccaaggagcccccacccaagaagaccaagaagaacaacagcagcaacagcaatgtgtccaagaaggagcccgcccccatgaagagcaagcccccacccacctatgaaagtgaggaggaggacaagtgcaagcccatgtcctatgaggagaagaggcagctgagcctggacatcaacaagctgcccggggagaagctgggccgggtggtgcacatcatccagagccgggagcccagcctgaagaacagcaacccagatgaaattgaaattgactttgagaccctgaagcccagcaccctgcgggagctggagcgctacgtgaccagctgcctgaggaagaagaggaagccccaggccgagaaggtggatgtgattgctggcagcagcaagatgaagggcttcagcagcagcgagagcgagagcagcagcgagagcagcagcagtgacagtgaagattctgaaacagagatggcccccaagagcaagaagaagggccaccctggccgggagcagaagaagcaccaccaccaccaccaccagcagatgcagcaggccccagcccctgtgccccagcagcccccacctccaccccagcagcccccacctcctcctccaccccagcagcagcagcagcccccacctcctcctcctccacccagcatgccccagcaggccgccccagccatgaagagcagccccccacccttcatcgccacccaggtgcctgtgctggagccccagctgcccggctctgtgtttgaccccatcggccacttcacccagcccatcctgcacctgccccagcctgagctgcccccccacctgccccagcccccagagcacagcaccccaccccacctgaaccagcacgctgtggtgtccccaccagccctgcacaatgccctgccccagcagcccagccggcccagcaacagagctgctgccctgccccccaagccagcccggcccccagctgtgtccccagccctgacccagacccccctgctgccccagccccccatggcccagcccccccaggtgctgctggaggatgaggagcccccagccccacccctgacctccatgcagatgcagctgtacctgcagcagctgcagaaggtgcagccccccacccccctgctgcccagcgtgaaggtgcagagccagcccccaccacccctgcccccaccaccccaccccagcgtgcagcagcagctgcagcagcagcccccacctcctcctccaccccagccccagcccccaccccagcagcagcaccagcccccacccaggcctgtgcacctgcagcccatgcagttcagcacccacatccagcagcccccaccaccccagggccagcagcccccccaccccccacctggccagcagcccccaccaccccagcctgccaagccccagcaggtgatccagcaccaccacagccccaggcaccacaagagtgacccctacagcacaggccacctgcgggaggcccccagccccctgatgatccacagcccccagatgagccagttccagagcctgacccaccagagccccccccagcagaatgtgcagcccaagaagcaggagctgcgggccgcctctgtggtgcagccccagcccctggtggtggtgaaggaggagaagatccacagccccatcatccgctctgagcccttcagccccagcctgcggcctgagccccccaagcaccctgagagcatcaaggcccctgtgcacctgccccagaggcctgagatgaagcctgtggatgtgggccggcctgtgatccggcccccagagcagaatgcccctcctcctggggccccagacaaggacaagcagaagcaggagcccaagacccctgtggcccccaagaaggacctgaagatcaagaacatgggctcctgggccagcctggtgcagaagcaccccaccacccccagcagcacagccaagagcagcagtgacagctttgagcagttccggcgggccgcccgggagaaggaggagcgggagaaggccctgaaggcccaggccgagcacgccgagaaggagaaggagcggctgcggcaggagaggatgaggagccgggaggatgaagatgccctggagcaggcccggcgggcccacgaggaggcccggcggcggcaggagcagcagcagcagcagaggcaggagcagcagcagcagcagcagcagcaggccgctgctgtggccgctgctgccaccccccaggcccagagcagccagccccagagcatgctggaccagcagcgggagctggccaggaagcgggagcaggagaggagaagaagagaggccatggccgccaccatcgacatgaacttccagagcgacctgctgagcatctttgaagaaaatctcttctag

SEQ ID NO: 145440 - DNA, 2385 bp, Artificial Sequence
  Description of Artificial Sequence: Synthetic coding sequence
atgtctgctgagagcggccctggcacccggctgaggaacctgcctgtgatgggagatggcctggagaccagccagatgagcaccacccaggcccaggcccagccccagcctgccaatgctgccagcaccaaccccccacctcctgagaccagcaaccccaacaagcccaagaggcagaccaaccagctgcagtacctgctgcgggtggtgctgaagaccctgtggaagcaccagtttgcctggcccttccagcagcctgtggatgctgtgaagctgaacctgcctgactactacaagatcatcaagacccccatggacatgggcaccatcaagaagaggctggagaacaactactactggaatgcccaggagtgcatccaggacttcaacaccatgttcaccaactgctacatctacaacaagccaggagatgacatcgtgctgatggccgaggccctggagaagctgttcctgcagaagatcaatgagctgcccacagaggagacagagatcatgattgtgcaggccaagggccggggccggggcaggaaggagaccggcacagccaagccaggagtgtccacagtgcccaacaccacccaggccagcaccccaccccagacccagaccccccagcccaaccccccacctgtgcaggccaccccccaccccttccctgctgtgaccccagacctgattgtgcagacccctgtgatgacagtggtgcccccccagcccctgcagaccccacctcctgtgcccccccagccccagcccccaccagccccagccccccagcctgtgcagagccacccccccatcatcgccgccaccccccagcctgtgaagaccaagaagggcgtgaagaggaaggctgacaccaccacccccaccaccatcgaccccatccacgagccccccagcctgcccccagagcccaagaccaccaagctgggccagaggcgggagagcagcaggcctgtgaagccacccaagaaggatgtgcctgacagccagcagcacccagcccctgagaagagcagcaaggtgtctgagcagctgaagtgctgcagcggcatcctgaaggagatgtttgccaagaagcacgccgcctatgcctggcccttctacaagcctgtggatgtggaggccctgggcctgcatgactactgtgacatcatcaagcaccccatggacatgagcaccatcaagagcaagctggaggcccgggagtacagagatgcccaggagtttggagcagatgtgcggctgatgttcagcaactgctacaagtacaaccccccagaccacgaggtggtggccatggccaggaagctgcaggatgtgtttgagatgagatttgccaagatgccagatgagcctgaggagcctgtggtggccgtgagcagccctgctgtgcccccacccaccaaggtggtggccccacccagcagcagtgacagcagcagtgacagcagcagtgacagcgacagcagcacagatgattctgaggaggagcgggcccagaggctggccgagctgcaggagcagctgaaggctgtgcatgagcagctggccgccctgagccagccccagcagaacaagcccaagaagaaggagaaggacaagaaggagaagaagaaggagaagcacaagaggaaggaggaggtggaggagaacaagaagagcaaggccaaggagcccccacccaagaagaccaagaagaacaacagcagcaacagcaatgtgtccaagaaggagcccgcccccatgaagagcaagcccccacccacctatgaaagtgaggaggaggacaagtgcaagcccatgtcctatgaggagaagaggcagctgagcctggacatcaacaagctgcccggggagaagctgggccgggtggtgcacatcatccagagccgggagcccagcctgaagaacagcaacccagatgaaattgaaattgactttgagaccctgaagcccagcaccctgcgggagctggagcgctacgtgaccagctgcctgaggaagaagaggaagccccaggccgagaaggtggatgtgattgctggcagcagcaagatgaagggcttcagcagcagcgagagcgagagcagcagcgagagcagcagcagtgacagtgaagattctgaaacagccttctgcaccagcggggactttgtgtccccaggccccagcccctaccacagccacgtgcagtgtggccgcttccgggagatgctgcgctggttcctggtggatgtggagcagacagctgctggccagccccaccggcagagcgctgctggccctgccatcacctgggccccagccatcgcctaccccagcccagaatgtgcccgctgctgcgtgggctgcagctag

SEQ ID NO: 145441 - DNA, 2169 bp, Artificial Sequence
  Description of Artificial Sequence: Synthetic coding sequence
atgtctgctgagagcggccctggcacccggctgaggaacctgcctgtgatgggagatggcctggagaccagccagatgagcaccacccaggcccaggcccagccccagcctgccaatgctgccagcaccaaccccccacctcctgagaccagcaaccccaacaagcccaagaggcagaccaaccagctgcagtacctgctgcgggtggtgctgaagaccctgtggaagcaccagtttgcctggcccttccagcagcctgtggatgctgtgaagctgaacctgcctgactactacaagatcatcaagacccccatggacatgggcaccatcaagaagaggctggagaacaactactactggaatgcccaggagtgcatccaggacttcaacaccatgttcaccaactgctacatctacaacaagccaggagatgacatcgtgctgatggccgaggccctggagaagctgttcctgcagaagatcaatgagctgcccacagaggagacagagatcatgattgtgcaggccaagggccggggccggggcaggaaggagaccggcacagccaagccaggagtgtccacagtgcccaacaccacccaggccagcaccccaccccagacccagaccccccagcccaaccccccacctgtgcaggccaccccccaccccttccctgctgtgaccccagacctgattgtgcagacccctgtgatgacagtggtgcccccccagcccctgcagaccccacctcctgtgcccccccagccccagcccccaccagccccagccccccagcctgtgcagagccacccccccatcatcgccgccaccccccagcctgtgaagaccaagaagggcgtgaagaggaaggctgacaccaccacccccaccaccatcgaccccatccacgagccccccagcctgcccccagagcccaagaccaccaagctgggccagaggcgggagagcagcaggcctgtgaagccacccaagaaggatgtgcctgacagccagcagcacccagcccctgagaagagcagcaaggtgtctgagcagctgaagtgctgcagcggcatcctgaaggagatgtttgccaagaagcacgccgcctatgcctggcccttctacaagcctgtggatgtggaggccctgggcctgcatgactactgtgacatcatcaagcaccccatggacatgagcaccatcaagagcaagctggaggcccgggagtacagagatgcccaggagtttggagcagatgtgcggctgatgttcagcaactgctacaagtacaaccccccagaccacgaggtggtggccatggccaggaagctgcaggatgtgtttgagatgagatttgccaagatgccagatgagcctgaggagcctgtggtggccgtgagcagccctgctgtgcccccacccaccaaggtggtggccccacccagcagcagtgacagcagcagtgacagcagcagtgacagcgacagcagcacagatgattctgaggaggagcgggcccagaggctggccgagctgcaggagcagctgaaggctgtgcatgagcagctggccgccctgagccagccccagcagaacaagcccaagaagaaggagaaggacaagaaggagaagaagaaggagaagcacaagaggaaggaggaggtggaggagaacaagaagagcaaggccaaggagcccccacccaagaagaccaagaagaacaacagcagcaacagcaatgtgtccaagaaggagcccgcccccatgaagagcaagcccccacccacctatgaaagtgaggaggaggacaagtgcaagcccatgtcctatgaggagaagaggcagctgagcctggacatcaacaagctgcccggggagaagctgggccgggtggtgcacatcatccagagccgggagcccagcctgaagaacagcaacccagatgaaattgaaattgactttgagaccctgaagcccagcaccctgcgggagctggagcgctacgtgaccagctgcctgaggaagaagaggaagccccaggccgagaaggtggatgtgattgctggcagcagcaagatgaagggcttcagcagcagcgagagcgagagcagcagcgagagcagcagcagtgacagtgaagattctgaaacaggccctgcctag

SEQ ID NO: 145442 - DNA, 2625 bp, Artificial Sequence
  Description of Artificial Sequence: Synthetic coding sequence
atggacctgaacaccatcaagaagaggctggagaacaagtactatgccaaggccagcgagtgcatcgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgtcctctgccaaggagaagagcagccccagcgccacagagaaggtgttcaagcagcaggagatccccagcgtcttccccaagaccagcatcagccccctgaatgtggtgcagggcgcctctgtgaacagcagcagccagacagctgcccaggtgaccaagggcgtgaagaggaaggctgacaccaccaccccagccaccagcgctgtgaaggccagcagcgagttcagccccaccttcacagagaagtctgtggccctgccccccatcaaggagaacatgcccaagaatgtgctgcctgacagccagcagcagtacaacgtggtgaagacagtgaaggtgacagagcagctgcggcactgcagcgagatcctgaaggagatgctggccaagaagcacttctcctatgcctggcccttctacaaccctgtggatgtgaatgccctgggcctgcacaactactatgatgtggtgaagaaccccatggacctgggcaccatcaaggagaagatggacaaccaggagtacaaggatgcctacaagtttgctgctgatgtgcggctgatgttcatgaactgctacaagtacaaccccccagaccacgaggtggtgaccatggccaggatgctgcaggatgtgtttgagacccacttcagcaagatccccatcgagcctgtggagagcatgcccctgtgctacatcaagacagacatcacagagaccaccggccgggagaacaccaatgaggccagcagcgagggcaacagcagtgatgacagtgaagatgagcgggtgaagaggctggccaagctgcaggagcagctgaaggctgtgcaccagcagctgcaggtgctgagccaggtgcccttcaggaagctgaacaagaagaaggagaagagcaagaaggagaagaagaaggagaaggtgaacaacagcaatgaaaaccccaggaagatgtgtgagcagatgaggctgaaggagaagagcaagaggaaccagcccaagaagaggaagcagcagttcatcggcctgaagtcagaagatgaagataatgccaagcccatgaactatgatgagaagaggcagctgagcctgaacatcaacaagctgcccggggacaagctgggccgggtggtgcacatcatccagagccgggagcccagcctgagcaacagcaacccagatgaaattgaaattgactttgagaccctgaaggccagcaccctgcgggagctggagaagtatgtgtctgcctgcctgaggaagaggcccctgaagcccccagccaagaagatcatgatgagcaaggaggagctgcacagccagaagaagcaggagctggagaagaggctgctggatgtgaacaaccagctgaacagcaggaagaggcagaccaagagtgacaagacccagcccagcaaggctgtggagaatgtgtcccggctgtctgagagcagcagcagcagcagcagcagcagcgagagcgagagcagcagcagtgacctgagcagcagtgacagcagtgacagcgagagcgagatgttccccaagttcacagaggtgaagcccaatgacagccccagcaaagaaaatgtgaagaagatgaagaatgaatgcatccccccagagggccgcactggagtgacccagatcggctactgtgtgcaggacaccaccagcgccaacaccaccctggtgcaccagaccacccccagccacgtgatgccacccaaccaccaccagctggccttcaactaccaggagctggagcacctgcagacagtgaagaacatcagccccctgcagatcctgcccccatctggggacagcgagcagctgagcaatggcatcaccgtgatgcaccccagcggggacagcgacaccaccatgctggagagcgagtgccaggcccctgtgcagaaggacatcaagatcaagaatgctgacagctggaagagcctgggcaagcctgtgaagcccagcggcgtgatgaagagcagtgatgagctgttcaaccagttcaggaaggccgccatcgagaaggaggtgaaggcccggacccaggagctgatcaggaagcacctggagcagaacaccaaggagctgaaggccagccaggagaaccagagggacctgggcaatggcctgactgtggagagcttcagcaacaagatccagaacaagtgcagcggggaggagcagaaggagcaccagcagagcagcgaggcccaggacaagagcaagctgtggctgctgaaggaccgggacctggcccggcagaaggagcaggagaggagaagaagagaggccatggtgggcaccatcgacatgaccctgcagagcgacatcatgaccatgtttgagaacaactttgattag

SEQ ID NO: 145443 - DNA, 45 bp, Artificial Sequence
  Description of Artificial Sequence: Synthetic coding sequence
atgagcctgcccagccggcagacagccatcatcgtgaacccctag

SEQ ID NO: 145444 - DNA, 2844 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgagcagcgccaaggagaagagcagccccagcgccacagagaaggtgttcaagcagcaggagatccccagcgtcttccccaagaccagcatcagccccctgaatgtggtgcagggcgcctctgtgaacagcagcagccagacagctgcccaggtgaccaagggcgtgaagaggaaggctgacaccaccaccccagccaccagcgctgtgaaggccagcagcgagttcagccccaccttcacagagaagtctgtggccctgccccccatcaaggagaacatgcccaagaatgtgctgcctgacagccagcagcagtacaacgtggtgaagacagtgaaggtgacagagcagctgcggcactgcagcgagatcctgaaggagatgctggccaagaagcacttctcctatgcctggcccttctacaaccctgtggatgtgaatgccctgggcctgcacaactactatgatgtggtgaagaaccccatggacctgggcaccatcaaggagaagatggacaaccaggagtacaaggatgcctacaagtttgctgctgatgtgcggctgatgttcatgaactgctacaagtacaaccccccagaccacgaggtggtgaccatggccaggatgctgcaggatgtgtttgagacccacttcagcaagatccccatcgagcctgtggagagcatgcccctgtgctacatcaagacagacatcacagagaccaccggccgggagaacaccaatgaggccagcagcgagggcaacagcagtgatgattctgaagatgagcgggtgaagaggctggccaagctgcaggagcagctgaaggctgtgcaccagcagctgcaggtgctgagccaggtgcccttcaggaagctgaacaagaagaaggagaagagcaagaaggagaagaagaaggagaaggtgaacaacagcaatgaaaaccccaggaagatgtgtgagcagatgaggctgaaggagaagagcaagaggaaccagcccaagaagaggaagcagcagttcatcggcctgaagtcagaagatgaggacaatgccaagcccatgaactatgatgagaagaggcagctgagcctgaacatcaacaagctgcccggggacaagctgggccgggtggtgcacatcatccagagccgggagcccagcctgagcaacagcaacccagatgaaattgaaattgactttgagaccctgaaggccagcaccctgcgggagctggagaagtatgtgtctgcctgcctgaggaagaggcccctgaagcccccagccaagaagatcatgatgagcaaggaggagctgcacagccagaagaagcaggagctggagaagaggctgctggatgtgaacaaccagctgaacagcaggaagaggcagaccaagagtgacaagacccagcccagcaaggctgtggagaatgtgtcccggctgtctgagagcagcagcagcagcagcagcagcagcgagagcgagagcagcagcagtgacctgagcagcagtgacagcagtgacagcgagagcgagatgttccccaagttcacagaggtgaagcccaatgacagccccagcaaagaaaatgtgaagaagatgaagaatgaatgcatccccccagagggccgcactggagtgacccagatcggctactgtgtgcaggacaccaccagcgccaacaccaccctggtgcaccagaccacccccagccacgtgatgccacccaaccaccaccagctggccttcaactaccaggagctggagcacctgcagacagtgaagaacatcagccccctgcagatcctgccccccagcggggacagcgagcagctgagcaatggcatcaccgtgatgcaccccagcggggacagcgacaccaccatgctggagagcgagtgccaggcccctgtgcagaaggacatcaagatcaagaatgctgacagctggaagagcctgggcaagcctgtgaagcccagcggcgtgatgaagagcagtgatgagctgttcaaccagttcaggaaggccgccatcgagaaggaggtgaaggcccggacccaggagctgatcaggaagcacctggagcagaacaccaaggagctgaaggccagccaggagaaccagagggacctgggcaatggcctgactgtggagagcttcagcaacaagatccagaacaagtgcagcggggaggagcagaaggagcaccagcagagcagcgaggcccaggacaagagcaagctgtggctgctgaaggaccgggacctggcccggcagaaggagcaggagaggagaagaagagaggccatggtgggcaccatcgacatgaccctgcagagcgacatcatgaccatgtttgagaacaactttgattag

SEQ ID NO: 145445 - DNA, 2706 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcccccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgagcagcgccaaggagaagagcagccccagcgccacagagaaggtgttcaagcagcaggagatccccagcgtcttccccaagaccagcatcagccccctgaatgtggtgcagggcgcctctgtgaacagcagcagccagacagctgcccaggtgaccaagggcgtgaagaggaaggctgacaccaccaccccagccaccagcgctgtgaaggccagcagcgagttcagccccaccttcacagagaagtctgtggccctgccccccatcaaggagaacatgcccaagaatgtgctgcctgacagccagcagcagtacaacgtggtgaagacagtgaaggtgacagagcagctgcggcactgcagcgagatcctgaaggagatgctggccaagaagcacttctcctatgcctggcccttctacaaccctgtggatgtgaatgccctgggcctgcacaactactatgatgtggtgaagaaccccatggacctgggcaccatcaaggagaagatggacaaccaggagtacaaggatgcctacaagtttgctgctgatgtgcggctgatgttcatgaactgctacaagtacaaccccccagaccacgaggtggtgaccatggccaggatgctgcaggatgtgtttgagacccacttcagcaagatccccatcgagcctgtggagagcatgcccctgtgctacatcaagacagacatcacagagaccaccggccgggagaacaccaatgaggccagcagcgagggcaacagcagtgatgattctgaagatgagcgggtgaagaggctggccaagctgcaggagcagctgaaggctgtgcaccagcagctgcaggtgctgagccaggtgcccttcaggaagctgaacaagaagaaggagaagagcaagaaggagaagaagaaggagaaggtgaacaacagcaatgaaaaccccaggaagatgtgtgagcagatgaggctgaaggagaagagcaagaggaaccagcccaagaagaggaagcagcagttcatcggcctgaagtcagaagatgaggacaatgccaagcccatgaactatgatgagaagaggcagctgagcctgaacatcaacaagctgcccggggacaagctgggccgggtggtgcacatcatccagagccgggagcccagcctgagcaacagcaacccagatgaaattgaaattgactttgagaccctgaaggccagcaccctgcgggagctggagaagtatgtgtctgcctgcctgaggaagaggcccctgaagcccccagccaagaagatcatgatgagcaaggaggagctgcacagccagaagaagcaggagctggagaagaggctgctggatgtgaacaaccagctgaacagcaggaagaggcagaccaagagtgacaagacccagcccagcaaggctgtggagaatgtgtcccggctgtctgagagcagcagcagcagcagcagcagcagcgagagcgagagcagcagcagtgacctgagcagcagtgacagcagtgacagcgagagcgagatgttccccaagttcacagaggtgaagcccaatgacagccccagcaaagaaaatgtgaagaagatgaagaatgaatgcatccccccagagggccgcactggagtgacccagatcggctactgtgtgcaggacaccaccagcgccaacaccaccctggtgcaccagaccacccccagccacgtgatgccacccaaccaccaccagctggccttcaactaccaggagctggagcacctgcagacagtgaagaacatcagccccctgcagatcctgccccccagcggggacagcgagcagctgagcaatggcatcaccgtgatgcaccccagcggggacagcgacaccaccatgctggagagcgagtgccaggcccctgtgcagaaggacatcaagatcaagaatgctgacagctggaagagcctgggcaagcctgtgaagcccagcggcgtgatgaagagcagtgatgagctgttcaaccagttcaggaaggccgccatcgagaaggaggtgaaggcccggacccaggagctgatcaggaagcacctggagcagaacaccaaggagctgaaggccagccaggagaaccagagggacctgggcaatggcctgactgtggagagcttcagcaacaagatccagaacaagtgcagcggggaggagcagaaggagcaccagcagagcagcgaggcccaggacaagagcaagctgtggctgctgaaggaccgggacctggcccggcagaaggagcaggagaggagaagaagagaggccatggtgggcaccatcgacatgaccctgcagagcgacatcatgaccatgtttgagaacaactttgattag

SEQ ID NO: 145446 - DNA, 2844 bp, Artificial Sequence; identical to SEQ ID NO: 145444
  Description of Artificial Sequence: Synthetic coding sequence

SEQ ID NO: 145447 - DNA, 2844 bp, Artificial Sequence; identical to SEQ ID NO: 145444
  Description of Artificial Sequence: Synthetic coding sequence

SEQ ID NO: 145448 - DNA, 531 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgagcagcgccaaggagaagagcagccccagcgccacagagaaggtgttcaagcagcaggagtag

SEQ ID NO: 145449 - DNA, 1389 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgagcagcgccaaggagaagagcagccccagcgccacagagaaggtgttcaagcagcaggagatccccagcgtcttccccaagaccagcatcagccccctgaatgtggtgcagggcgcctctgtgaacagcagcagccagacagctgcccaggtgaccaagggcgtgaagaggaaggctgacaccaccaccccagccaccagcgctgtgaaggccagcagcgagttcagccccaccttcacagagaagtctgtggccctgccccccatcaaggagaacatgcccaagaatgtgctgcctgacagccagcagcagtacaacgtggtgaagacagtgaaggtgacagagcagctgcggcactgcagcgagatcctgaaggagatgctggccaagaagcacttctcctatgcctggcccttctacaaccctgtggatgtgaatgccctgggcctgcacaactactatgatgtggtgaagaaccccatggacctgggcaccatcaaggagaagatggacaaccaggagtacaaggatgcctacaagtttgctgctgatgtgcggctgatgttcatgaactgctacaagtacaaccccccagaccacgaggtggtgaccatggccaggatgctgcaggatgtgtttgagacccacttcagcaagatccccatcgagcctgtggagagcatgcccctgtgctacatcaagacagacatcacagagaccaccggccgggagaacaccaatgaggccagcagcgagggcaacagcagtgatgattctgaagatgagcgggtgaagaggctggccaagctgcaggagcagctgaaggctgtgcaccagcagctgcaggtgctgagccaggtgcccttcaggaagctgaacaagaagaaggagaagagcaagaaggagaagaagaaggagtag

SEQ ID NO: 145450 - DNA, 468 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacatcgcctag

SEQ ID NO: 145451 - DNA, 603 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgagcagcgccaaggagaagagcagccccagcgccacagagaaggtgttcaagcagcaggagatccccagcgtcttccccaagaccagcatcagccccctgaatgtggtgcagggcgcctctgtgaacagcagctag

SEQ ID NO: 145452 - DNA, 468 bp, Artificial Sequence; identical to SEQ ID NO: 145450
  Description of Artificial Sequence: Synthetic coding sequence

SEQ ID NO: 145453 - DNA, 159 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttctag

SEQ ID NO: 145454 - DNA, 291 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaatag

SEQ ID NO: 145455 - DNA, 99 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgtag

SEQ ID NO: 145456 - DNA, 1398 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacaccatgttcagcaactgctacctgtacaacaagccaggagatgacatcgtgctgatggcccaggccctggagaagctgttcatgcagaagctgagccagatgccccaggaggagcaggtggtgggcgtgaaggagcgcatcaagaagggcacccagcagaacattgctgtgagcagcgccaaggagaagagcagccccagcgccacagagaaggtgttcaagcagcaggagatccccagcgtcttccccaagaccagcatcagccccctgaatgtggtgcagggcgcctctgtgaacagcagcagccagacagctgcccaggtgaccaagggcgtgaagaggaaggctgacaccaccaccccagccaccagcgctgtgaaggccagcagcgagttcagccccaccttcacagagaagtctgtggccctgccccccatcaaggagaacatgcccaagaatgtgctgcctgacagccagcagcagtacaacgtggtgaagacagtgaaggtgacagagcagctgcggcactgcagcgagatcctgaaggagatgctggccaagaagcacttctcctatgcctggcccttctacaaccctgtggatgtgaatgccctgggcctgcacaactactatgatgtggtgaagaaccccatggacctgggcaccatcaaggagaagatggacaaccaggagtacaaggatgcctacaagtttgctgctgatgtgcggctgatgttcatgaactgctacaagtacaaccccccagaccacgaggtggtgaccatggccaggatgctgcaggatgtgtttgagacccacttcagcaagatccccatcgagcctgtggagagcatgcccctgtgctacatcaagacagacatcacagagaccaccggccgggagaacaccaatgaggccagcagcgagggcaacagcagtgatgattctgaagatgagcgggtgaagaggctggccaagctgcaggagcagctgaaggctgtgcaccagcagctgcaggtgctgagccaggtgcccttcaggaagctgaacaagaagaaggagaagagcaagaaggagaagaagaaggagaagaagaagtag

SEQ ID NO: 145457 - DNA, 303 bp, Artificial Sequence
  Description of Artificial Sequence: Synthetic coding sequence
atgagcctgcccagccggcagacagccatcatcgtgaaccccccacctcctgagtacatcaacaccaagaagaatggccgcctgaccaaccagctgcagtacctgcagaaggtggtgctgaaggacctgtggaagcacagcttctcctggcccttccagaggcctgtggatgctgtgaagctgcagctgcctgactactacaccatcatcaagaaccccatggacctgaacaccatcaagaagaggctggagaacaagtactatgccaaggcctctgaatgtattgaggacttcaacacctag

SEQ ID NO: 145458 - DNA, 5550 bp, Artificial Sequence
  Description of Artificial Sequence: Synthetic coding sequence
atggctgtgtcccggctggacaggctcttcatcctgctggacaccggcaccacccctgtgaccaggaaggctgctgcccagcagctgggggaggtggtgaagctgcacccccatgagctgaacaacctgctgagcaaggtgctgatctacctgcggagcgccaactgggacaccagaattgctgctggccaggccgtggaggccatcgtgaagaatgtgcctgagtggaaccctgtgcccaggacccggcaggagcccaccagcgagagctccatggaggacagccccaccacagagcggctgaactttgacagatttgacatctgccgcctgctgcagcacggggccagcctgctgggcagcgctggagctgagtttgaggtgcaggatgagaagtctggagaggtggaccccaaggagcgcatcgcccggcagaggaagctgctgcagaagaagctgggcctgaacatgggagaggccatcggcatgagcacagaggagctgttcaatgatgaggacctggactacacccccaccagcgccagctttgtgaacaagcagcccaccctgcaggccgctgagctgattgacagcgagttccgggccggcatgagcaaccggcagaagaacaaggccaagaggatggccaagctgtttgccaagcagaggagcagagatgctgtggagaccaatgagaagagcaatgacagcacagatggagagcctgaggagaagaggaggaagatcgccaacgtggtgatcaaccagagcgccaatgacagcaaggtgctgattgacaacatcccagacagcagcagcctgattgaggagaccaatgagtggcccctggagagcttctgtgaggagctgtgcaatgacctcttcaaccccagctgggaggtgagacatggagctggcaccggcctgcgggagatcctgaaggcccacggcaagagcggcggcaagatgggagacagcaccctggaggagatgatccagcagcaccaggagtggctggaggacctggtgatccggctgctgtgtgtgtttgccctggacagatttggagactttgtgtctgatgaggtggtggcccctgtgcgggagacctgtgcccagaccctgggcgtggtgctgaagcacatgaatgaaacaggagtgcacaagacagtggatgtgctgctgaagctgctgacccaggagcagtgggaggtgagacatggaggcctgctgggcatcaagtatgccctggccgtgcggcaggacgtcatcaacaccctgctgcccaaggtgctgacccgcatcatcgagggcctgcaggacctggatgatgatgtgcgggctgtggccgccgccagcctggtgcctgtggtggagagcctggtgtacctgcagacccagaaggtgcccttcatcatcaacaccctgtgggatgccctgctggagctggatgacctgacagccagcaccaacagcatcatgaccctgctgagcagcctgctgacctacccccaggtgcagcagtgcagcatccagcagagcctgactgtgctggtgccccgggtgtggcccttcctgcaccacaccatcagctctgtgcggcgggccgccctggagaccctcttcaccctgctgagcacccaggaccagaacagcagctcctggctgatccccatcctgcctgacatgctgcggcacatcttccagttctgtgtgctggagagcagccaggagatcctggacctgatccacaaggtgtggatggagctgctgagcaaggcctctgtgcagtatgtggtggccgccgcctgcccctggatgggcgcctggctgtgcctgatgatgcagcccagccacctgcccatcgacctgaacatgctgctggaggtgaaggcccgggccaaggagaagacaggaggcaaggtgcggcagggccagagccagaacaaggaggtgctgcaggagtacatcgccggggctgacaccatcatggaggaccctgccacccgggactttgtggtgatgagggccaggatgatggccgccaagctgctgggcgccctgtgctgctgcatctgtgaccccggggtgaatgtggtgacccaggagatcaagccagctgagagcctgggccagctgctgctcttccacctgaacagcaagagcgccctgcagaggatctctgtggccctggtgatctgtgagtgggccgccctgcagaaggagtgcaaggctgtgaccctggccgtgcagccccggctgctggacatcctgtctgagcacctgtactatgatgaaattgctgtgcccttcaccaggatgcagaatgaatgcaagcagctgatcagcagcctggctgatgtgcacatcgaggtgggcaacagagtgaacaacaacgtgctgaccatcgaccaggccagtgacctggtgaccaccgtcttcaatgaggccaccagcagctttgacctgaacccccaggtgctgcagcagctggacagcaagaggcagcaggtgcagatgacagtgacagagaccaaccaggagtggcaggtgctgcagctgcgggtgcacacctttgctgcctgtgctgtggtgtccctgcagcagctgcctgagaagctgaaccccatcatcaagcccctgatggagaccatcaagaaggaggagaacaccctggtgcagaactatgctgcccagtgcatcgccaagctgctgcagcagtgcaccaccaggaccccctgccccaacagcaagatcatcaagaacctgtgcagcagcctgtgtgtggacccctacctgaccccctgtgtgacctgccctgtgcccacccagagcggccaggagaacagcaagggcagcaccagcgagaaggatggcatgcaccacacagtgaccaagcaccggggcatcatcaccctgtaccgccaccagaaggccgcctttgccatcaccagccggcggggccccacccccaaggctgtgaaggcccagattgctgacctgcctgctggcagcagcggcaacatcctggtggagctggatgaggcccagaagccctacctggtgcagaggagaggagctgagtttgccctgaccaccatcgtgaagcactttggaggagagatggctgtgaagctgccccacctgtgggatgccatggtgggccccctgaggaacaccatcgacatcaacaactttgatggcaagagcctgctggacaagggggacagccctgcccaggagctggtgaacagcctgcaggtgtttgaaacagctgctgcctccatggacagcgagctgcaccccctgctggtgcagcacctgccccacctgtacatgtgcctgcagtaccccagcacagctgtgcgccacatggccgcccgctgtgtgggcgtgatgagcaagatcgccaccatggagaccatgaacatcttcctggagaaggtgctgccctggctgggcgccattgatgattctgtgaagcaggagggcgccatcgaggccctggcctgtgtgatggagcagctggatgtgggcatcgtgccctacatcgtgctgctggtggtgcctgtgctgggccgcatgtctgaccagacagattctgtgcgcttcatggccacccagtgctttgccaccctcatccggctgatgcccctggaggccggcatcccagacccccccaacatgtctgctgagctgatccagctgaaggccaaggagcggcacttcctggagcagctgctggatggcaagaagctggagaactacaagatccctgtgcccatcaatgctgagctgaggaagtaccagcaggatggagtgaactggctggccttcctgaacaagtacaagctgcacggcatcctgtgtgatgacatgggcctgggcaagaccctgcagagcatctgcatcctggccggggaccactgccaccgggcccaggagtatgcccggagcaagctggccgagtgcatgcccctgcccagcctggtggtgtgcccccccaccctgaccggccactgggtggatgaggtgggcaagttctgcagccgggagtacctgaaccccctgcactacacaggccccccaacagagcgcatccggctgcagcaccaggtgaagaggcacaacctgattgtggccagctatgatgtggtgagaaatgacatcgacttcttcaggaacatcaagttcaactactgcatcctggatgagggccacgtgatcaagaatggcaagaccaagctgagcaaggctgtgaagcagctgacagccaactaccgcatcatcctgagcggcacccccatccagaacaacgtgctggagctgtggagcctgtttgacttcctgatgcctggcttcctgggcacagagcggcagtttgctgcccgctatggcaagcccatcctggccagcagagatgcccggagcagcagccgggagcaggaggccggcgtgctggccatggatgccctgcaccggcaggtgctgcccttcctgctgcggaggatgaaggaggatgtgctgcaggacctgccccccaagatcatccaggactactactgcaccctgagccccctgcaggtgcagctgtatgaagattttgccaagagccgggccaagtgtgatgtggatgaaacagtgagcagcgccaccctgtctgaggagacagagaagcccaagctgaaggccactggacatgtgttccaggccctgcagtacctgaggaagctgtgcaaccacccagccctggtgctgaccccccagcaccctgagttcaagaccacagctgagaagctggccgtgcagaacagcagcctgcatgacatccagcacgcccccaagctgagcgccctgaagcagctgctgctggactgtggcctgggcaatggcagcaccagcgagagcggcacagagagcgtggtggcccagcaccgcatcctgatcttctgccagctgaagtccatgctggacatcgtggagcatgacctgctgaagccccacctgcccagcgtgacctacctgcggctggatggcagcatccccccaggccagaggcacagcatcgtgagccgcttcaacaatgaccccagcattgatgtgctgctgctgaccacccacgtgggcggcctgggcctgaacctgaccggggctgacacagtggtgtttgtggagcatgactggaaccccatgagggacctgcaggccatggaccgggcccacagaattggccagaagagggtggtgaatgtgtaccgcctcatcacccggggcaccctggaggagaagatcatgggcctgcagaagttcaagatgaacatcgccaacacagtcatcagccaggagaacagcagcctgcagagcatgggcacagaccagctgctggacctcttcaccctggacaaggatggcaaggccgagaaggctgacaccagcaccagcggcaaggcctccatgaagagcatcctggagaacctgagtgacctgtgggaccaggagcagtatgattctgagtacagcctggagaacttcatgcacagcctgaagtag

SEQ ID NO: 145459 - DNA, 2100 bp, Artificial Sequence
  Description of Artificial Sequence: Synthetic coding sequence
aagctgtggttcaagaacacagaggactacagaagaacagccctgacccggctgaccagcggcgtgatggagcagctggatgtgggcatcgtgccctacatcgtgctgctggtggtgcctgtgctgggccgcatgtctgaccagacagattctgtgcgcttcatggccacccagtgctttgccaccctcatccggctgatgcccctggaggccggcatcccagacccccccaacatgtctgctgagctgatccagctgaaggccaaggagcggcacttcctggagcagctgctggatggcaagaagctggagaactacaagatccctgtgcccatcaatgctgagctgaggaagtaccagcaggatggagtgaactggctggccttcctgaacaagtacaagctgcacggcatcctgtgtgatgacatgggcctgggcaagaccctgcagagcatctgcatcctggccggggaccactgccaccgggcccaggagtatgcccggagcaagctggccgagtgcatgcccctgcccagcctggtggtgtgcccccccaccctgaccggccactgggtggatgaggtgggcaagttctgcagccgggagtacctgaaccccctgcactacacaggccccccaacagagcgcatccggctgcagcaccaggtgaagaggcacaacctgattgtggccagctatgatgtggtgagaaatgacatcgacttcttcaggaacatcaagttcaactactgcatcctggatgagggccacgtgatcaagaatggcaagaccaagctgagcaaggctgtgaagcagctgacagccaactaccgcatcatcctgagcggcacccccatccagaacaacgtgctggagctgtggagcctgtttgacttcctgatgcctggcttcctgggcacagagcggcagtttgctgcccgctatggcaagcccatcctggccagcagagatgcccggagcagcagccgggagcaggaggccggcgtgctggccatggatgccctgcaccggcaggtgctgcccttcctgctgcggaggatgaaggaggatgtgctgcaggacctgccccccaagatcatccaggactactactgcaccctgagccccctgcaggtgcagctgtatgaagattttgccaagagccgggccaagtgtgatgtggatgaaacagtgagcagcgccaccctgtctgaggagacagagaagcccaagctgaaggccactggacatgtgttccaggccctgcagtacctgaggaagctgtgcaaccacccagccctggtgctgaccccccagcaccctgagttcaagaccacagctgagaagctggccgtgcagaacagcagcctgcatgacatccagcacgcccccaagctgagcgccctgaagcagctgctgctggactgtggcctgggcaatggcagcaccagcgagagcggcacagagagcgtggtggcccagcaccgcatcctgatcttctgccagctgaagtccatgctggacatcgtggagcatgacctgctgaagccccacctgcccagcgtgacctacctgcggctggatggcagcatccccccaggccagaggcacagcatcgtgagccgcttcaacaatgaccccagcattgatgtgctgctgctgaccacccacgtgggcggcctgggcctgaacctgaccggggctgacacagtggtgtttgtggagcatgactggaaccccatgagggacctgcaggccatggaccgggcccacagaattggccagaagagggtggtgaatgtgtaccgcctcatcacccggggcaccctggaggagaagatcatgggcctgcagaagttcaagatgaacatcgccaacacagtcatcagccaggagaacagcagcctgcagagcatgggcacagaccagctgctggacctcttcaccctggacaaggatggcaaggccgagaaggctgacaccagcaccagcggcaaggcctccatgaagagcatcctggagaacctgagtgacctgtgggaccaggagcagtatgattctgagtacagcctggagaacttcatgcacagcctgaagtag

SEQ ID NO: 145460 - DNA, 2034 bp, Artificial Sequence
  Description of Artificial Sequence: Synthetic coding sequence
atggagcagctggatgtgggcatcgtgccctacatcgtgctgctggtggtgcctgtgctgggccgcatgtctgaccagacagattctgtgcgcttcatggccacccagtgctttgccaccctcatccggctgatgcccctggaggccggcatcccagacccccccaacatgtctgctgagctgatccagctgaaggccaaggagcggcacttcctggagcagctgctggatggcaagaagctggagaactacaagatccctgtgcccatcaatgctgagctgaggaagtaccagcaggatggagtgaactggctggccttcctgaacaagtacaagctgcacggcatcctgtgtgatgacatgggcctgggcaagaccctgcagagcatctgcatcctggccggggaccactgccaccgggcccaggagtatgcccggagcaagctggccgagtgcatgcccctgcccagcctggtggtgtgcccccccaccctgaccggccactgggtggatgaggtgggcaagttctgcagccgggagtacctgaaccccctgcactacacaggccccccaacagagcgcatccggctgcagcaccaggtgaagaggcacaacctgattgtggccagctatgatgtggtgagaaatgacatcgacttcttcaggaacatcaagttcaactactgcatcctggatgagggccacgtgatcaagaatggcaagaccaagctgagcaaggctgtgaagcagctgacagccaactaccgcatcatcctgagcggcacccccatccagaacaacgtgctggagctgtggagcctgtttgacttcctgatgcctggcttcctgggcacagagcggcagtttgctgcccgctatggcaagcccatcctggccagcagagatgcccggagcagcagccgggagcaggaggccggcgtgctggccatggatgccctgcaccggcaggtgctgcccttcctgctgcggaggatgaaggaggatgtgctgcaggacctgccccccaagatcatccaggactactactgcaccctgagccccctgcaggtgcagctgtatgaagattttgccaagagccgggccaagtgtgatgtggatgaaacagtgagcagcgccaccctgtctgaggagacagagaagcccaagctgaaggccactggacatgtgttccaggccctgcagtacctgaggaagctgtgcaaccacccagccctggtgctgaccccccagcaccctgagttcaagaccacagctgagaagctggccgtgcagaacagcagcctgcatgacatccagcacgcccccaagctgagcgccctgaagcagctgctgctggactgtggcctgggcaatggcagcaccagcgagagcggcacagagagcgtggtggcccagcaccgcatcctgatcttctgccagctgaagtccatgctggacatcgtggagcatgacctgctgaagccccacctgcccagcgtgacctacctgcggctggatggcagcatccccccaggccagaggcacagcatcgtgagccgcttcaacaatgaccccagcattgatgtgctgctgctgaccacccacgtgggcggcctgggcctgaacctgaccggggctgacacagtggtgtttgtggagcatgactggaaccccatgagggacctgcaggccatggaccgggcccacagaattggccagaagagggtggtgaatgtgtaccgcctcatcacccggggcaccctggaggagaagatcatgggcctgcagaagttcaagatgaacatcgccaacacagtcatcagccaggagaacagcagcctgcagagcatgggcacagaccagctgctggacctcttcaccctggacaaggatggcaaggccgagaaggctgacaccagcaccagcggcaaggcctccatgaagagcatcctggagaacctgagtgacctgtgggaccaggagcagtatgattctgagtacagcctggagaacttcatgcacagcctgaagtag

SEQ ID NO: 145461 - DNA, 1233 bp, Artificial Sequence
  Description of Artificial Sequence: Synthetic coding sequence
atgggcgccaatgccagcaactacccccacagctgcagcccccgggtgggcggcaacagccaggcccagcagaccttcatcggcaccagcagctacagccagcagggctacggctgtgagagcaagctgtacagcctggaccacggccacgagaagccccaggacaagaagaagaggaccagcggcctggccaccctgaagaagaagttcatcaagaggaggaagagcaacagatctgctgaccacgccaagcagatgagggagctgctgagcggctgggatgtgagagatgtgaatgccctggtggaggagtatgagggcaccagcgccctgaaggagctgagcctgcaggccagcctggcccggcctgaggcccggaccctgcagaaggacatggctgacctgtatgagtacaagtactgcacagatgtggacctgatcttccaggagacctgcttccctgtgcaccgggccatcctggccgcccgctgccccttcttcaagaccctgctgagcagcagcccagaatatggagctgagatcatcatggacatcaacacagctggcatcgacatgcccatgttcagcgccctgctgcactacctgtacaccggggagtttggcatggaggacagccgcttccagaatgtggacatcctggtgcagctgtctgaggagtttggcacccccaacagcctggatgtggacatgaggggcctgtttgactacatgtgctactatgatgtggtgctgtccttcagcagtgacagcgagctggtggaggcctttggaggcaaccagaactgcctggatgaggagctgaaggcccacaaggctgtgatcagcgcccggagccccttcttcaggaacctgctgcagaggcgcatcagaactggagaggagatcacagacaggaccctgcggacccccacccgcatcatcctggatgagagcatcatccccaagaagtatgccaccgtcatcctgcactgcatgtacacagatgtggtggacctgtctgtgctgcactgcagccccagcgtgggcagcctgtctgaggtgcaggccctggtggccggcaagcccaacatgaccagggctgaggaggccatggagctgtaccacatcgccctcttcctggagttcaacatgctggcccaggaggagaccaccgtcatccggcctgcctgtgccgctgagctgagcaacagctgcctgctgccccagagctag
